United States Patent 8,344,211 (PLANT NUCLEOTIDE SEQUENCES AND CORRESPONDING POLYPEPTIDES) - sequence listing, part 4

SEQ ID NO: 14691 - DNA, 880 bp, Zea mays
  misc_feature: Ceres CLONE 1376707-F
  misc_feature: Encodes the peptide sequence at SEQ ID NO. 14692
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (41)..(41): n is a, c, t, g, unknown, or other
  misc_feature (50)..(50): n is a, c, t, g, unknown, or other
  misc_feature (860)..(860): n is a, c, t, g, unknown, or other
  misc_feature (880)..(880): n is a, c, t, g, unknown, or other
nnnnnnnnnnnnnccccnnnccccccccccccccccccccncgcggcttntagagaaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaaggtggcagggtcccccccccgccgccccatggaggacccgtggccacggccggggggggggggcggagtgcccccagccgacgtgctctggcccgccgaactccaacgctggagcacgtctgaggaagcgggtgaccggcggcgggaccggagggcggcggccgtcgggagggccctaccggcccgagaacccgaaaaaggggcagggcggcggaacggggggacgtggctgcccccaagaaggccggtgcggtgccgcgcgagggcgggccccgtggctcgcagccacgcgcaggccggggactgggaaggggacgacacgcgggtgggccggcctgagaggcgcgcccggtaagcagcggcccccccgcccgctcccgccttctttgctccccatgcccgaagccaccgctacacacgcggcacgggtgcgccgccgcggagaaacaagtgcgacggggcgagaggaggacgtgggcgaanccgagagcagccagcaggtn

SEQ ID NO: 14692 - protein, 72 aa, Zea mays
  misc_feature: Ceres CLONE 1376707-F
  misc_feature: SWISSPROT Homolog: EC 1.1.1.1 Alcohol dehydrogenase
MAAADASSLPPSAITCRAAVAWGPGQPLVMEEGGRVPPPPPHGGPVATAGGGGRSAPSRRALARRTPTLEHV

SEQ ID NO: 14693 - DNA, 647 bp, Zea mays
  misc_feature: Ceres CLONE 1376708-F
  misc_feature: Encodes the peptide sequence at SEQ ID NO. 14694
  misc_feature (309)..(309): n is a, c, t, g, unknown, or other
  misc_feature (344)..(344): n is a, c, t, g, unknown, or other
  misc_feature (351)..(351): n is a, c, t, g, unknown, or other
  misc_feature (352)..(352): n is a, c, t, g, unknown, or other
tccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacangagatgacctgggggcgatgggcgcggcaaggtantggacgnncggcgcgggctggacctgacgctggacccacggtcggcttcgggtttcaggccagaggcgaggactgttccgcgagatcgacatgcaaaatcaggtggtgcaaggaaatcccgggggagggtcaccaccttctacctgtgggcccaggggaggcggcacaagagaaccaactccaggtcctggggcacagggggggggggggcccctaagctgggaacccaagggtgttcccccgggaaagggcccccgggaaaaaacaaattccccccccttggggtgacccccacaccggggg

SEQ ID NO: 14694 - protein, 51 aa, Zea mays
  misc_feature: Ceres CLONE 1376708-F
  misc_feature (32)..(32): Xaa is any aa, unknown, or other
  misc_feature (43)..(43): Xaa is any aa, unknown, or other
  misc_feature (46)..(46): Xaa is any aa, unknown, or other
MRSFAPVFLSAVVAWLELAGTAQGGNFYQDTXDDLGAMGAARXWTXGAGWT

SEQ ID NO: 14695 - DNA, 618 bp, Zea mays
  misc_feature: Ceres CLONE 1376715-F
  misc_feature: Translation starting site: 216
  misc_feature (146)..(146): n is a, c, t, g, unknown, or other
  misc_feature (496)..(496): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (593)..(593): n is a, c, t, g, unknown, or other
tccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcanagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagacattgggggaggtgatgatgctttcacaccttcttcaggagactgggctgggagcacgcccccgtggctgtttttgttgaccttgagccactgtcatcgatgagggtgaggactggcacctaccgccagctctttcatcctgagcagctcatcagtgggnaagggaggatgcagccacacttttcgctcgtgtcacacacattgnnnaagggaagattggtggactggtgcttgacgcatcaggaagtttgcagatnattgacttgcctcagggcttctccc

SEQ ID NO: 14696 - DNA, 630 bp, Zea mays
  misc_feature: Ceres CLONE 1376716-F
  misc_feature: Encodes the peptide sequence at SEQ ID NO. 14697
  misc_feature (452)..(452): n is a, c, t, g, unknown, or other
  misc_feature (455)..(455): n is a, c, t, g, unknown, or other
  misc_feature (630)..(630): n is a, c, t, g, unknown, or other
tggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaacatcagggcacaacaactacnacnacttgtgctagcaaaccttgctgcctactctagcaacagcagtttcctccattcaaccaactagctgcattggactctgctttcttatttgcaacaacacaactaccattcagccagctacctgctgcctaccccccagcatttcttccattcaccaactggcagcattgactcn

SEQ ID NO: 14697 - protein, 103 aa, Zea mays
  misc_feature: Ceres CLONE 1376716-F
  misc_feature (100)..(100): Xaa is any aa, unknown, or other
  misc_feature (101)..(101): Xaa is any aa, unknown, or other
MAAKIFCLLMLLGLSASAATATIFPQCSQAPIASLLPPYLSPAVSSVCENPILQPYRIQQAITAGILPLSPLFLQQSSALLHQLPLVHLLAQTSGHNNYXXLC

SEQ ID NO: 14698 - DNA, 671 bp, Zea mays
  misc_feature: Ceres CLONE 1376720-F
  misc_feature: Translation starting site: 397
  misc_feature: Pfam Name: eIF-6 Pfam Description: eIF-6 family
  misc_feature (299)..(299): n is a, c, t, g, unknown, or other
  misc_feature (536)..(536): n is a, c, t, g, unknown, or other
  misc_feature (538)..(538): n is a, c, t, g, unknown, or other
  misc_feature (647)..(647): n is a, c, t, g, unknown, or other
  misc_feature (661)..(661): n is a, c, t, g, unknown, or other
  misc_feature (662)..(662): n is a, c, t, g, unknown, or other
tacccgcggtggcggccgctctagaactagtggatcccccgggctgcaggaattcgcacgagaccattacctagaacatcctaatcgaaaaaaatcaaaccgggaccgggtggcctcttgccctcttccgttccgtctcattctcatccccgacccccgcaccgcagcgtaaaccctagtccccggcggcgaccttgcggcctccgctgcgctctgactggtgcgcgtttagacgaggagctgcggcggccaagaccaatcgaccatggctacccgtatccagtttgagaacaactgtngaaattggtgttttctccaagctgacaaatgcttactgtctggtagcgattggagggtcagagaacttctacagtgcctttgaggctgagcttgcagatgccatccctgtggtcaagaacctctattggtggcactagaataaaggcccgactttgtgttggaaacaagaatggacttctattgccacatactacaaccgaccaagagcttcagcatctgaaggaattgctgctgtncnaaagggggtggttcagcgctttgggtgggagaggttatctggcccttggcatttgcatagcctgcaattgaccatgtttgcacttacgcaccctgaccttgacaggagnaaactggaggagtnnctttgagag

SEQ ID NO: 14699 - DNA, 669 bp, Zea mays
  misc_feature: Ceres CLONE 1376721-F
  misc_feature: Translation starting site: 146
  misc_feature (289)..(289): n is a, c, t, g, unknown, or other
  misc_feature (344)..(344): n is a, c, t, g, unknown, or other
  misc_feature (669)..(669): n is a, c, t, g, unknown, or other
tggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcggnctgtacccctacgcggagtacctgaggcagccgcagtgcagcccgctggcggcgncgcctactacggccggggtgtgggcagccgagccgcatgttccagccgctccggcaacagtgctgcagcagcaaatggaggatgatggacgtgccatcccgcccccaacaacttgaaatgatgatgcacctttggaggggccgcttgccccaaaaaaacccgggaaaaacccgttttgtatgaaaaaacaaaaaaacgggttggacccccagggttccaccccccggggccagggggggggggccaaaaatggggcgcccgtggtgggaattctcaaagaaaccggtggccagttaccggcacccccccgtgggggggcctcttn

SEQ ID NO: 14700 - DNA, 720 bp, Zea mays
  misc_feature: Ceres CLONE 1376725-F
  misc_feature: Encodes the peptide sequence at SEQ ID NO. 14701
  misc_feature (584)..(584): n is a, c, t, g, unknown, or other
  misc_feature (591)..(591): n is a, c, t, g, unknown, or other
  misc_feature (592)..(592): n is a, c, t, g, unknown, or other
  misc_feature (678)..(678): n is a, c, t, g, unknown, or other
  misc_feature (720)..(720): n is a, c, t, g, unknown, or other
acccgcggtggcggccgctctagaactagtggatcccccgggctgcaggaattcgcacgagaccattacctagaacatcctaatcaaaagtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcagctcggtcaacttctctgaccgggtgttgcggatcgagatcgtcgctggggatgacgccctcggggccaagggcgccaccggcgaggggtgctcatctcttgccgactgggcgtgccaccgcaagcgacgacgggaggagctccgacgcgacaaagaatctagaaaatacatgccagatccagcaaactgcaaaagtgaagctgaagaatgtgatgcctancgagaanngcatgagcctgtagctatgatagaagaatctcccgctgatattgaggcaagatggtgaggatggaaaaagcagcgactcgactggnagtatggagggtactcagggttttgaaagtaagtctatgtan

SEQ ID NO: 14701 - protein, 113 aa, Zea mays
  misc_feature: Ceres CLONE 1376725-F
  misc_feature (92)..(92): Xaa is any aa, unknown, or other
  misc_feature (95)..(95): Xaa is any aa, unknown, or other
MDPDFSPASGGPSFEFAFSSVNFSDRVLRIEIVAGDDALGAKGATGEGCSSLADWACHRKRRREELRRDKESRKYMPDPANCKSEAEECDAXREXHEPVAMIEESPADIEARW

SEQ ID NO: 14702 - DNA, 681 bp, Zea mays
  misc_feature: Ceres CLONE 1376726-F
  misc_feature: Encodes the peptide sequence at SEQ ID NO. 14703
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaacgctccccggaacgaacgacgcagcccaacccgttcccaccaaaccagcggcaccacccatggcttcggcggcggcgagatccggtctccggtcgctggcggtgcgcgccggcccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgataagccgccggcgtacccctatctgcacatccggcacaaggagttcccatggggccctgatggcttgtttgagacgaaggacaccactgagccctgattagcacacattcaggagctggtgcatgcttaaaagagtatatgggtgtttcagggattttcctttttccctgagacctatttgctgcaacaaggaataagaatgaccaaactcttggtatggacagggaggttttaactgtggtaagctgttaccggtccggtncttccttttctttggcggcccaccccaaaaaatgggccccctggaaagtggattcttggcccg

SEQ ID NO: 14703 - protein, 96 aa, Zea mays
  misc_feature: Ceres CLONE 1376726-F
  misc_feature: SWISSPROT Homolog: EC 1.9.3.1 Cytochrome-c oxidase
MASAAARSGLRSLAVRAGPLRRRMSSSVHDDAYETAKWEKITYAGIVTCTLLAAYNLSKGHPHFDKPPAYPYLHIRHKEFPWGPDGLFETKDTTEP

SEQ ID NO: 14704 - DNA, 737 bp, Zea mays
  misc_feature: Ceres CLONE 1376727-F
  misc_feature: Translation starting site: 191
  misc_feature: Pfam Name: Fer2 Pfam Description: 2Fe-2S iron-sulfur cluster binding domain
  misc_feature: SWISSPROT Homolog: EC 1.3.5.1 Succinate dehydrogenase (ubiquinone)
ggagctccccgcggtggcggccgctctagaactagtggatcccccgggctgcaggaattcgcacgagaccattacctagaacatcctaatcgaaaaacgcgcgcccaaaggcccccaaggccccaaccccaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactgcgggccgatggtgctggacgcgctgctcaagatcaagaacgagcaggacccgtcgctcaccttccgccgaggttggccgggagggcatctggcgggagctgcgccaggaacatcgacggcgacaacggcctcgcctgcctcaccaagatctccggcgcctcctcccgcgtccacggtctcgcgcttccccaaaatgttcgtcgcagaggaaccgggggggtgggacatgaccaacttctacagccagtaccagagcgtcgagccatggctcaagcgcaggacagcccccgcagaaagggggaaggggatccccgcaaaccagg

SEQ ID NO: 14705 - DNA, 686 bp, Zea mays
  misc_feature: Ceres CLONE 1376728-F
  misc_feature: Encodes the peptide sequence at SEQ ID NO. 14706
  misc_feature (395)..(395): n is a, c, t, g, unknown, or other
  misc_feature (402)..(402): n is a, c, t, g, unknown, or other
  misc_feature (482)..(482): n is a, c, t, g, unknown, or other
  misc_feature (514)..(514): n is a, c, t, g, unknown, or other
  misc_feature (532)..(532): n is a, c, t, g, unknown, or other
tggagctccaccggcggtggcggccgctctagaactagtggatcccccgggctgcaggaattcgcacgagaccattacctagaacatcctaatcgaaaaccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcaccctagcagagagttttgcgagatgaagtgccagcaccaccagnaccctgncaggaaagagatctgcgtacagcagtgcatgagctatggtctcagccaccgtgcgagtggccagtgttgtttgatgaggntgaaaaacgcttccatggctggaaaacgacgntggcccgagaatcctccnagcggggggacgacctacgacgtttatataaccggacggtctaattaataaaataagctaccccccgcggttcctttaaaaaaattggcttggcaatgggaagaaggaattcttgggaaaggcttagggaaaaaaggggggtggggatattggt

SEQ ID NO: 14706 - protein, 144 aa, Zea mays
  misc_feature: Ceres CLONE 1376728-F
  misc_feature (84)..(84): Xaa is any aa, unknown, or other
  misc_feature (86)..(86): Xaa is any aa, unknown, or other
  misc_feature (113)..(113): Xaa is any aa, unknown, or other
MGFARKSGVAAVGVWWLLLLAGVLLPLAAAFGRHADAGNDMCDIKCQHHSDPARRQQCVDECHSREHHHPSREFCEMKCQHHQXPXRKEICVQQCMSYGLSHRASGQCCLMRXKNASMAGKRRWPENPPSGGTTYDVYITGRSN

SEQ ID NO: 14707 - DNA, 749 bp, Zea mays
  misc_feature: Ceres CLONE 1376730-F
  misc_feature: Encodes the peptide sequence at SEQ ID NO. 14708
tccccgcggtggcggccgctctagaactagtggatcccccgggctgcaggaattcgcacgagaccattacatagaacatcctaatcgaaaactttccctgctctctccttccaactcttgtttctgcaacgccagggcgcaaccatggatcagcagcagcaagggccggcggccaggcggatggccacgctcgcctcccacctgcgccatccctccgtctctcaccctcagatggaagatgttcccctcttgaggggatccaattgccgtgcaaaaggtgcggcgccaggcttcaaagtcgcgatcttgggtgcagcaggtgggatcgggcagccacttgcgctattgatgaagatgaaccctcttgtttcggtgctccatctatacgatgtcgtcaacgcacctggtgtcacagccgacatcagccacatgaacactggtgctggtggtacgtggccttcttgggccagccacagttgcaaaatgccctggctggcaatggatccttgaataatccctgctggtggccctcggaaaacctgggaggaaaagggcatgaatttgcccaacataaatgctggaaaaaacccccaaccgcggggggaacgaaaatgaaaaatggctgcccaaatggaaattggagaagggggaccaagaaaaccctggaaactcctaccgaccccaatttggttgctggaagtctccaaaaaaaacctgcgaacttaatggcccctaaccgggctctttag

SEQ ID NO: 14708 - protein, 121 aa, Zea mays
  misc_feature: Ceres CLONE 1376730-F
  misc_feature: SWISSPROT Homolog: EC 1.1.1.37 Malate dehydrogenase
MDQQQQGPAARRMATLASHLRHPSVSHPQMEDVPLLRGSNCRAKGAAPGFKVAILGAAGGIGQPLALLMKMNPLVSVLHLYDVVNAPGVTADISHMNTGAGGTWPSWASHSCKMPWLAMDP

SEQ ID NO: 14709 - DNA, 734 bp, Zea mays
  misc_feature: Ceres CLONE 1376736-F
  misc_feature: Encodes the peptide sequence at SEQ ID NO. 14710
  misc_feature (537)..(537): n is a, c, t, g, unknown, or other
  misc_feature (615)..(615): n is a, c, t, g, unknown, or other
  misc_feature (728)..(728): n is a, c, t, g, unknown, or other
aaagctggagctcaccgcggtggcggccgctctagaactagtggatcccccgggctgcaggaattcgcacgagaccattacctagaacatcctaatcgaaaaatcaactcgcaatttcgcattcgtccaaactcttgagcactttctcctcgtccccgacaagccactcgaagccgagatacggccatggactccaccggcaccggagcagcggggaagggaaagaagggagcggccgggcgcaaggtcggcgggccaaggaagaagtcggtgtcgaggtccgtgaaggctgggctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagctcgggaagctgctgggcggcgtgacctcgctncaacggaggtgtgctccccaatatcaaccctgttctgctgcccaagaagaccgcgggagaaagcgtcccagtggcggnagcaaaggaggcaaagtcgcccaagaaaggccgcagtccccctagaaggcattaactgactggtccggaggggatctgaatggtttaacagtaccttgtaaccagtatgcggnggatgc

SEQ ID NO: 14710 - protein, 157 aa, Zea mays
  misc_feature: Ceres CLONE 1376736-F
  misc_feature (31)..(104): Pfam Name: Histone Pfam Description: Core histone H2A/H2B/H3/H4
MDSTGTGAAGKGKKGAAGRKVGGPRKKSVSRSVKAGLQFPVGRIGRYLKKGRYAQRVGTGAPVYLAAVLEYLAAEVLELAGNAARDNKKTRIIPRHVLLAIRNDEELGKLLGGVTSLQRRCAPQYQPCSAAQEDRGRKRPSGGSKGGKVAQERPQSP

SEQ ID NO: 14711 - DNA, 732 bp, Zea mays
  misc_feature: Ceres CLONE 1376738-F
  misc_feature: Encodes the peptide sequence at SEQ ID NO. 14712
  misc_feature (500)..(500): n is a, c, t, g, unknown, or other
  misc_feature (640)..(640): n is a, c, t, g, unknown, or other
  misc_feature (695)..(695): n is a, c, t, g, unknown, or other
  misc_feature (732)..(732): n is a, c, t, g, unknown, or other
gctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcccttccagatcaatggagtaccgatccgccgtgtganccagacctatgtccttgctacctcaaccaaagttgacatctcccgggggtggatgccgcccaggttgaatgacaagtacttttgcccagggcacaaaaaccagaaggggggagaaacaccggaggcccgagtcttttttngcaccgcaaagggggcgcctcccaaagtccctggcctgggcccttcaaggaaggnatgacacccaacagcctcgtgcgggcctccgcgcctn

SEQ ID NO: 14712 - protein, 185 aa, Zea mays
  misc_feature: Ceres CLONE 1376738-F
  misc_feature (1)..(49): Pfam Name: Ribosomal_L6e_N Pfam Description: Ribosomal protein L6, N-terminal domain
  misc_feature (112)..(181): Pfam Name: Ribosomal_L6e Pfam Description: Ribosomal protein L6e
  misc_feature (121)..(121): Xaa is any aa, unknown, or other
  misc_feature (168)..(168): Xaa is any aa, unknown, or other
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPFQINGVPIRRVXQTYVLATSTKVDISRGWMPPRLNDKYFCPGHKNQKGGETPEARVFFXTAKGAPPKVPGLGPSRK

SEQ ID NO: 14713 - DNA, 759 bp, Zea mays
  misc_feature: Ceres CLONE 1376741-F
  misc_feature: Translation starting site: 196
  misc_feature: SWISSPROT Homolog: EC 2.7.1.4 Fructokinase
  misc_feature (421)..(421): n is a, c, t, g, unknown, or other
  misc_feature (422)..(422): n is a, c, t, g, unknown, or other
aaagctggagctccccgcggtggcggccgctctagaactagtggatcccccgggctgcaggaattcgcacgagaccattacctagaacatcctaatcgaaaaattccccacacgcgcccacctcctctgctctctcctctcccccacctctgcgtccgtgcgttgtgtttgtttaggcggcaaccgcgaggcgcaatggcggccgggcgagagctggtggtgagtttcggcgagatgttgatagacttcgtgcccaccgtggcgggggtctcgctggcggaggcgccggccttcctcaaggcgcccgggggcgcgcccgccaacgcggccatcgcggtctcgcgcctcggcggcggggccgcctttgtcggcagctcggcgacgacgagttcggccgcatgctcgccgccatcctcgcganncacgggtcgacgacgggggggtcgtcttccgactccggggggcggaccgggttcgccttcgtcacctgcgcgccgacggggagcgccgagttcatggtctaacgaaaccccagggttgactggctctcaccgccgagaggttcaaggtcgagttattcaagaagggttgggccttccactaacggaaaaaaaaattggtatggtgagctttgccgaaaagaaaatccccgggccggggaattgccaaaaagagagggggcctctgctcttttattaccccccctggggggggggccattgcccccccccgggggggggccccccccaaattattttg

SEQ ID NO: 14714 - DNA, 764 bp, Zea mays
  misc_feature: Ceres CLONE 1376742-F
  misc_feature: Encodes the peptide sequence at SEQ ID NO. 14715
  misc_feature (442)..(442): n is a, c, t, g, unknown, or other
  misc_feature (577)..(577): n is a, c, t, g, unknown, or other
ggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggaattcccgntggggggttcggttggtgctggaataatgttgttgagtcctaactggtggttttcactggaccaggagaaggctgcagctcactttgaaagggtggtgccccaagaagggttgtcatcctctgctcctagcaggnatgccccccatggtttggtccgttggtgtcaaccgagaaaggagtacaagtcctgacattaacattggtctccaatgctagctgcacaaccaactgccttgctcccccttgctaaggcattcaatggacaggtcccgtattcctttgggaggcctggagtaccattgttcatgccatcaatggtacc

SEQ ID NO: 14715 - protein, 151 aa, Zea mays
  misc_feature: Ceres CLONE 1376742-F
  misc_feature (4)..(129): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (89)..(89): Xaa is any aa, unknown, or other
  misc_feature (134)..(134): Xaa is any aa, unknown, or other
MAKIKIGINGFGRIGRLVARVALQSDDVELVAVNDPFISTDYMTYMFKYDTVHGQWKHHEVKVKDSKTLLFGEKEVAVFGCRNPEEFPXGGSVGAGIMLLSPNWWFSLDQEKAAAHFERVVPQEGLSSSAPSRXAPHGLVRWCQPRKEYKS

SEQ ID NO: 14716 - DNA, 741 bp, Zea mays
  misc_feature: Ceres CLONE 1376743-F
  misc_feature: Encodes the peptide sequence at SEQ ID NO. 14717
  misc_feature (446)..(446): n is a, c, t, g, unknown, or other
  misc_feature (546)..(546): n is a, c, t, g, unknown, or other
  misc_feature (623)..(623): n is a, c, t, g, unknown, or other
  misc_feature (627)..(627): n is a, c, t, g, unknown, or other
  misc_feature (628)..(628): n is a, c, t, g, unknown, or other
  misc_feature (631)..(631): n is a, c, t, g, unknown, or other
  misc_feature (704)..(704): n is a, c, t, g, unknown, or other
aaagctggagctccccgcggtggcggccgctctagaactagtggatcccccgggctgcaggaattcgcacgagaccattacctagaacatcctaatcgaaaatcgtctccactgctctgctgctcctcgcaccgccgccgccgccgccgcagcgacgtaatggcttccgccgcggtgctccggaacgccggctcccggcgcctcttctcctaccctactctccgcgccgctgcgatatatgtaccttctgcgctacccgatgcgcccgcggcggcggcagcgccggcccagccgccaccgacggccgggaccctctgggcgaggtctatggccaccttcacgcgcacgaagccccatgtgaatgtcggcaccattggggcacgtcgatcacggcaaaaccactctcactgctgtcattaccaaggtcctggccgagggcagggagngccaaagccgttgcttttcgacgagatcgacaaggctccggaggagaaagccagaggaatcaccattgcgacagctcacgtcgagtatgagacggctaanaggcattatgctcacgttgattgtccaggtcacgcagattatgtcaagaacatgatcactggagtggtcaaattggntggnnggnattccttgtcgtgtcagctcctgatgggccgatgcacaaactaaggagcatattctccttgcccgggccaggntggggtacccttcccttgtgtgcttcttaaacaaagg

SEQ ID NO: 14717 - protein, 171 aa, Zea mays
  misc_feature: Ceres CLONE 1376743-F
  misc_feature: SWISSPROT Homolog: EC 2.7.7.4 Sulfate adenylyltransferase
  misc_feature (96)..(96): Xaa is any aa, unknown, or other
  misc_feature (129)..(129): Xaa is any aa, unknown, or other
  misc_feature (155)..(155): Xaa is any aa, unknown, or other
  misc_feature (157)..(157): Xaa is any aa, unknown, or other
  misc_feature (158)..(158): Xaa is any aa, unknown, or other
MASAAVLRNAGSRRLFSYPTLRAAAIYVPSALPDAPAAAAAPAQPPPTAGTLWARSMATFTRTKPHVNVGTIGARRSRQNHSHCCHYQGPGRGQGXPKPLLFDEIDKAPEEKARGITIATAHVEYETAXRHYAHVDCPGHADYVKNMITGVVKLXGXXSLSCQLLMGRCTN

SEQ ID NO: 14718 - DNA, 846 bp, Zea mays
  misc_feature: Ceres CLONE 1376745-F
  misc_feature: Encodes the peptide sequence at SEQ ID NO. 14719
  misc_feature (11)..(11): n is a, c, t, g, unknown, or other
  misc_feature (32)..(32): n is a, c, t, g, unknown, or other
  misc_feature (33)..(33): n is a, c, t, g, unknown, or other
  misc_feature (846)..(846): n is a, c, t, g, unknown, or other
ccccccattancttctccacccccccttttcnncatttcttttcaagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggtcaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgttcccccgtgctgtttttgttgaccttgagccccactgtcatcgatgaggtggaggactggcacctaccgccagcttctccatcctgagcagctcatcaggggaaaggaggatgcagccaacaaacttcgctgcggggcacttaccaccattgggcaaggagaattggttgcacctggtgccttgacccgcatcaaggaagccttgggagaataatttgcactgggctcccccgggggcttcctcccgctctctccaacgcttggtctgcagggaagagaaacggagcctcctggggcatgtgagactccccccccctgcccgtggaaaccaggccctgggccactggtcttcacaatattgtgggcaaatgaataatcccccccagagtctn

SEQ ID NO: 14719 - protein, 68 aa, Zea mays
  misc_feature: Ceres CLONE 1376745-F
MRECISIHIGQAGIQVGNACWELYCLEHGIQADGQMPGDKTIGGGDDAFNTFFSETGAGKHVPPCCFC

SEQ ID NO: 14720 - DNA, 728 bp, Zea mays
  misc_feature: Ceres CLONE 1376746-F
  misc_feature (90)..(90): n is a, c, t, g, unknown, or other
  misc_feature (192)..(192): n is a, c, t, g, unknown, or other
  misc_feature (218)..(218): n is a, c, t, g, unknown, or other
  misc_feature (304)..(304): n is a, c, t, g, unknown, or other
  misc_feature (577)..(577): n is a, c, t, g, unknown, or other
tcaccgcggtggcggccgctctagaactagtggatcccccgggctgcaggaattcgcacgagaccattacctagaacatcctaatcgaanaacatcgacccagccatctcctcaccctcgttcaccacacagtcccgccactcccttagtagcttgtgatttgtacgtcgacgagatcactggtcgggtggncggacgacgacacatggggaaagggnaatggggggtgcatcatgtgtggggcgggttcttcctggttcgccggggggtgtgtttggtgcctaaaaaaccccaggcccggggngggagaaaccaatgggtcccaaccgggacccccaggggggacccccggggggggggcaaaacagcgggggtgggggggatcaacggaaggggggcacccccccggaaaaagggatgggcggaaaaaaaaggggccccctcagggtccccacaacaattatactggcttgggaaagaaacaaaccaacccccggggaaaaaaaaaaaatttcacccccccgggaaggggggggggttgcggttcccccacgctgtttccctctaacccgggttnctcctgtgggggaaaccaccaagaggtgtggggggggtggctccccgcccccctgggggtggtcggctcttccgtatgaggggtttgggccccgggggcccggcggtttattttcggaagtggagagggcgcccttcatccgcttgttggg

SEQ ID NO: 14721 - DNA, 708 bp, Zea mays
  misc_feature: Ceres CLONE 1376747-F
  misc_feature: Translation starting site: 175
  misc_feature: SWISSPROT Homolog: EC 1.11.1.11 L-ascorbate peroxidase
tggagctccccgcggtggcggccgctctagaactagtggatcccccgggctgcaggaattcgcacgagaccattacctagaacatcctaatcgaaaaagatcttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctacccagctcgcgggagttgtgggccgtggaggtcaccggtgggcctgagattcccttccacccgggtagggaggacaagcctcagcccccacctgagggccgccttctgatggccactaaagggttctgaccactggagggcagtttttggcaagcagatgggctggagcgatcaggacattgttgcccctctctggtggcaacccctttgggagtgccacaaggaggcggctgggtttccgagg

SEQ ID NO: 14722 - DNA, 734 bp, Zea mays
  misc_feature: Ceres CLONE 1376749-F
  misc_feature: Encodes the peptide sequence at SEQ ID NO. 14723
  misc_feature (481)..(481): n is a, c, t, g, unknown, or other
  misc_feature (493)..(493): n is a, c, t, g, unknown, or other
  misc_feature (498)..(498): n is a, c, t, g, unknown, or other
  misc_feature (558)..(558): n is a, c, t, g, unknown, or other
  misc_feature (580)..(580): n is a, c, t, g, unknown, or other
  misc_feature (658)..(658): n is a, c, t, g, unknown, or other
tggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgagcggcaccagcaagctgacgcgggcgaggacggcgacagcggcgtggacgcctacgtctcccgctccggnagggggcgagtngcggngccagtgcctgcgccgccacgagggccagccgtgggagacccaggagggcatgaggcggngccgccgccgcggactggccgncgacatggagaaagagaacggtcgcggcagcgagagcggcggcaagggccgggagaaggtgcaggccaccaccccggngaactgggggcaaggccacgccttcctgatggatgcaaggacccggagggcgacgaagggggtttctatggtgttt

SEQ ID NO: 14723 - protein, 73 aa, Zea mays
  misc_feature: Ceres CLONE 1376749-F
MGKGSVGASWWAFLLLAGVLLVVAATAGAEDGVVERDRKEDLRWCKQACEWQYGKDTPRKRECESECRAAPAS

SEQ ID NO: 14724 - DNA, 737 bp, Zea mays
  misc_feature: Ceres CLONE 1376752-F
  misc_feature: Encodes the peptide sequence at SEQ ID NO. 14725
  misc_feature (585)..(585): n is a, c, t, g, unknown, or other
  misc_feature (648)..(648): n is a, c, t, g, unknown, or other
  misc_feature (649)..(649): n is a, c, t, g, unknown, or other
  misc_feature (737)..(737): n is a, c, t, g, unknown, or other
tggagctccccgcggtggcggccgctctagaactagtggatcccccgggctgcaggaattcgcacgagaccattacctagaacatcctaatcgaaaactagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagatcaggatatacgatgtcgggatgaagaggaagggtgttgatgagttcccctactgtgtgcaccttgtctcttgggagaaggagaatgtctccagtgaggcgcttgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactggaatgaggggtgcctttggcaagcctcagggcacctgtgctagggtggacattggtcaggtcctcctttccgtgcgatgncaggacaacaatgctgcccatgccagcgaagctctgcgtcgcgctaaagtcaagttccctggnncgccaaagatcattgagagcagaaagtggggcttcaccaagtcagccgcgctgactacctgagtaacagagcgaaggcagaattgttn

SEQ ID NO: 14725 - protein, 181 aa, Zea mays
  misc_feature: Ceres CLONE 1376752-F
  misc_feature (5)..(167): Pfam Name: Ribosomal_L16 Pfam Description: Ribosomal protein L16
  misc_feature (140)..(140): Xaa is any aa, unknown, or other
  misc_feature (162)..(162): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRXQDNNAAHASEALRRAKVKFPGXPKIIESRKWGFTKSAALTT

SEQ ID NO: 14726 - DNA, 764 bp, Zea mays
  misc_feature: Ceres CLONE 1376753-F
  misc_feature: Encodes the peptide sequence at SEQ ID NO. 14727
  misc_feature (359)..(359): n is a, c, t, g, unknown, or other
  misc_feature (405)..(405): n is a, c, t, g, unknown, or other
  misc_feature (432)..(432): n is a, c, t, g, unknown, or other
  misc_feature (435)..(435): n is a, c, t, g, unknown, or other
  misc_feature (454)..(454): n is a, c, t, g, unknown, or other
  misc_feature (455)..(455): n is a, c, t, g, unknown, or other
  misc_feature (485)..(485): n is a, c, t, g, unknown, or other
  misc_feature (565)..(565): n is a, c, t, g, unknown, or other
  misc_feature (568)..(568): n is a, c, t, g, unknown, or other
  misc_feature (580)..(580): n is a, c, t, g, unknown, or other
  misc_feature (605)..(605): n is a, c, t, g, unknown, or other
tggagctccccgcggtggcggccgctctagaactagtggatcccccgggctgcaggaattcgcacgagaccattacctagaacatcctaatcgaaaacgtgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggntgatgggtgttcggcgagatcaccaccaaggcgagcgtggactacngagaagatcgtgcgcgacacctgccgncgnagatcgggttcacctccgnnacgacgtgggggctcgacgccgaccgctgncaaggggtggctggtgaacattccgagcagcagtcccccgacatcggccgcaggggcggtgcacgggcactttcacgagncgncccccgaggagnatcgggcgcccggcgaccagggccnaccatggtttcgggtacgcccaccgacgagaccccccgagcttgatgcccgctgagccacgtgctggccaccaggctcgggcgggcccctgacggaggcccgcaaggacgcacctgcggctggttcaggccgaaggaagaaccaggggggcggggggat

SEQ ID NO: 14727 - protein, 152 aa, Zea mays
  misc_feature: Ceres CLONE 1376753-F
  misc_feature (4)..(107): Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (53)..(53): Xaa is any aa, unknown, or other
  misc_feature (85)..(85): Xaa is any aa, unknown, or other
  misc_feature (95)..(95): Xaa is any aa, unknown, or other
  misc_feature (122)..(122): Xaa is any aa, unknown, or other
  misc_feature (123)..(123): Xaa is any aa, unknown, or other
  misc_feature (127)..(127): Xaa is any aa, unknown, or other
  misc_feature (135)..(135): Xaa is any aa, unknown, or other
MAAESFLFTSESVNEGHPDKLCDQVSDAVLDACLAQDPDSKVACETCTKTNMXDGCSARSPPRRAWTTEKIVRDTCRRRSGSPPXRRGGSTPTAXKGWLVNIPSSSPPTSAAGAVHGHFHEXXPEEXRAPGDQGXPWFRVRPPTRPPELDAR

SEQ ID NO: 14728 - DNA, 688 bp, Zea mays
  misc_feature: Ceres CLONE 1376754-F
  misc_feature (569)..(569): n is a, c, t, g, unknown, or other
tccccgcggtggaggccgctctagaactagtggatcccccgggctgcaggaattcgcacgagaccattacctagaacatcctaatcgaaaacccccttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctgtgttggggttctccggggttccttgcgctggagggaggtttcgttctcgctggccatggtttggctgagaagcagcagcggcagcatcttgatgccaaatctctgagctttatgaagatcgccactcacctgcgccgctcctgcttcctccactccttctcggttgtcttcctctactggttttatgtgatctcataacttgccctccccccggatcgcattccccgtgccctctctccgtcccctcaacttctccctcccttcttgctccctcnacatcgccaaatacaggactagcggagcgggagaggatcctttcaaggaagctaaggcggccgggttcctgggggaaaaagaaagaaaggaaccggctgggggcgcccccgcccttgcc

SEQ ID NO: 14729 - DNA, 735 bp, Zea mays
  misc_feature: Ceres CLONE 1376755-F
  misc_feature: Translation starting site: 202
  misc_feature: Pfam Name: S-AdoMet_synt_N Pfam Description: S-adenosylmethionine synthetase, N-terminal domain
  misc_feature: SWISSPROT Homolog: EC 2.5.1.6 Methionine adenosyltransferase
  misc_feature (547)..(547): n is a, c, t, g, unknown, or other
  misc_feature (548)..(548): n is a, c, t, g, unknown, or other
  misc_feature (640)..(640): n is a, c, t, g, unknown, or other
tggagctccccgcggtggcggccgctctagaactagtggatcccccgggctgcaggaattcgcacgagaccattacctagaacatcctaatcgaaaacgtgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagtccccgacatcgcgcagggcgtgcacgggcacttcacgagcgnncccgaggagatcggcgccggcgaccaggccacatggttcgggtacgccaccgacgagacccccgagttgatggcgctgagccacgtgctggncaccaagctcgcgcgcgccctgacggaggtccgcaaggacggcacctgcgcctgcttcagcccgacgcaagaaccaggtggaggggggagtaagt

SEQ ID NO: 14730 - DNA, 757 bp, Zea mays
  misc_feature: Ceres CLONE 1376756-F
  misc_feature: Encodes the peptide sequence at SEQ ID NO. 14731
  misc_feature (512)..(512): n is a, c, t, g, unknown, or other
  misc_feature (713)..(713): n is a, c, t, g, unknown, or other
ggagctccccgcggtggcggccgctctagaactagtggatcccccgggctgcaggaattcgcacgagaccattacctagaacatcctaatcgaaaaatcctccgcgcaggcaagagcagccagccgcttcgggatcgggacgcggagaggggaaaggcgagtcgtcgactcgtcgtccgggcagcttccctccctctcctctccgcccccgcttacctaggccggccccgcctacgcccccctcccgccgccgcacgatgagcacttctcccgccgccgccgacgtttcgcctttgccgcctactgctgccgccgacgaggccgcgcgggcgacagagacggtggtggtcgatgagagggtcgcctcacacgtggacccgttcctcgtcgagacgctcgacaaccctcgccaccgtctcatggttctacggatggaactggatatacaaaactttatgcagaaccctcagctggcaggagtttgaattccagaactttccgacttcttaccntccgctgtgctggctcatcgtgttgcacaacattatgggcttagagactatagtagcagatagttttagtagaggctcagttagcagggattgttggcaggaaaacggcagaaagcaggtatccctgcaattttttttatcaaaaggtccctaggcatcaggcaagaaatgatcatgaaaccgctggagaaagctttaggnttggcaatttatcagaggggcccaaggcatttccaaaagtggaa

SEQ ID NO: 14731 - protein, 75 aa, Zea mays
  misc_feature: Ceres CLONE 1376756-F
MSTSPAAADVSPLPPTAAADEAARATETVVVDERVASHVDPFLVETLDNPRHRLMVLRMELDIQNFMQNPQLAGV

SEQ ID NO: 14732 - DNA, 755 bp, Zea mays
  misc_feature: Ceres CLONE 1376758-F
  misc_feature: Encodes the peptide sequence at SEQ ID NO. 14733
  misc_feature (572)..(572): n is a, c, t, g, unknown, or other
  misc_feature (597)..(597): n is a, c, t, g, unknown, or other
  misc_feature (598)..(598): n is a, c, t, g, unknown, or other
  misc_feature (613)..(613): n is a, c, t, g, unknown, or other
  misc_feature (673)..(673): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (713)..(713): n is a, c, t, g, unknown, or other
aagctggagctccccgcggtggcggccgctctagaactagtggatcccccgggctgcaggaattcgcacgagaccattacctagaacatcctaatcgaaaaccggtcctccacactccactgtctctcacactcacacagtctcacaaaggctcgtgggctcgtggcctggcctctataaacccccgcccagccggtcacccccaccccatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcaggcctgcctcgccgggaggaggctcaccgcgctggtgcaggagccggccataaccatgaggtaccacaagggcgcgctcctgtcgggccccatcgccgtcaacttcatctggtacggcgacttctcggcgccgcagcgggcggcgatcaccgacttcgtctcgtcgttgaaaacggcgggcggccccggncgcgggcaaacccggaagccgccgnnggggccaacgtgggnttcaagaaacggcgcgcaagtactacgccagctttcccagggttgccgtttccccggcgnctgcgcctcgnnntccccacgccgtnnnaaccgggactgntttttcctcggagggggcctcttttgggggggaaaagggtac

SEQ ID NO: 14733 - protein, 145 aa, Zea mays
  misc_feature: Ceres CLONE 1376758-F
  misc_feature (93)..(93): Xaa is any aa, unknown, or other
  misc_feature (98)..(98): Xaa is any aa, unknown, or other
  misc_feature (118)..(118): Xaa is any aa, unknown, or other
  misc_feature (122)..(122): Xaa is any aa, unknown, or other
  misc_feature (127)..(127): Xaa is any aa, unknown, or other
  misc_feature (131)..(131): Xaa is any aa, unknown, or other
MACYNTASLAATLLAFALTFQACLAGRRLTALVQEPAITMRYHKGALLSGPIAVNFIWYGDFSAPQRAAITDFVSSLKTAGGPGRGQTRKPPXGPTWXSRNGAQVLRQLSQGCRFPGXCASXSPRRXNRDXFFLGGGLFWGGKGY

SEQ ID NO: 14734 - DNA, 740 bp, Zea mays
  misc_feature: Ceres CLONE 1376760-F
  misc_feature: Encodes the peptide sequence at SEQ ID NO. 14735
  misc_feature (531)..(531): n is a, c, t, g, unknown, or other
  misc_feature (547)..(547): n is a, c, t, g, unknown, or other
  misc_feature (553)..(553): n is a, c, t, g, unknown, or other
  misc_feature (712)..(712): n is a, c, t, g, unknown, or other
ggagctccccgcggtggcggccgctctagaactagtggatcccccgggctgcaggaattcgcacgagaccattacctagaacatcctaatcgaaaactctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctngtgcattctactttgnagctcngtttggatttgacaagatggcaggagaaggctcttcacccatgataacaactgcccacctgttatgaaggtggggacgggggttgctaagaaagcatcgaaagcccccacggcagcagcaaaagcagcaagcctaactctaaaccatcaaaactgaccnattctaacagtaagcccgcgaagccagc

SEQ ID NO: 14735 - protein, 139 aa, Zea mays
  misc_feature: Ceres CLONE 1376760-F
  misc_feature (111)..(111): Xaa is any aa, unknown, or other
  misc_feature (116)..(116): Xaa is any aa, unknown, or other
  misc_feature (118)..(118): Xaa is any aa, unknown, or other
MDGDGGGAGALHHHTRSPEDVFRDFRARRAGIVKALTTDVEKFYQQCDPEKENLCLYGLPNETWEVTLPAEEVPPELPEPALGINFARDGMVEKDWLSLVAVHSDAWLLSXAFYFXAXFGFDKMAGEGSSPMITTAHLL

SEQ ID NO: 14736 - DNA, 701 bp, Zea mays
  misc_feature: Ceres CLONE 1376767-F
  misc_feature: Encodes the peptide sequence at SEQ ID NO. 14737
  misc_feature (405)..(405): n is a, c, t, g, unknown, or other
  misc_feature (443)..(443): n is a, c, t, g, unknown, or other
  misc_feature (560)..(560): n is a, c, t, g, unknown, or other
  misc_feature (601)..(601): n is a, c, t, g, unknown, or other
  misc_feature (664)..(664): n is a, c, t, g, unknown, or other
  misc_feature (677)..(677): n is a, c, t, g, unknown, or other
  misc_feature (696)..(696): n is a, c, t, g, unknown, or other
ggagctccccgcggtggcggccgctctagaactagtggatcccccgggctgcaggaattcgcacgagaccattacctagaacatcctaatcgaaaaaatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcgcagctggcatcttacctttatcacccttgttcctccacaatcatcagccctaattacacagttacctttgntgcatttattggcacaaacatcagggcacacaactacnacaacttgtgctagcaaaccttgctgcctactctcagcaacagcagtttcttccatcaaccaactaggttcattgaactctgcttcttaaattgcacaacaacaactaccattcagncagctacctgctgcctacccccagcaatttcttccattcancaactagcagcattgaactctcctgcttatttacagcagcacaactactaccatcagccaggntagctggggtgangcctgctaccttctgaccnaccaa

SEQ ID NO: 14737 - protein, 79 aa, Zea mays
  misc_feature: Ceres CLONE 1376767-F
MAAKIFCLLMLLGLSASAATATIFPQCSQAPIASLLPPYLSPAVSSVCENPILQPYRIQQAIAAGILPLSPLFLHNHQP

SEQ ID NO: 14738 - DNA, 712 bp, Zea mays
  misc_feature: Ceres CLONE 1376771-F
  misc_feature (523)..(523): n is a, c, t, g, unknown, or other
  misc_feature (524)..(524): n is a, c, t, g, unknown, or other
  misc_feature (532)..(532): n is a, c, t, g, unknown, or other
  misc_feature (534)..(534): n is a, c, t, g, unknown, or other
  misc_feature (537)..(537): n is a, c, t, g, unknown, or other
  misc_feature (555)..(555): n is a, c, t, g, unknown, or other
  misc_feature (565)..(565): n is a, c, t, g, unknown, or other
  misc_feature (566)..(566): n is a, c, t, g, unknown, or other
  misc_feature (588)..(588): n is a, c, t, g, unknown, or other
  misc_feature (592)..(592): n is a, c, t, g, unknown, or other
  misc_feature (658)..(658): n is a, c, t, g, unknown, or other
  misc_feature (660)..(660): n is a, c, t, g, unknown, or other
tccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaatttatggagacctctgcagcaaccccgacccgggcnngcacacangnggncacttcccatcgcatcgncctcgttgtnnttgaggctggtgaggcagcggngcancgcacatgccgcttcagtggtccattcgaccccccaaagaacatgggttgcccccctttttaaagncnggcccaccctccgcggtcgtaaggcccctttctggggaaatgcgaaaagggt

SEQ ID NO: 14739 - DNA, 696 bp, Zea mays
  misc_feature: Ceres CLONE 1376778-F
  misc_feature: Translation starting site: 174
  misc_feature (223)..(223): n is a, c, t, g, unknown, or other
  misc_feature (277)..(277): n is a, c, t, g, unknown, or other
  misc_feature (278)..(278): n is a, c, t, g, unknown, or other
  misc_feature (305)..(305): n is a, c, t, g, unknown, or other
  misc_feature (325)..(325): n is a, c, t, g, unknown, or other
  misc_feature (328)..(328): n is a, c, t, g, unknown, or other
  misc_feature (364)..(364): n is a, c, t, g, unknown, or other
  misc_feature (376)..(376): n is a, c, t, g, unknown, or other
  misc_feature (392)..(392): n is a, c, t, g, unknown, or other
ggcggccgctctagaactagtggatcccccgggctgcaggaattcgcacgagaccattacctagaacatcctaatcaaaaaacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggncgggcgcaaggccggcgggccgaggaagaaagtcgtgacgaggtccgtcagggnncggctgcagtttcccgtcggccgcatncggcggtacctgaagagggncgntacgcgcagcgcgtcggcacgggcgccccgtctacntggggcgcgtcntcgagtacctggccgncgaggtgctggagctggcccggaaaaccttgcaagggacaacaaaaggacccggataattccggggccagggggtccttgtgcattcccaaaagaaaagggatttcgggaaatttgttgtccgggtcacccatcccccagggggggggccctcccaaaataaacccgggggtcctggcccaaaaaacccccttaaaaaggggggcccaaagggggccaatcccccaaaaaagggccccaatccccccaaaaaaggtataaaggggggggcgcccttcccccgcggggagaaaaaaacgcccccc

SEQ ID NO: 14740 - DNA, 638 bp, Zea mays
  misc_feature: Ceres CLONE 1376782-F
  misc_feature: Encodes the peptide sequence at SEQ ID NO. 14741
  misc_feature (396)..(396): n is a, c, t, g, unknown, or other
  misc_feature (436)..(436): n is a, c, t, g, unknown, or other
  misc_feature (439)..(439): n is a, c, t, g, unknown, or other
  misc_feature (465)..(465): n is a, c, t, g, unknown, or other
  misc_feature (473)..(473): n is a, c, t, g, unknown, or other
  misc_feature (474)..(474): n is a, c, t, g, unknown, or other
  misc_feature (488)..(488): n is a, c, t, g, unknown, or other
tggcggccgctctagaactagtggatcccccgggctgcaggaattcgcacgagaccattacctagaacatcctaatcgaaaaaagcgagcgtgaggtggtggacggaaccgtcgcctgctgcgggctgcctacgagatctaggcgagcgagcgagcgcggccatgggtgctcgctgctccaagctctccgtctgctggtggcctccccgcttcaaatcgccgatgctcgagaatggcgccgccgaagatgacggcagcggcgtgccggtgttcgccgagtacagcctcgccgagctccgggtggccaccgacggcttcgccaccgaccgcatcgtgtcggagcacggcgagaaggcgcccaacgtggtctaccgcggcacgctcttcagctccggncgcaccgtcgccatcaagcgcttcggccgctccgcctggncgnactcacgacagttcctggagggagcnagggctgnntggcaactgcgcantccgcggctggccaatctgatcgggtgctgctacgagagcggggagcgtctcctcctccccgagttcatgccggaccagacccttgggcaaggatcctttcccactgggaaaacaaaatccgtttgagtttgggcaattgaagaacagag

SEQ ID NO: 14741 - protein, 150 aa, Zea mays
  misc_feature: Ceres CLONE 1376782-F
  misc_feature: SWISSPROT Homolog: EC 2.7.11.1 Non-specific serine/threonine protein kinase
  misc_feature (92)..(92): Xaa is any aa, unknown, or other
  misc_feature (93)..(93): Xaa is any aa, unknown, or other
  misc_feature (104)..(104): Xaa is any aa, unknown, or other
  misc_feature (109)..(109): Xaa is any aa, unknown, or other
MGARCSKLSVCWWPPRFKSPMLENGAAEDDGSGVPVFAEYSLAELRVATDGFATDRIVSEHGEKAPNVVYRGTLFSSGRTVAIKRFGRSAWXXSRQFLEGARAXWQLRXPRLANLIGCCYESGERLLLPEFMPDQTLGQGSFPTGKTKSV

SEQ ID NO: 14742 - DNA, 717 bp, Zea mays
  misc_feature: Ceres CLONE 1376783-F
  misc_feature: Encodes the peptide sequence at SEQ ID NO. 14743
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (501)..(501): n is a, c, t, g, unknown, or other
  misc_feature (503)..(503): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
ggagctccccgcggtggcggccgctctagaactagtggatcccccgggctgcaggaattcgcacgagaccattacctagaacatcctaatcgaaaaagaaccgatccttacagagagacacacccagcgcgcgagatatctacatcgatcatcatcaccagcgagcgagccggccgagcagcaccgatggcggcgtacatgcgcgtgacgcaccgcgacgaggaaggcaagaaggtgacggagaagatgccggtcccggagacgcggcgcccggacacggccaagcacttcgagcgcaagctggaggagcagggcctccaccgcttcgagcggcacccggcgaacgcgccccggggcgtgggcatcggcgccccgccgcccaagtccgggcgcggcggcaagtacacctgggagggccccggcagcgtcgtcgaggaccagctcgacccggcgccgcccgccatcgaccaacccnnnnnaatataaaaagggaggannnangntnnnnttaaacaagaacaactaggcggcccagggaggtggtcgtcgggggaggtggaggtcgctaaggtcgccgagagcagggacggcgtcgccagggtcgacgtcgcgccgggcctgctccaggaccagaagcagtaaaaggactgtcttttctggatacgtctagactctataagactgtgtgtcagtggtgttcgagtttgttccgtgcag

SEQ ID NO: 14743 - protein, 99 aa, Zea mays
  misc_feature: Ceres CLONE 1376783-F
  misc_feature (97)..(97): Xaa is any aa, unknown, or other
  misc_feature (98)..(98): Xaa is any aa, unknown, or other
MAAYMRVTHRDEEGKKVTEKMPVPETRRPDTAKHFERKLEEQGLHRFERHPANAPRGVGIGAPPPKSGRGGKYTWEGPGSVVEDQLDPAPPAIDQPXXI

SEQ ID NO: 14744 - DNA, 688 bp, Zea mays
  misc_feature: Ceres CLONE 1376786-F
  misc_feature: Encodes the peptide sequence at SEQ ID NO. 14745
  misc_feature (395)..(395): n is a, c, t, g, unknown, or other
  misc_feature (397)..(397): n is a, c, t, g, unknown, or other
  misc_feature (467)..(467): n is a, c, t, g, unknown, or other
  misc_feature (469)..(469): n is a, c, t, g, unknown, or other
  misc_feature (474)..(474): n is a, c, t, g, unknown, or other
  misc_feature (631)..(631): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccngncggggaaagaggagtcgccgggcggcgcgcctccagtcttttttcggctccgtgctctccgggctcttcngncaggncgaggcccgaggacgagacgaggaccaagagatgcccacgcgcaaccaccacgctgccgcgggtggcgctccgcagcatcaccatcacaaccgaggtggtgctcccgctcttggaaaggagcaaggccgtgccccgccgaactgatgccatgaaccngncgagcccccctcgggggatattgcccaacctcgtcagcgtcccgccccagcgaag

SEQ ID NO: 14745 - protein, 37 aa, Zea mays
  misc_feature: Ceres CLONE 1376786-F
MPTRNHHAAAGGAPQHHHHNRGGAPALGKEQGRAPPN

SEQ ID NO: 14746 - DNA, 723 bp, Zea mays
  misc_feature: Ceres CLONE 1376787-F
  misc_feature: Encodes the peptide sequence at SEQ ID NO. 14747
  misc_feature (522)..(522): n is a, c, t, g, unknown, or other
tccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgccctccctttctccctctccgcggaaccacgagagccgggccgtggcgcctgcggtggtgttcaccccgcccccgccgcctgcttctgtgaatgtcgcgctgccgccggtgcaggtgccgccgccgcagtacgagaaggcgtccgcggngggcaagcatgacgtatcggcgttcggcttcttctgggacgccgtcgcgcgcgtccaggaagcgcacgcgagcctcgacgagtacgtgtctacctggttcgggttggatcagtccaagtaccagtgggcgcttaacgactactacgagaccataggcaaggtcagcaaggtcagtgatcttcgaattcgctcatcgtcact

SEQ ID NO: 14747 - protein, 180 aa, Zea mays
  misc_feature: Ceres CLONE 1376787-F
  misc_feature (114)..(114): Xaa is any aa, unknown, or other
MGSSSSPPPPPPLPLPMIGRAGNLTIFITPPSPASTPRGAGRTPPLESPRSDISTPIPQRAAPSPSLSPSPRNHESRAVAPAVVFTPPPPPASVNVALPPVQVPPPQYEKASAXGKHDVSAFGFFWDAVARVQEAHASLDEYVSTWFGLDQSKYQWALNDYYETIGKVSKVSDLRIRSSS

SEQ ID NO: 14748 - DNA, 757 bp, Zea mays
  misc_feature: Ceres CLONE 1376788-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (48)..(48): n is a, c, t, g, unknown, or other
nnnnnnnnnnnnnnnncccccccgcccccggcctnnnttgacnnnggntcaaaagctgggactccccgcggtggcggccgctctagaactagtggatcccccgggctgcaggaattcgcacgagaccattacctagaacatcctaatcgaaaatccatcttatcatccgccgccaatgctgcgccgcaacccaacccgcatcgagctcacctcctccgaccgcgacgagctcgaagaccacctccgcgccgccgcggcgagctccaccaaggatccttccggttacaccactccgtctccaggccttggcccgcagacctccaatcccctgctccaattcctccacccgaagcccggcgccgggccatccaaggcccaacgcatcgggatcggtctctccaccccgccggctccgggcccgaagccgcaagcaccccgtccacctcatggaggttgacatcaaggtccgcttccccaacgccgtcgcgcaccgcacgcctgcgcgcgtttctcagggcccgcctccgcagcacctagaccgaggggaaccaggcctccaaacaagagcgcgcggacaacactgagcggcgaccgccgccactccgcccgtggcctataccaaggggccggaaagacggaaaacctcccgaggcgcccgggacaaccggggccggggcctacccccagcggcctcacaggccggggggggtcaaggccggggcccggggggagggcgggaaggaggcggggcccggca

SEQ ID NO: 14749 - DNA, 715 bp, Zea mays
  misc_feature: Ceres CLONE 1376792-F
  misc_feature: Encodes the peptide sequence at SEQ ID NO. 14750
gctctagaactagtggatcccccgggctgcaggaattcgcacgagaccattacctagaacatcctaatcgaaaaatttgaacctccaagttcagaaactgaccccctcgtccctccccaccatcgcgatggctgacgacgccgcggcggcggcgttcgcgccctctccctcgccaccgtcacccgtagcgcaacctctgcccgacctctccccgccgccgcccttctccccaccagccggcacccctgcttccggggcgcagacgccgagcctcccggacaccccggcctccctagatccggacacccccttctccgacgccaccccgacccccgccgacgcctccgaccgccgccctcgctttcggaacgacgggaatcaccctacccggtcggggggcaccgccgggaaaagaacttgaaggtttggggcggcccggccccgccccggcaaagaaaaccgtccaagaaggaaggggcgggaaacaggcgtctggggacccccgcccgggcctccccgcaaggggcaaaaaaagaaagggggaggggaaggccggggcgggccctctggcccccgggtttcggggcgggccccctcccgggggcccgccaaaagggtttccaaaccctagggcccaaacgccggggggggggaagggaggaaggttcccttcccttcggtccccggggaaacccgccctccacccccccgaaag

SEQ ID NO: 14750 - protein, 97 aa, Zea mays
  misc_feature: Ceres CLONE 1376792-F
MADDAAAAAFAPSPSPPSPVAQPLPDLSPPPPFSPPAGTPASGAQTPSLPDTPASLDPDTPFSDATPTPADASDRRPRFRNDGNHPTRSGGTAGKRT

SEQ ID NO: 14751 - DNA, 665 bp, Zea mays
  misc_feature: Ceres CLONE 1376793-F
  misc_feature: Translation starting site: 149
tccccgcggtggcggccgctctagaactagtggatcccccgggctgcaggaattcgcacgagaccattacctagaacatcctaatcgaaaaatccgaagttccgaacccacgccaagccccagggtccgaccgcagaaccgacccaaaatgtcgcccgcctctcccatgctcaccgccgtgtcgctctcctccccgttcccagccccgcgcctccgcgccgccgccgccgcctccttcgctccgccgcgccgcgcggcagtcgcactcgtcgtgcgcgcggcgtccgcatcttccaagtcccctgccacggcggaggcggccccaaagaagaagagggcgaccggcatcacccagccgaagtccgtgtcgcccggcgctgcagggcaatcgtggggcgaccccggttattccccggcaccgaggtcctcaagcgcctctgggcctatatcaaggagcataccctccaggatccctctgataaaaaggggtggttttgggatgaaaagcttgaagtcctgttcccggggcgggagcgaaccgatttctccaaatcgccaagttctcaacctcccttcgggaggggaggagagccagggcacttccaggaacgagtaacttatggtgggtacttgggcctggccaaagaagggggccggctttggtt

SEQ ID NO: 14752 - DNA, 674 bp, Zea mays
  misc_feature: Ceres CLONE 1376795-F
  misc_feature: Translation starting site: 207
  misc_feature (492)..(492): n is a, c, t, g, unknown, or other
tggagctccaccgcggtggcggccgctctagaactagtggatcccccgggctgcaggaattcgcacgagaccattacctagaacatcctaatcgaaaaaccacacttattagcttcctaatttcaattattgtatttcagtcgagttgctaaacaacacgaactcagtcgtttgagttttgaggaggcaagcaagaggacccatcgatggcctccttgaagaaccactgtgccgtggtggcagcagttgtagtggcgatctgcttcgtcgtcctcgccgccgccctcccttcgcatgcgtcgacggcggtggacgagccggcgaagtataagcccagcagggcgccagcgccgtcccctgcatctgcatcatcatcctacgtccccgcgccggtcccagccgtgatcgtcgtccaggggcgtcatctactgcaagtcctggcagctcaggggctacaacagcggcatggacgcgtcccctctccccaatgcnaccgcaagcttggtgggctacggggacccggaaaagcaataaccggtggttgaaccaaaaaaacacggccaccgaacccaaagggtatttcatggggagggggaccaacgggggatgtttccaacccccaaattgggggtttaaacccccgtcctccccaaaagggttttgggccgcggcct

SEQ ID NO: 14753 - DNA, 682 bp, Zea mays
  misc_feature: Ceres CLONE 1376806-F
  misc_feature: Encodes the peptide sequence at SEQ ID NO. 14754
ggagctccccgcggtggcggccgctctagaactagtggatcccccgggctgcaggaattcgcacgagaccattacctagaacatcctaatcgaaaagaaaacccaccgcacccctgtccactgttggcttggtgacttcctccgctcggctcccctccgctcccgaacggtcgatctttgcatggcagcagcagctggctccaaggggcgggcgatcgctgaaagcttcgtcagccgcgtcctcgccggcaaggccgcctcgccgaggagggccgtgcacgcctcggcgtacgacaagaacctggaggaccaggtgcgcccggcgttcgtgccggacgatgtgatcggcagcgccgggagccccgacaagtactggagcccccaccccaagaccggcgtgttcggcccggcggcggtggaccccaagctggccgctggtggcgcgccggacgccggcgcggatgctgcaggaggcacggtgctggaccagaaggtgtggttccgcccgctcgaggacgtcgagaagccgccccccgccgcgtgagccgcgcggcgctgctaggccagcccacactgctgctcgctcataaaaagggcggcggaagaagctggaagtgggaggcactctgctccgggtccgggggggttgggcccccggttttatcccccaaaaattatccca

SEQ ID NO: 14754 - protein, 120 aa, Zea mays
  misc_feature: Ceres CLONE 1376806-F
MAAAAGSKGRAIAESFVSRVLAGKAASPRRAVHASAYDKNLEDQVRPAFVPDDVIGSAGSPDKYWSPHPKTGVFGPAAVDPKLAAGGAPDAGADAAGGTVLDQKVWFRPLEDVEKPPPAA

SEQ ID NO: 14755 - DNA, 682 bp, Zea mays
  misc_feature: Ceres CLONE 1376815-F
  misc_feature: Encodes the peptide sequence at SEQ ID NO. 14756
  misc_feature (501)..(501): n is a, c, t, g, unknown, or other
  misc_feature (530)..(530): n is a, c, t, g, unknown, or other
  misc_feature (538)..(538): n is a, c, t, g, unknown, or other
  misc_feature (637)..(637): n is a, c, t, g, unknown, or other
tggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcngcgctcaccgcggtgggccgcaccctggntgccgggnccccgcctcgggcgcgtcctacggccgactacgtgctgcagcaccacaggacgcgtggggggggggggccgtgcccccgcctgcacgaggccgtgttgngaaccccgcggggccccgagccgttcgcgcggccaaaacgccggg

SEQ ID NO: 14756 - protein, 167 aa, Zea mays
  misc_feature: Ceres CLONE 1376815-F
  misc_feature: SWISSPROT Homolog: EC 2.1.1.68 Caffeate O-methyltransferase
  misc_feature (108)..(108): Xaa is any aa, unknown, or other
  misc_feature (120)..(120): Xaa is any aa, unknown, or other
  misc_feature (153)..(153): Xaa is any aa, unknown, or other
MPPPSANGATAAAAAARDDMSPAEARLAMMELANMVSVPMALAAVIRLGVPAAVWAGGANAPMSAADLLPPGHPDPSVLERLLRLLASRGVFSESTESTPTTRRRLFXAHRGGPHPGCRXPASGASYGRLRAAAPQDAWGGGAVPPPARGRVXNPAGPRAVRAAKTP

SEQ ID NO: 14757 - DNA, 679 bp, Zea mays
  misc_feature: Ceres CLONE 1376818-F
ggagctccccgcggtggcggccgctctagaactagtggatcccccgggctgcaggaattcgcacgagaccattacctagaacatcctaatcgaaaaagggtccttctgtctcctatctccccggagaccccgctggccaacccggatctcactttccaggctcccagactccgagtctcgctcgaaccccgccccatgcagacagagctctgagtgtgctatgaggagagctgcaacgaaacgctcatctatggagtagatgaattcagatacgacgaggaaaagacttgcattgctgaacctggttcacctgtcgtggcccgtcgcgcccggcctcaccttctccggagtactatgtcctgctcaacagtggagcctctcaaactaatacaagggggggtacttgtacaagctgcttcagtagctgaggatgcatcaacattccctgattagcactatacgcgtcacggttgaattcatttcacatagcacacaccagagaggcatgagcctgagtgttccacaggtagcacatgcagtaaggctcatgaatgagcctcctagacgttgaacgatgacgtcctatacggcctcgtagtatgctatcacatctgtacgatgccggactgcgcactactgtaggacggaagttacgtgttttatgggtcctccaaaccta

SEQ ID NO: 14758 - DNA, 728 bp, Zea mays
  misc_feature: Ceres CLONE 1376821-F
  misc_feature: Encodes the peptide sequence at SEQ ID NO. 14759
tccccgcggtggcggccgctctataactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggtcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtgggggtggccgtggacacgccggggttcctgatcttcagccccgtgctgggccccgccgcgctgctcatcgggacggtcgtcatggggttcctcacgtcgggcgcgctggggctcggtggactgtcctcgctcacgtgactgcgctgcacgtggcggtaggcgttccagcgcaccccggactacctgcaggaggcgcaccgcaggatgacggacggcgcgtcgcgcgcgaggccaaaaaacaggatagcgaggacaggccctccccgcatcggagaagaggccgcgcctgaggaagcgccagaggcttacggg

SEQ ID NO: 14759 - protein, 119 aa, Zea mays
  misc_feature: Ceres CLONE 1376821-F
  misc_feature (44)..(120): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGVAVDTPGFLIFSPVLGPAALLIGTVVMGFLTSGALGLGGLSSLT

SEQ ID NO: 14760 - DNA, 708 bp, Zea mays
  misc_feature: Ceres CLONE 1376822-F
  misc_feature: Encodes the peptide sequence at SEQ ID NO. 14761
tcaccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggggatcaagaaggcgctcgtgttctaccacggcaagccgccgcgcggggtcaagaacggagtggatcatgcacgagtaccgcctcgccgggaaacgcgaagaagtccggcgccggcacgctcaaggg

SEQ ID NO: 14761 - protein, 160 aa, Zea mays
  misc_feature: Ceres CLONE 1376822-F
  misc_feature (21)..(145): Pfam Name: NAM Pfam Description: No apical meristem (NAM) protein
MAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTAGIKKALVFYHGKPPRGVKNGVDHARVPPRRETRRSPAPARSR

SEQ ID NO: 14762 - DNA, 703 bp, Zea mays
  misc_feature: Ceres CLONE 1376829-F
  misc_feature: Encodes the peptide sequence at SEQ ID NO. 14763
cgcggtggcgcgcgctctagaactagtgtatcccccggtgtgcaggaattcgcacgagaccattacctaaaacatcctaatcgaaaaatcgatcgtcaatgcaagtttgtccattcgcattggcccgaatactgcagctactaacgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggtcagaccaactaccccggcgtggccggcaacggcgcgacgttctacttcctggtgttcgccatcctgtgcccgtcgtggtgggcgcggcgtccaagctggcgggcgtgcaccacgtgcgcgcctggcgccacgacagcctgggcaccaacgccgcgtcgtcgctcatcgcctgggccatcacggcgctcgacttcgggctggcctgcaagcagatccacatcggcggacaccgcgtctgtcgcctgcacatgctggaggccttc

SEQ ID NO: 14763 - protein, 125 aa, Zea mays
  misc_feature: Ceres CLONE 1376829-F
  misc_feature (14)..(125): Pfam Name: AWPM-19 Pfam Description: AWPM-19-like family
MAGIGRNMVAPLLVLNLIMYIIVIGFASWNLNHFINGSDQLPRRGRQRRDVLLPGVRHPVPVVVGAASKLAGVHHVRAWRHDSLGTNAASSLIAWAITALDFGLACKQIHIGGHRVCRLHMLEAF

SEQ ID NO: 14764 - DNA, 678 bp, Zea mays
  misc_feature: Ceres CLONE 1376837-F
  misc_feature: Encodes the peptide sequence at SEQ ID NO. 14765
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (461)..(461): n is a, c, t, g, unknown, or other
  misc_feature (488)..(488): n is a, c, t, g, unknown, or other
  misc_feature (552)..(552): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccccgcggaagaggaatgcnnnagagcgagtgccgcgagcggcaccagcaggctgacgcgggcgaagacggcgaacagggnggtggacgcctacgtctcccgctccgnaaagggggcggagtgccggcggcagtggctggcgccgcacgaggggcaggccgtggaggacccnagatggcatgaggcggtgccgccggcgcgggactggccgtcgactggagcaaagagtaccgtcgcggcacgaaacggcggcaagggcccgggaagagtgccagcgccacaccgcgggggactggtg

SEQ ID NO: 14765 - protein, 117 aa, Zea mays
  misc_feature: Ceres CLONE 1376837-F
  misc_feature (64)..(64): Xaa is any aa, unknown, or other
  misc_feature (65)..(65): Xaa is any aa, unknown, or other
  misc_feature (115)..(115): Xaa is any aa, unknown, or other
MGKGSVGASWWAFLLLAGVLLVVAATAGAEDGVVERDRKEDLRWCKQACEWQYGKDTPRGRGMXXSECRERHQQADAGEDGEQGGGRLRLPLRKGGGVPAAVAGAARGAGRGGPXMA

SEQ ID NO: 14766 - DNA, 683 bp, Zea mays
  misc_feature: Ceres CLONE 1376840-F
  misc_feature (432)..(432): n is a, c, t, g, unknown, or other
  misc_feature (441)..(441): n is a, c, t, g, unknown, or other
  misc_feature (499)..(499): n is a, c, t, g, unknown, or other
  misc_feature (528)..(528): n is a, c, t, g, unknown, or other
  misc_feature (534)..(534): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
aagctggagctccccgcggtggcggccgctctagaactagtggatcccccgggctgcaggaattcgcacgagaccattacctagaacatcctaatcgaaaaaactagcaacatagaaagcacaatagtgtaccaacaatggcagccaaaatattttgcttccttatgctccttggtctttctgcaagtgctgctaccgcgaccattttcccgcaatgctcacaagctcctataacttcccttcttcccccatacctctcaccagcagtgtcttcagtgtgtgaaaacccaattcttcaaccctacaggatccaacaggcaatcgcagcaggcatcttacctttatcacccttgttcctccaacaaccgtcagccctattacaacagttaaccttttggtgcattttgtttggcacaaaacattaagggcacnaacactacnacaacttgtgctaagaaaccttgctgcatactctcagcaacatcagtttcctccattncaacaactggctgcattgaactctgctgnctattngcannncacactaccattcagccagctagctgctggctacccccagaatttcttccattttcatcactggcagcatgaactctgctgcttattttacacagcaaagctaccaccattcagccagttagctgatgtgagccctgctgcct

SEQ ID NO: 14767 - DNA, 679 bp, Zea mays
  misc_feature: Ceres CLONE 1376841-F
  misc_feature: Encodes the peptide sequence at SEQ ID NO. 14768
  misc_feature (490)..(490): n is a, c, t, g, unknown, or other
  misc_feature (554)..(554): n is a, c, t, g, unknown, or other
  misc_feature (559)..(559): n is a, c, t, g, unknown, or other
  misc_feature (560)..(560): n is a, c, t, g, unknown, or other
  misc_feature (578)..(578): n is a, c, t, g, unknown, or other
  misc_feature (584)..(584): n is a, c, t, g, unknown, or other
  misc_feature (629)..(629): n is a, c, t, g, unknown, or other
  misc_feature (679)..(679): n is a, c, t, g, unknown, or other
tggagctccccgcggtggcggccgctctagaactagtggatcccccgggctgcaggaattcgcacgagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacacgcagcagcagaaggtggtggtcataggcaacgtctctgcagacgcgctcgtcaagaagctcctcaagtccgggaagcacgcggagccgtggccggagcctgctccagccccaccggccgccgacagcccgcccgggcccgacggatctcccggcagcgcangcaagaagaagaaaaagaagaaggggcacaagagccccgaggcggcgaacaacagcccgccgantcggnngcagcgcccgcgccgcgncggggnagggcaacggcggacccaccccccggagcacacgacaaggctgancgcggcgcttcgtgcgagaggcatcgaatggtgagcagataagctgaagn

SEQ ID NO: 14768 - protein, 158 aa, Zea mays
  misc_feature: Ceres CLONE 1376841-F
  misc_feature (17)..(77): Pfam Name: HMA Pfam Description: Heavy-metal-associated domain
  misc_feature (102)..(102): Xaa is any aa, unknown, or other
  misc_feature (123)..(123): Xaa is any aa, unknown, or other
  misc_feature (125)..(125): Xaa is any aa, unknown, or other
  misc_feature (131)..(131): Xaa is any aa, unknown, or other
  misc_feature (133)..(133): Xaa is any aa, unknown, or other
  misc_feature (148)..(148): Xaa is any aa, unknown, or other
MAAAEEGPEPLRYQTLALRVSIHCEGCKKKVKKVLHSIEGVYKTDIDTQQQKVVVIGNVSADALVKKLLKSGKHAEPWPEPAPAPPAADSPPGPDGSPGSAXKKKKKKKGHKSPEAANNSPPXRXQRPRRXGXGQRRTHPPEHTTRLXAALRARGIEW

SEQ ID NO: 14769 - DNA, 669 bp, Zea mays
  misc_feature: Ceres CLONE 1376852-F
  misc_feature: Encodes the peptide sequence at SEQ ID NO. 14770
  misc_feature (380)..(380): n is a, c, t, g, unknown, or other
tccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacnatgtggacatggtgccaaagtttatgatggcaaatgggacattggttcgaaccctcatccacaccgacgtgacaaagtacttgtcattcaaagctgttgatgggagctatgttttcagtaaagggaagatttacagggtcctggcactgatatggaggctcttgagccccctttgatggggctattccagaagcgcaaaacaagaaacttcttctttatggccaagattaacagggagctggatccagggcccttcggggttgggaccttacaaggggaaacaaagaaa

SEQ ID NO: 14770 - protein, 129 aa, Zea mays
  misc_feature: Ceres CLONE 1376852-F
  misc_feature (1)..(130): Pfam Name: GDI Pfam Description: GDP dissociation inhibitor
  misc_feature (72)..(72): Xaa is any aa, unknown, or other
MDEEYDVIVLGTGLKECILSGLLSVDGLKVLHMDRNDYYGGDSTSLNLNQLWKRFRGEDKPPAHLGASRDYXVDMVPKFMMANGTLVRTLIHTDVTKYLSFKAVDGSYVFSKGKIYRVLALIWRLLSPL

SEQ ID NO: 14771 - DNA, 661 bp, Zea mays
  misc_feature: Ceres CLONE 1376865-F
  misc_feature: Encodes the peptide sequence at SEQ ID NO. 14772
  misc_feature (408)..(408): n is a, c, t, g, unknown, or other
  misc_feature (458)..(458): n is a, c, t, g, unknown, or other
  misc_feature (481)..(481): n is a, c, t, g, unknown, or other
  misc_feature (521)..(521): n is a, c, t, g, unknown, or other
  misc_feature (532)..(532): n is a, c, t, g, unknown, or other
  misc_feature (533)..(533): n is a, c, t, g, unknown, or other
  misc_feature (564)..(564): n is a, c, t, g, unknown, or other
  misc_feature (574)..(574): n is a, c, t, g, unknown, or other
  misc_feature (575)..(575): n is a, c, t, g, unknown, or other
  misc_feature (586)..(586): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgaaaaatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaaggagtcaacccctccactggntgctgcgccttaggggaggcatgcagatcttttgtcagaccttgactggncagacatcaccctttgaggtggnagtctcagacaccattggacatggtcagggcaagatccanggacaggaggnncatcccactggacagcaacgtctcatctttngccgcagcanntggaggatggnaggacccttgctgactacacatcccgaggagagcaccctcactggtgctgcgtctaagggtggnatgcagatctt

SEQ ID NO: 14772 - protein, 84 aa, Zea mays
  misc_feature: Ceres CLONE 1376865-F
  misc_feature (6)..(68): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKGVNPSTGCCALGEACRSFVRP

SEQ ID NO: 14773 - DNA, 671 bp, Zea mays
  misc_feature: Ceres CLONE 1376872-F
  misc_feature: Translation starting site: 192
  misc_feature: SWISSPROT Homolog: EC 5.3.1.1 Triose-phosphate isomerase
  misc_feature (379)..(379): n is a, c, t, g, unknown, or other
  misc_feature (399)..(399): n is a, c, t, g, unknown, or other
  misc_feature (403)..(403): n is a, c, t, g, unknown, or other
  misc_feature (454)..(454): n is a, c, t, g, unknown, or other
  misc_feature (476)..(476): n is a, c, t, g, unknown, or other
  misc_feature (506)..(506): n is a, c, t, g, unknown, or other
  misc_feature (522)..(522): n is a, c, t, g, unknown, or other
  misc_feature (524)..(524): n is a, c, t, g, unknown, or other
  misc_feature (532)..(532): n is a, c, t, g, unknown, or other
  misc_feature (536)..(536): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgncggctcagaaactgctgggntaangaaggaaggtgctttcaccggtgaagtcagtgctgagatgctcgtcaaccntggtgtttccctggggcattcntggacactctgaaaggagagctctgctggnagaatcaaatgaattngntggagacnaggntgcgtatgccctgtctcagggactaaaggtcattgcatgtggtgttgagacacttgagcagagggaggctgggtctaccatggaagnttgtgctgcacaaacaaaagcaattgctgaaaagatcaggactgaagc

SEQ ID NO: 14774 - DNA, 666 bp, Zea mays
  misc_feature: Ceres CLONE 1376873-F
  misc_feature: Encodes the peptide sequence at SEQ ID NO. 14775
  misc_feature (523)..(523): n is a, c, t, g, unknown, or other
  misc_feature (572)..(572): n is a, c, t, g, unknown, or other
  misc_feature (573)..(573): n is a, c, t, g, unknown, or other
  misc_feature (634)..(634): n is a, c, t, g, unknown, or other
tccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctcccagcttcttgacgcgttttgaagacgtggagtacacgaggggacagagtgagatatcattggctgactcttccgagaacatgctggctgacacttacgggggggagtgatgcagaggatctcaatctttatggagaatgggacntttgagtgatatgacttgtttcctgcagccctggggggtaaggctatgnngatatcatgctacggggatcctatcaaaatgatgactctatcagctactgccgttctcggnatctaaattctggtgcgacacgcaccatgaat

SEQ ID NO: 14775 - protein, 86 aa, Zea mays
  misc_feature: Ceres CLONE 1376873-F
MAMKPAAAAPPTPAAAHSVFVYGSLMADEVVRTILKRVPPAAPALLPNYHRFNIKGRIYPAILPVESKRVAGRVIMGVTDEELPAS

SEQ ID NO: 14776 - DNA, 680 bp, Zea mays
  misc_feature: Ceres CLONE 1376877-F
  misc_feature: Encodes the peptide sequence at SEQ ID NO. 14777
aagctggagctccccgcggtggcggccgctctataactagtggatcccccgggctgcaggaattcgcacgagaccattacctacaacatcctaatcgaaaagaggtggagagatcgcacgcgccctctgccgcttgttcgttcctcgcgcttgccaccaggcaccaccacacacatcccaatctcgcgaggcggcgagggcaagcagcagggtctgcggcgcgccgcgctgctcatcggcacggtcgtcgcggggttcctcacgtcgggcgcgctggggctcggcggcctgtcctcgctcacgtgcctcgccaacacggcgcggcaggcgttccagcgcaccccggactacgtcgaggaggcgcgccgcaggatgccggaggccgcggcgcacgcggtccacaagaccgcgcacgccgggcacggcatccagagcaaggcgcacgagggcggtgctggcactggcgccggggggggcaggacttcctcgtaaataggcaaaacatccatggatgcgtgcgtgtcaatgtcagcagggtcgtcgtggaatgctcttccctggacgcgagaaaccgtcttttggtccccttccccgagggcgtgataaatatcctgaagttcctcgggtgtgatgctgcccctaagctgggccctggaaaccgcctgtgggaccgatatctg

SEQ ID NO: 14777 - protein, 39 aa, Zea mays
  misc_feature: Ceres CLONE 1376877-F
MPEAAAHAVHKTAHAGHGIQSKAHEGGAGTGAGGGRTSS

SEQ ID NO: 14778 - DNA, 851 bp, Zea mays
  misc_feature: Ceres CLONE 1376880-F
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
  misc_feature (43)..(43): n is a, c, t, g, unknown, or other
  misc_feature (745)..(745): n is a, c, t, g, unknown, or other
ttttttttttttnnttttnnnncngctaaaaggccggcggctntttgtcaattctggagctccccgcggtggcggccgctctagaactagtggatcccccgggctgcaggaattcgcacgagaccattacctagaacatcctaatcgaaaaagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcggccggcggacgagatgccgtcgcacggcggatctggaccggcaaatcgcgcagctgcgcgacttgcaatacctgcccgaagcggaggtcaaggcgctgctggggagggaggccagggccatctcttatgggaggactggaacgtggcagcccgttgcgcttgcacctgtcacccgggctggtggacgaacaatcccacgggccacgttctaatgcaccttctagcggaggctcctttccgccatcgggccggggcgacggcccccccagaacaaccaaaacttaacctcctttcatggggggggaactaacggggcggactcggggggccttacctaatctccaactccacaaaacgagcttctccccttggtttaaggtggacttttttagaaaggcgccgggtttaacgaggaagngtggtgagatttcccaatttccttcaaggaggcgaaaactcgcgtggaaggagagcaaggagaaaagatcgccttcctcagggaatacgcggggtctttcccaatg

SEQ ID NO: 14779 - DNA, 664 bp, Zea mays
  misc_feature: Ceres CLONE 1376883-F
  misc_feature: Pfam Name: HMA Pfam Description: Heavy-metal-associated domain
  misc_feature (566)..(566): n is a, c, t, g, unknown, or other
tggagctccccgcggtggcggccgctctagaactagtggatcccccgggctgcaggaattcgcacgagaccattacctagaacatcctaatcgaaaattttctttagaaattgtttatgtcccaatgaaacgagttagttaataatcttgtgcttgatatgatctgaagacggaattcatggtggacatgaaatgtgagggatgtgtaacagctgtgaaaaacaagctgcaaactcttgaaggaataaaaaacattgaggtggacttgtctaaccaagtcgttagagttttggggtctcttccagtgaagacaatgttagatgcccttcatcaaacaggtcgagatgcacgactgattggccaagggaacccaaatggtttgtgttaattgtatgttaatcagcatttgttagcaaaactcattcagattagcttggatatttgcagtcatttgttatcaaaattcattatggtaggtttagagatcatcactgagtgaagtgtgatgttggttatttcttatgacatgttgacatttgtagcattagggtttaattgtcgcttgngtatgtgttcttttcatattgagagatccgtcgaaaatggtgaaaatctttaaaatggacactatagtttccattttgtcttgaaatgcttgtaagcc

SEQ ID NO: 14780 - DNA, 895 bp, Zea mays
  misc_feature: Ceres CLONE 1376891-F
  misc_feature: Encodes the peptide sequence at SEQ ID NO. 14781
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (29)..(29): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnaaaaaannnnnaaaaanaaaaaaggaagcgggngnngggcaaagctggggctccaccgcggtggcggccgctctagactagtggatcccccgggctgcaggaattcgcacgagaccattacctagaacatcctaatcgaaaaacggaaaatcccttcaaaacccctccggtccctcacccccatccgccgccgctttcctcccacggtcccaccacgggcgcggccggcgggcggccaacggcgggctagcaccaccgcgcaatcgtaaccgaggcttccacccgacctgggccagaacaagggaccaaaaatgaaccaaccccctaagccttcaaggaggggtgggaaagtcctgggagccgggtattgtaaaaatgggtcgaagattttctgggagggcccgcggtacaagggccctagcggggaaaccgactacgtgggacctagcgtagggattggggcgctcaccggggaaggggttggggcggggaaaggacagcatttaccttgggcccgggaaaagtggggtagagatgggtctttcaagaaaaaaggaatggcttttgccaaacaaaggggcggcccccgcgcaccaaacggcggttccccggccccccggtgtcggccatggaacccaaagggagaagaatgcacacagacatttctctcccaaaaaaagctccttggtggaaaaaatggcgggcgctccaacgctgtttggcctccgcatggggtgaaacgcgggggcaattgggggccttgctcctaagtttcattgcgggaccgccctgtgtgatttgggaaaggccggccgggagcgcgccccgtgcggcttataatgcccacctgcggtggcccccctctatcagtggttgaaccacg

SEQ ID NO: 14781 - protein, 152 aa, Zea mays
  misc_feature: Ceres CLONE 1376891-F
MNQPPKPSRRGGKVLGAGYCKNGSKIFWEGPRYKGPSGETDYVGPSVGIGALTGEGVGAGKGQHLPWAREKWGRDGSFKKKGMAFAKQRGGPRAPNGGSPAPRCRPWNPKGEECTQTFLSQKKLLGGKNGGRSNAVWPPHGVKRGGNWGPCS

SEQ ID NO: 14782 - DNA, 661 bp, Zea mays
  misc_feature: Ceres CLONE 1376893-F
  misc_feature: Translation starting site: 479
  misc_feature: SWISSPROT Homolog: EC 5.2.1.8 Peptidylprolyl isomerase
ggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaaggtccgttcccgtcccagatccgtccatggcttcgtccagatctgacctgtcctgacacaccctcacccggatctgtccctccttcccctctcccctgcagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggc

SEQ ID NO: 14783 - DNA, 692 bp, Zea mays
  misc_feature: Ceres CLONE 1376899-F
  misc_feature: Encodes the peptide sequence at SEQ ID NO. 14784
gctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcaggggctcgtccgcaactaactcacctaggccacctccctcgtccaggaaaaccggggaaggaaattgtgttgaagggtatgggacaggctataaaaaaggcagtggctatttgttgaatcataaaaaaaaaggattcctgggtttgcatcaagataaaaaaaatccagttcctggccaagattaactggatggtatgggaacccccatgtgaggaaaggacttcggaccaatgggaaaaaagaactccggccttggttgccaatggaaaacccagtttgctccttggcgcacccctacgggggggccttaacccagaaaaatttccacccgcgggggaacgca

SEQ ID NO: 14784 - protein, 32 aa, Zea mays
  misc_feature: Ceres CLONE 1376899-F
MDRYQRVEKPPPEAAAIGENEIRITTQGLVRN

SEQ ID NO: 14785 - DNA, 692 bp, Zea mays
  misc_feature: Ceres CLONE 1376900-F
  misc_feature (246)..(246): n is a, c, t, g, unknown, or other
  misc_feature (247)..(247): n is a, c, t, g, unknown, or other
  misc_feature (263)..(263): n is a, c, t, g, unknown, or other
  misc_feature (265)..(265): n is a, c, t, g, unknown, or other
  misc_feature (271)..(271): n is a, c, t, g, unknown, or other
tggagctccccgcggtggcggccgctctagaactagtggatcccccgggctgcaggaattcgcacgagaccattacctagaacatcctaatcgaaaaactcctaagcgccgtcgcgatctgctgcggtggccgctgccgtcgccgtccatccccaccgcctcgaccacgccaccgacgccgcctctcgctccccctcgccgcgccgcccgaacgccacgatgcgtcacctcctcctctcccgctcnnctccgccgcgggtggngncagcgncatccccaacggccactaccaccacctccccctcctccgcgccgtgtcctcctccccctccccggcctcctccgacgcagagctccgcaagacccggggggacgcggcgcctcttcccggctggcggcccccgaaccaactactccttcccgttcccccgccgacccgctgcacaaaaagggcgggcccttcccgtaccgcgccgctgccgggaggacttccacggcccgtctcccactgggaagcggcacggaaacaagggtccatgcccggcggtgtggccccacccgaaatctggtcccggcgcttaaaagagatatccgaccaccgccttaaagggaacgcccccacagtcgggggccccttggctccgggggtggcccccccaaggggacccccctccccccgccactcggcaccg

SEQ ID NO: 14786 - DNA, 680 bp, Zea mays
  misc_feature: Ceres CLONE 1376901-F
  misc_feature (635)..(635): n is a, c, t, g, unknown, or other
gctctagaactagtggatcccccgggctgcaggaattcgcacgagaccattacctagaacatcctaatcaaaaagaggcaaagccgttagccaatctgctgttgcgtgttgcaccgatcaacgtcggttcccagcgcttgctcgtcaagcgtgtcctgctgctgttctctgctcctgcttgccgcgagagctcctctcgctcatctacccaaggtccgacagcaacgacttcgtcgagctgctatgggagaacggccaggcggtggtgcacgggaggaggaagcagcatccccaggccgccttcccgcccttcacctgcggcgcggccagcagcagtagagctcaagaaaaccagccgggtactaccgacccggtctcgctgttcaagacgggaggcctcttcgccgacttctcgtccggcctagacgccgcccgtggcaacggtgaccttgacgacaccgtgccctggatccactgccccatcgtcgaggaagacagcgccgcacccgcacttgccctcgcggagggctacagcccagattttcttctcggagctcaatgcagcggcgttagccagcggcgccggcagagacgaacctcagcctcttgccaccaccgtccagcaaaaaagaaanaaccccgggtgccaccaccagcagaggacagaaaccctcgaagga

SEQ ID NO: 14787 - DNA, 674 bp, Zea mays
  misc_feature: Ceres CLONE 1376910-F
  misc_feature: Encodes the peptide sequence at SEQ ID NO. 14788
agagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaaggaccacggcggcgtgcacgacggcaccgccgtcgtgctctgggagtggtgcaagggcgagaacagagctggaagatctgccgtggggt

SEQ ID NO: 14788 - protein, 171 aa, Zea mays
  misc_feature: Ceres CLONE 1376910-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDKDHGGVHDGTAVVLWEWCKGENRAGRSAVG

SEQ ID NO: 14789 - DNA, 757 bp, Zea mays
  misc_feature: Ceres CLONE 1376911-F
  misc_feature (29)..(29): n is a, c, t, g, unknown, or other
  misc_feature (32)..(32): n is a, c, t, g, unknown, or other
tttttttttttttttttttttttttttanggncgccccacacacggtgtgtaaaactggggctccccgcggtggcggccgctctagaactagtggatcccccgggctgcaggaattcgcacgagaccattacctagaacatcctaatcgaaaagcacatattattgagaccaactagcaacatagaaagcacaatagtgtaccaacaatagcagccaaaatattttgcttccttatgctccttggtctttctgcaagtgttgctaccgcgaccattttcccacaatggtcacaagctcctatagcttcccttcttcccccatacctatcaccagcggtgtcttcagtatatgaaaacccaattgttcaaccctacaggatccaacaggtaatcgcaacaggcatcttaccattatcacccttgttcctccaacgaccgtcagccctattacagcagttacctttggtgcatttggtggcacaaaacatcagggcacaacaactacaacaacttgtgctagcaaaccttgctgcatactctccgcaacatcagttttcttccattcaacccaagtggctgcattgaactccggcggctgattttgcaacaaccaactacccattcagcccagctagcttggtgcctacccccccagggaattttctttccattccaacccaacctaagcagggagttggaaactcctggctggccttaatttaaccgggaagggaagcccgcctgaggtacccagttg

SEQ ID NO: 14790 - DNA, 741 bp, Zea mays
  misc_feature: Ceres CLONE 1376915-F
  misc_feature: Encodes the peptide sequence at SEQ ID NO. 14791
  misc_feature (603)..(603): n is a, c, t, g, unknown, or other
tcaccgcggtggcggccgctctagaactagtggatcccccgggctgcaggaattcgcacgagaccattacctagaacatcctaatcgaaaagccccccccaggtaccgcttctccccctctcactggtcaccacacaccacactactgagtccagaccacggccaacgcggcaggtggatacatgggatgttgcttcagcaagaagcgcaagacccgtccggtggccggagcctctgccttcccgcaccggtgcgagcccgaggaccgcgacccgccgtcgccagaggagacggtcaaggaggtgctctcggagacaccgaacactaagccgagggccgagtcgaagctcgtcggcaatggcgtcgtccccgccgcggacgagcgggaattggagaaggccaagaagcaggacagcgtcgacgccgcggtgagcgacctcggcagctgcgtgtcgctctcgctcgccaccgacgagcggtccgaggcggggtcggagtcctcggtccgcaccagctcggtgacccgttcggaacgggtcgcccggtaagaaacccggccaggagggcgcccggtcctccgtcaattgggggcccagcggcggngcgtccaaagtccgccgccgggggacttcctaaggggggcccgctccccgcaagggcgcggagggagcgcccgtcccccgcccgcctgaggagacctggccaccgggaatattttcggcccggagggttcccacgccc

SEQ ID NO: 14791 - protein, 121 aa, Zea mays
  misc_feature: Ceres CLONE 1376915-F
MGCCFSKKRKTRPVAGASAFPHRCEPEDRDPPSPEETVKEVLSETPNTKPRAESKLVGNGVVPAADERELEKAKKQDSVDAAVSDLGSCVSLSLATDERSEAGSESSVRTSSVTRSERVAR

SEQ ID NO: 14792 - DNA, 689 bp, Zea mays
  misc_feature: Ceres CLONE 1376916-F
  misc_feature: Encodes the peptide sequence at SEQ ID NO. 14793
  misc_feature (586)..(586): n is a, c, t, g, unknown, or other
gctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacnacatccagaaggagagcaccctccacttggtgctgcgtcttaggggtggtatgcagatctttgtgaaacccttactggcaagacatcactcttggagtggagc

SEQ ID NO: 14793 - protein, 169 aa, Zea mays
  misc_feature: Ceres CLONE 1376916-F
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (136)..(136): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYXIQKESTLHLVLRLRGGMQIFVKPLLARHHSWSG

SEQ ID NO: 14794 - DNA, 725 bp, Zea mays
  misc_feature: Ceres CLONE 1376917-F
  misc_feature: Encodes the peptide sequence at SEQ ID NO. 14795
  misc_feature (397)..(397): n is a, c, t, g, unknown, or other
  misc_feature (398)..(398): n is a, c, t, g, unknown, or other
  misc_feature (485)..(485): n is a, c, t, g, unknown, or other
tccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatgggcgtaaaaaaggaagcggnngggagggctcgtcaagacgctgcagctggggtcgctcttcgggctctggtacctcttcaacatctacttcaacatctacaacaaganggggtctggaaggttctgccataccctataaacatcaccacagtgcagtttgcccgttggaagtgccattgggctttgtttatgtggatcaccggtatccttaaaaggccaaaaatttctggtgcccagctttttgctatccttcctctagctatcgttcataccatggggcatcttttcacaactgagccttggaaagaggttgcggtgtcattacacatactatcaaggcatggaccc

SEQ ID NO: 14795 - protein, 117 aa, Zea mays
  misc_feature: Ceres CLONE 1376917-F
  misc_feature (8)..(8): Xaa is any aa, unknown, or other
  misc_feature (37)..(37): Xaa is any aa, unknown, or other
MGVKKEAXGRARQDAAAGVALRALVPLQHLLQHLQQXGVWKVLPYPINITTVQFARWKCHWALFMWITGILKRPKISGAQLFAILPLAIVHTMGHLFTTEPWKEVAVSLHILSRHGP

SEQ ID NO: 14796 - DNA, 771 bp, Zea mays
  misc_feature: Ceres CLONE 1376918-F
  misc_feature: Encodes the peptide sequence at SEQ ID NO. 14797
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
nnnnaaaannnnnnnnnnnnnaaaaggaaacagagagaacgcgtttgtggttcaaagctggggctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaagggtcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtgttccgcaagttcgacgcgaacggcgacgggcagatctcgcggtccgagctggcggcgctgttcgagggcgtgggccacgccgtgaccgaccacgaaggtggcgcgcatgaggggaggagggggcacggcggacgggggagcggggggcatcaggctggcccgaggttcgcccgcgcttcattgggggttcgggggtccgcgggaaacacccggcccccggggcgaaggggaggaaacctggcgtccaacagtccctgcaattgtggtactttaccgaacgccccggaccggggaaaacc

SEQ ID NO: 14797 - protein, 159 aa, Zea mays
  misc_feature: Ceres CLONE 1376918-F
  misc_feature (56)..(84): Pfam Name: efhand Pfam Description: EF hand
MGKGRSFFSRSRSGKRGSARRAGSSSPHSSAASAPPSPSPLPRRSPSSSSTTTRDETERVFRKFDANGDGQISRSELAALFEGVGHAVTDHEGGAHEGRRGHGGRGSGGHQAGPRFARASLGVRGSAGNTRPPGRRGGNLASNSPCNCGTLPNAPDRGK

SEQ ID NO: 14798 - DNA, 764 bp, Zea mays
  misc_feature: Ceres CLONE 1376922-F
  misc_feature: Encodes the peptide sequence at SEQ ID NO. 14799
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (45)..(45): n is a, c, t, g, unknown, or other
  misc_feature (46)..(46): n is a, c, t, g, unknown, or other
nnnnnnnnnnnnnnnnnnnnttttaattttcggggggggcgtcanntaacaaagctggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagacccgtctctgcggctgtagcctcaagattccctggtaaggctgttggtgtaaatctgcctgcgggatcagctccctgcggcagctgctcctgcggatgaggctgaggacgatgatgaccttgatctttttggtgatgaaactgaggaggacaagaagggacctgatgagcgtggccgccgctggcaaggccttcttctaaaaaaaaaagaagggggaaaaaccctcccgtcctttatgggatggttcaaaccatggtgtaacgatggagaccggataattgaaagaaacccttggaaggggaggattggtcccccccaaggtggccccgggatggggaagggggtcc

SEQ ID NO: 14799 - protein, 70 aa, Zea mays
  misc_feature: Ceres CLONE 1376922-F
MAVFSDLHTADGLKSLEAHLAGKTYVSGDSITKDDIKVFAAVPSKPGAEFPNAARWYETRLCGCSLKIPW

SEQ ID NO: 14800 - DNA, 728 bp, Zea mays
  misc_feature: Ceres CLONE 1376928-F
  misc_feature: Encodes the peptide sequence at SEQ ID NO. 14801
  misc_feature (416)..(416): n is a, c, t, g, unknown, or other
  misc_feature (448)..(448): n is a, c, t, g, unknown, or other
  misc_feature (501)..(501): n is a, c, t, g, unknown, or other
  misc_feature (509)..(509): n is a, c, t, g, unknown, or other
  misc_feature (540)..(540): n is a, c, t, g, unknown, or other
  misc_feature (653)..(653): n is a, c, t, g, unknown, or other
ggagctccccgcggtggcggccgctctagaactagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcnaggaggtggtgtcccggatcccgctcaccacnggccgatgagttcaaagcttgccgtcgatgcccgccaggacggcttttccccnggctggcnggaacacgcccgtcacgacgcggcagcgcgntccatgttcaagttccaggagctcatccgggctaacatggacaagcttgcagagaacatcacctacgaagcaggggaagacgctaaaatgtttgggggggcacttgttcccgncccaaaaagggggtgaaacatgctttgtggaatggaacactgcaaatgggcgatatgtatcaatgtttccaaaag

SEQ ID NO: 14801 - protein, 152 aa, Zea mays
  misc_feature: Ceres CLONE 1376928-F
  misc_feature: SWISSPROT Homolog: EC 1.2.1.27 Methylmalonate-semialdehyde dehydrogenase (acylating)
  misc_feature (69)..(69): Xaa is any aa, unknown, or other
  misc_feature (80)..(80): Xaa is any aa, unknown, or other
  misc_feature (100)..(100): Xaa is any aa, unknown, or other
  misc_feature (148)..(148): Xaa is any aa, unknown, or other
MLRSALFRSAPGLRRSPATAHLSTAAAAAAAWLSNGPASAPSRVRLLIGGEFVESRADEHVDVTNPATXGGGVPDPAHHXPMSSKLAVDARQDGFSPGWXEHARHDAAARSMFKFQELIRANMDKLAENITYEAGEDAKMFGGALVPXPKRG

SEQ ID NO: 14802 - DNA, 689 bp, Zea mays
  misc_feature: Ceres CLONE 1376929-F
  misc_feature: Translation starting site: 246
  misc_feature: Pfam Name: Cullin Pfam Description: Cullin family
  misc_feature (451)..(451): n is a, c, t, g, unknown, or other
gctctagaactagtggatcccccgggctgcaggaattcgcacgagaccattacctagaacatcctaatcgaaaaatgcccacgcgctcgcctatctcatagtccttccccattccgcctctctagctggcctgtcgaggaccctcgccatcctccccaggcgcaccaccaaacggtccaaacccccagcggcggcgctaggatttgagtctcagcgcgccggcaccgccaccgccaccggcggtgatggcagggcaggagcgtaggacaatcgatctggaggagggatgggcgtttatgcagaagggtatcaccaagctgaagaacatcctcgagggcaagcccgagcctcagttcagctccgaggactacatgatgctctacacgacgatatacaacatgtgcacgcagaagccgccgcacgactactcgcagcagctctacgacaagtnatcgggagtcgttcgaggagtatatcacctccatggtactaccttcgctaagggagaaacatgatgagtttatgctgagggagctagtgcaaaggtggcaaacttaaaagtcattggttcgtgggctcttcgcgtttctttcattaccttgaccggactcctaaaaacaaggaggtcacttacccccttttaaaaggagttgggtcttacttggctttccgagagttgatatatcaag

SEQ ID NO: 14803 - DNA, 689 bp, Zea mays
  misc_feature: Ceres CLONE 1376930-F
  misc_feature: Encodes the peptide sequence at SEQ ID NO. 14804
  misc_feature (1)..(1): n is a, c, t, g, unknown, or other
  misc_feature (472)..(472): n is a, c, t, g, unknown, or other
  misc_feature (495)..(495): n is a, c, t, g, unknown, or other
  misc_feature (496)..(496): n is a, c, t, g, unknown, or other
  misc_feature (540)..(540): n is a, c, t, g, unknown, or other
  misc_feature (541)..(541): n is a, c, t, g, unknown, or other
nagctggagctccccgcggtggcggccgctctagaactagtggatcccccgggctgcaggaattcgcacgagaccattacctaagaacatcctaatcgaaaatcaacaacagccctacaacttactgcttgctctagctagctagctgctcccggcccatatccactacacaagtaggctagcagcagcagcagcaatggcctcggtgacgaggttcccggccgtggccctcgtcctgctgctcgccgccagcgccttcctggccagcgaggtggcggcgtgcggcggctgcccgaaaccaactcctcctccatcgccaccaccgccgtcgcccaccagcacgccgtgccctccccgccgcgtcagctccggcggcaaagtgcccaagaacgcgctgaaactgggcgtgtgcgccaacgtgctgggccctcgtcaggtgtcatcggcaaagtgccaccgactcgtgctgcanctgctggacggctcgccgactgnnaggccgcgtctgcctctgaccgggtaaaggcaagggggtcgggnnaaacctggaggtccccgtaaagttacctggtctaaataatgggggaaaagggcccccagggtttcgggggctaaaaaattacaaaaagggggtaagtccccccaaattttgggtggccaaaaaaaaaaaaaaagctttcctacgcccc

SEQ ID NO: 14804 - protein, 108 aa, Zea mays
  misc_feature: Ceres CLONE 1376930-F
  misc_feature (92)..(92): Xaa is any aa, unknown, or other
  misc_feature (100)..(100): Xaa is any aa, unknown, or other
MASVTRFPAVALVLLLAASAFLASEVAACGGCPKPTPPPSPPPPSPTSTPCPPRRVSSGGKVPKNALKLGVCANVLGPRQVSSAKCHRLVLXLLDGSPTXRPRLPLTG

SEQ ID NO: 14805 - DNA, 716 bp, Zea mays
  misc_feature: Ceres CLONE 1376936-F
  misc_feature: Encodes the peptide sequence at SEQ ID NO. 14806
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
cgcggtggcggccgctctagaactagtggatcccccgggctgcaggaattcgcacgagaccattacctagaacatcctaatcgaaaatcaccttgtgaccctccctcagacgagtgacgcggcatacctacgatccaaagctctctctgctcgcaggtctcagacctgatcaaaacctacccgaccgtgaccgcctagaacagagaggatgtgtacaagggcaggcgctcgatcctagacctcctcttcgagaagagctgcgccccgctcgtgctccgtcatctgagcaactccacgacgacgatggacgtgtcatcgaggacaggaggacccttcagaacgattgagcatcgcctaaaattggatcacggcgttcacgggccactggacatgttctcgcgactgtgcaagctcatcagggaggtccttccaatcttctctgacggcaatttctactgcttcacggtaggagtgctagtgcaggtgacccgtgcaactgagattctcttccaacccgtaagggagagactgcctcttcccccacctgaagtacgcctatctgagccatgaaggccctgacactcagagtagagttgtgctcattctcggcctgaggccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14806 - protein, 88 aa, Zea mays
  misc_feature: Ceres CLONE 1376936-F
  misc_feature: SWISSPROT Homolog: EC 1.11.1.11 L-ascorbate peroxidase
MDVSSRTGGPFRTIEHRLKLDHGVHGPLDMFSRLCKLIREVLPIFSDGNFYCFTVGVLVQVTRATEILFQPVRERLPLPPPEVRLSEP

SEQ ID NO: 14807 - DNA, 866 bp, Zea mays
  misc_feature: Ceres CLONE 1376937-R
  misc_feature (833)..(833): n is a, c, t, g, unknown, or other
  misc_feature (866)..(866): n is a, c, t, g, unknown, or other
ttgtgtcctctgaattctataacgttgattgtgaaatagtacagacgaccaaagtaataggaacgtcacaacataaaagacaggaaactgaaaaactctaaaaacaacaaccatggaacatcttattttagtattcgctcatccaatacataatacttgaacgtctgcattagcttcatccgaccgccgctcatttcacactgttgcagttggtggttttgctgatcttgtaaggaatgttgactccacatgccttaggaagtccagctgcacgggcagcgttgagagtagggaaggcgttagcggctcctacaaggcaacggcaagcttgctgacggtctggggttgtacgggccaggttgtttagactagtaacgccgctgcagcacgctctgggaagggccggcgcaccctgggccaggtagccaatgcacggtgccacgtagccgctaacggtgccacagctcagagccgcgttcgatgtgattggaccggccacgatcatgcaggccaagaccaagcatgcccatttcattagaccagccatatttctctcttagattttttttgcttgcaaaatgagatgtgtgtggaatgaatgaggggatttttcgattagaatgttccagggaaagggtctcggtgcgaattttctggaggcccggggggaatccactggggttcaagaaagggccttcttaggggggtggggagccttcaagcctcatggtgccgccttttaaggtaagggggttaattacccgcgcggctgtgcgcttaatctgggtggggcatttgcccccggtcttcgccgggtgcgggaacaatccggntgagtccgcttcgggtagaggatcttggactan

SEQ ID NO: 14808 - DNA, 727 bp, Zea mays
  misc_feature: Ceres CLONE 1376941-F
  misc_feature: Translation starting site: 196
  misc_feature (428)..(428): n is a, c, t, g, unknown, or other
  misc_feature (523)..(523): n is a, c, t, g, unknown, or other
  misc_feature (541)..(541): n is a, c, t, g, unknown, or other
  misc_feature (555)..(555): n is a, c, t, g, unknown, or other
  misc_feature (624)..(624): n is a, c, t, g, unknown, or other
  misc_feature (631)..(631): n is a, c, t, g, unknown, or other
  misc_feature (696)..(696): n is a, c, t, g, unknown, or other
  misc_feature (723)..(723): n is a, c, t, g, unknown, or other
ggcggccgctctagaactagtggatcccccgggctgcaggaattcgcacgagaccattacctagaacatcctaatcgaaaagtcagtcagtcacccaccccacaccgccgccgggaacttgttcatcgagccgagaggatagatagatagatagatagatagatagggtaaccgatcgaatccgccaaccaaacaatggcgtccgacggcagtggcgtggtgacggtgtacggcaacaacggcgcggcgctgctggagccgccgaagcagcccaagtcgtcgactttctccgtgaaggtgggcctggcgcagatgctccgcggcggtgtgatcatggacgtggtgaccccggagcaggcccgcctcgccgaggaggccggcgcctgcgccgtgatggcgctggagcgtgtccccgccgacatccgcgncgcagggtggcgtggcgcgcatgtcggacccgggcctgatccgcgacatcaagcgcgccgtgaccatccccgtcatggccaaggcccgcatcggncactttcgtggaggcganaatccctggagggnccgtgggcgtggactacgtggccaaaaaagcgaggtggctgacccgggccgacgacgcccaccacatcnacagacnaacttcgcggggggcctttcggggtgcggctggcgcggacctcgggagggggtttgcgaaggggncccggcgaggccgccgcatgatcggancaaa

SEQ ID NO: 14809 - DNA, 729 bp, Zea mays
  misc_feature: Ceres CLONE 1376943-F
  misc_feature: Encodes the peptide sequence at SEQ ID NO. 14810
  misc_feature (493)..(493): n is a, c, t, g, unknown, or other
  misc_feature (523)..(523): n is a, c, t, g, unknown, or other
  misc_feature (524)..(524): n is a, c, t, g, unknown, or other
  misc_feature (621)..(621): n is a, c, t, g, unknown, or other
  misc_feature (718)..(718): n is a, c, t, g, unknown, or other
  misc_feature (729)..(729): n is a, c, t, g, unknown, or other
tccccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattgacaacgttaaggccaagatccaggacaaggagggcatccccccagaccagcagcggctcatctttgctgccaaacagcttgaggacgggcgcacgcttgctgactacaacatccagaaggagagcaccctccaccttgtgctccgtctcaggggaggcatgcagatctttgtgaaaaccctgaccggcaaaactatcaccctcgaggtggagtcctctgacaccattgacaacgtcaagtgcaagatccaggacnaggtagggcatccctccagaccagcagcgnnctcatcctttgctgggaagcagcttgaggacgggcgcacgcttgccgactacaacatccagaaggagagcacccctccacttggtgctgcgcctcangggaggcatgcagatcttcgtgaagaccctgaccggcaagatatcaccctcgagtggagtcttcagacacgatcgacaacgtcaaggcaagatccangacaaggaggn

SEQ ID NO: 14810 - protein, 187 aa, Zea mays
  misc_feature: Ceres CLONE 1376943-F
  misc_feature (6)..(74): Pfam Name: ubiquitin Pfam Description: Ubiquitin family
  misc_feature (82)..(151): Pfam Name: ubiquitin Pfam Description: Ubiquitin family
  misc_feature (109)..(109): Xaa is any aa, unknown, or other
  misc_feature (119)..(119): Xaa is any aa, unknown, or other
  misc_feature (151)..(151): Xaa is any aa, unknown, or other
  misc_feature (184)..(184): Xaa is any aa, unknown, or other
MQIFVKTLTGKTITLEVESSDTIDNVKAKIQDKEGIPPDQQRLIFAAKQLEDGRTLADYNIQKESTLHLVLRLRGGMQIFVKTLTGKTITLEVESSDTIDNVKCKIQDXVGHPSRPAAXSSFAGKQLEDGRTLADYNIQKESTPPLGAAPXGRHADLREDPDRQDITLEWSLQTRSTTSRQDPXQGG

SEQ ID NO: 14811 - DNA, 681 bp, Zea mays
  misc_feature: Ceres CLONE 1376945-F
  misc_feature: Encodes the peptide sequence at SEQ ID NO. 14812
  misc_feature (523)..(523): n is a, c, t, g, unknown, or other
ggagctccccgcggtggcggccgctctagaactagtggatcccccgggctgcaggaattcgcacgagaccattacctagaacatcctaatcgaaaaacagtgcctctcgctcactgactgactactgtaataccagagatcgaacaacttggtcctgcagctcaagaagagagttttgtgcatttgggggccgggggcaagagagagagagagagccatggcggcggaccagcagccgcagctgcaggaggagatgaacgacgctgccggcggcggcctcaggctgcctccagggttccgcttccacccgagcgacttcgagattgtcagcttctacctcaccaacaaggtgctcaacacgcgcttcacctgcgccggcgtgacggaggccgacctaaacaagattgagccatgggacctcccgagcaaggcgaagatgggcgagaaagagtggtacttcttctaccagaaggaccgcaagtacccgacggggctgagggcgaaccgggccaccgaggccggntactgggaggcgacgggcaagggacaggaggtctacaacgccgccggagggggtggcggtactggtcggcatgaaaaacactctcgtcttctaacggggcagggctcccgggggtgacaagacaactgggtcatgcacgagtaccggctcaaaggagg

SEQ ID NO: 14812 - protein, 140 aa, Zea mays
  misc_feature: Ceres CLONE 1376945-F
  misc_feature (23)..(134): Pfam Name: NAM Pfam Description: No apical meristem (NAM) protein
MAADQQPQLQEEMNDAAGGGLRLPPGFRFHPSDFEIVSFYLTNKVLNTRFTCAGVTEADLNKIEPWDLPSKAKMGEKEWYFFYQKDRKYPTGLRANRATEAGYWEATGKGQEVYNAAGGGGGTGRHEKHSRLLTGQGSRG

SEQ ID NO: 14813 - DNA, 736 bp, Zea mays
  misc_feature: Ceres CLONE 1376946-F
  misc_feature: Encodes the peptide sequence at SEQ ID NO. 14814
  misc_feature (594)..(594): n is a, c, t, g, unknown, or other
tccccgcggtggcggccgctctagaactagtggatcccccgggctgcaggaattcgcacgagaccattacctagaacatcctaatcgaaaaagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaagcatcagtcggaattggctcacggcgctaacgcggggctggacatcgcggtgcggctgctcgagcccatcaaggaggagttcccaatcctctcttacgccgatttctaccagctcgcgggagttgtggccgtggaggtcaccggtgggcctgagattcccttccaccccggtagggaggacaagcctcagcccccacctgagggccgccttcctgtgggccactaagggttctgacacctngaggcaagtttttggcaagcagatgggcttgagcgatcaggacattgttgccctctctggtggcacacccttgggaaggccacaaggagacgtctgggggttttccagggggcctggactacaaaccccttggtctttgaca

SEQ ID NO: 14814 - protein, 135 aa, Zea mays
  misc_feature: Ceres CLONE 1376946-F
  misc_feature (19)..(135): Pfam Name: peroxidase Pfam Description: Peroxidase
  misc_feature: SWISSPROT Homolog: EC 1.11.1.11 L-ascorbate peroxidase
MAKNYPTVSAEYSEAVDKARRKLRALIAEKSCAPLMLRLAWHSAGTFDVSSRTGGPFGTMKHQSELAHGANAGLDIAVRLLEPIKEEFPILSYADFYQLAGVVAVEVTGGPEIPFHPGREDKPQPPPEGRLPVGH

SEQ ID NO: 14815 - DNA, 717 bp, Zea mays
  misc_feature: Ceres CLONE 1376947-F
  misc_feature: Encodes the peptide sequence at SEQ ID NO. 14816
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcatgtatcacactctggccctgagggtgagcatccactgcgagggttgcaagaagaaggtgaagaaggtgctccacagcatagaaggggtgtacaagacggacatagacacgcagcagcagaagggggtggtcataggcaacgtctctgcagacgcgctcgtcaagaaactccctcagtccgggaagcacgcggagccgtggccggaggctgctccagccccaccggccgccgacagcccgcccgggccgacggatctcccggcagcgcggccaagaggaagaaaaagaggaagggccaccaagagccccgagggggggaaccaacaatccccgccgaatccggggcccaggggcccgcgccccggcgccggggggaagggcaaacggggggcacccaaccccccccggaagcagcaccaacaagggcttgacgggcggcgcccctccgtgcgaaggaaggcatccggaatgggggaagccaaggaataagccn

SEQ ID NO: 14816 - protein, 173 aa, Zea mays
  misc_feature: Ceres CLONE 1376947-F
  misc_feature (17)..(77): Pfam Name: HMA Pfam Description: Heavy-metal-associated domain
MAAAEEGPEPLMYHTLALRVSIHCEGCKKKVKKVLHSIEGVYKTDIDTQQQKGVVIGNVSADALVKKLPQSGKHAEPWPEAAPAPPAADSPPGPTDLPAARPRGRKRGRATKSPEGGNQQSPPNPGPRGPRPGAGGKGKRGAPNPPRKQHQQGLDGRRPSVRRKASGMGEAKE

SEQ ID NO: 14817 - DNA, 730 bp, Zea mays
  misc_feature: Ceres CLONE 1376951-F
  misc_feature: Encodes the peptide sequence at SEQ ID NO. 14818
  misc_feature (650)..(650): n is a, c, t, g, unknown, or other
  misc_feature (703)..(703): n is a, c, t, g, unknown, or other
  misc_feature (704)..(704): n is a, c, t, g, unknown, or other
ggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggcggccccggtggtctcctcctcccgccgcagatcagcggacgcgccgttgcccgggtcaggcgagtccaacgcagtgcagttcacgctcgagcacgaccttggcgacggcaagggcttcgtctcagctggaaccttctcggcccgcctcaagaccttcgcccacggcacgcagaccctcactaaacttcgctttacaaggaatgattttactgaggatgataaagcggcgttcaaaaaagtgcttcaggaagatggcttttatacaattaggctgcccatctatggtgttggacactacaaagaaacatcatggtgtttcttcatcagagctagatgctncccacgtggacagtttggatggacacattgtattcaaccatggatgggtgtanntatcttggcagcaattatggctttgt

SEQ ID NO: 14818 - protein, 191 aa, Zea mays
  misc_feature: Ceres CLONE 1376951-F
  misc_feature (165)..(165): Xaa is any aa, unknown, or other
  misc_feature (183)..(183): Xaa is any aa, unknown, or other
MAPPRRALLVLAALLLSLSLGAASFHSDELLLNDDEEFEGVVARPSAPSPPAAPVVSSSRRRSADAPLPGSGESNAVQFTLEHDLGDGKGFVSAGTFSARLKTFAHGTQTLTKLRFTRNDFTEDDKAAFKKVLQEDGFYTIRLPIYGVGHYKETSWCFFIRARCXPRGQFGWTHCIQPWMGVXILAAIMAL

SEQ ID NO: 14819 - DNA, 723 bp, Zea mays
  misc_feature: Ceres CLONE 1376960-F
  misc_feature: Encodes the peptide sequence at SEQ ID NO. 14820
  misc_feature (456)..(456): n is a, c, t, g, unknown, or other
  misc_feature (497)..(497): n is a, c, t, g, unknown, or other
  misc_feature (578)..(578): n is a, c, t, g, unknown, or other
  misc_feature (625)..(625): n is a, c, t, g, unknown, or other
  misc_feature (635)..(635): n is a, c, t, g, unknown, or other
  misc_feature (636)..(636): n is a, c, t, g, unknown, or other
tcaccgcggtggcggccgctctagaactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctctgcacaagaacctagctgccagagaattgctataccaacaccagcataacaaaaggatgagctgccctgccatggcacagctcctctccnataccctgtactacaagcgcttcttcccatattacgccttncatgtgctcggtgggcttgacagcgaggggaaagggtgtgttttcacctatgatgcagtaggttcctacgagagaactggntatagtgctcagggaactggatctactttgatttatgcagtcctggnacatcactannatcaccaagtcctctattgctccctgccagggatgctgtcacacccatgtcggagtcagaggcatcgatctaaattaagggatgtgt

SEQ ID NO: 14820 - protein, 186 aa, Zea mays
  misc_feature: Ceres CLONE 1376960-F
  misc_feature (10)..(180): Pfam Name: Proteasome Pfam Description: Proteasome A-type and B-type
  misc_feature: SWISSPROT Homolog: EC 3.4.25.1 Proteasome endopeptidase complex
  misc_feature (98)..(98): Xaa is any aa, unknown, or other
  misc_feature (111)..(111): Xaa is any aa, unknown, or other
  misc_feature (154)..(154): Xaa is any aa, unknown, or other
  misc_feature (157)..(157): Xaa is any aa, unknown, or other
  misc_feature (158)..(158): Xaa is any aa, unknown, or other
MSRRGDWVYENNGGTCVAIAGADYCVVAADTRLSVGYSILTRDHSKICDLADKCVLASSGFQGDIKALHKNLAARELLYQHQHNKRMSCPAMAQLLSXTLYYKRFFPYYAXHVLGGLDSEGKGCVFTYDAVGSYERTGYSAQGTGSTLIYAVLXHHXXHQVLYCSLPGMLSHPCRSQRHRSKLRDV

SEQ ID NO: 14821 - DNA, 646 bp, Zea mays
  misc_feature: Ceres CLONE 1376962-F
  misc_feature: Encodes the peptide sequence at SEQ ID NO. 14822
  misc_feature (469)..(469): n is a, c, t, g, unknown, or other
  misc_feature (646)..(646): n is a, c, t, g, unknown, or other
aagctggagctcaccgcggtggcggccgctctagaactagtggatcccccgggctgcaggaattcgcacgagaccattacctagaacatcctaatcgaaaatacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaaacacgtcccccgtgctgtttttgttgaccttgagcccactgtcatcgatgaggggaggactggnacctaccggcagctcttccatcctgagcagctcatcagtggaaaggaggatgcagccaacaacttccctcggggtcactacccccatggcaaggaaatttgttgacctgggccctggaccccatcaagaaactttgcaaaaaaatggcactgggcctccagggctttccctcccctn

SEQ ID NO: 14822 - protein, 115 aa, Zea mays
  misc_feature: Ceres CLONE 1376962-F
MRECISIHIGQAGIQVGNACWELYCLEHGIQADGQMPGDKTIGGGDDAFNTFFSETGAGKHVPRAVFVDLEPTVIDEGRTGTYRQLFHPEQLISGKEDAANNFPRGHYPHGKEIC

SEQ ID NO: 14823 - DNA, 623 bp, Zea mays
  misc_feature: Ceres CLONE 1376964-F
  misc_feature: Encodes the peptide sequence at SEQ ID NO. 14824
  misc_feature (188)..(188): n is a, c, t, g, unknown, or other
  misc_feature (220)..(220): n is a, c, t, g, unknown, or other
  misc_feature (266)..(266): n is a, c, t, g, unknown, or other
  misc_feature (343)..(343): n is a, c, t, g, unknown, or other
tccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccggnggcaagagagagagagagagccatggcggcgnaccagcagccgcagctgcaggaagagatgaacgacgctgcccgcgncggcctccagctgcctccagggttccgcttccacccgagcgacttcgagatggtcagcttctacctcacaaacaggntgctcaaaacgggtttcacctgcacgccatcccgggagccgagctaaacaaagatgggccctggggactccctagcaaagggaaaaagggcaagaaaaaatgggcacttcttctacccaaaaggcccgaagtcccccacggggcttgaggggaaccgggccccccggggcggtttttggagagggagggcaaggcaaaggaggcctacaccccccaaaaggggggggggccctctggcccacataaaaaaaacccccccttttaaggggggggggccccc

SEQ ID NO: 14824 - protein, 59 aa, Zea mays
  misc_feature: Ceres CLONE 1376964-F
  misc_feature (4)..(4): Xaa is any aa, unknown, or other
  misc_feature (19)..(19): Xaa is any aa, unknown, or other
  misc_feature (45)..(45): Xaa is any aa, unknown, or other
MAAXQQPQLQEEMNDAARXGLQLPPGFRFHPSDFEMVSFYLTNRXLKTGFTCTPSREPS

SEQ ID NO: 14825 - DNA, 717 bp, Zea mays
  misc_feature: Ceres CLONE 1376965-F
  misc_feature: Encodes the peptide sequence at SEQ ID NO. 14826
  misc_feature (556)..(556): n is a, c, t, g, unknown, or other
  misc_feature (558)..(558): n is a, c, t, g, unknown, or other
  misc_feature (566)..(566): n is a, c, t, g, unknown, or other
  misc_feature (607)..(607): n is a, c, t, g, unknown, or other
  misc_feature (644)..(644): n is a, c, t, g, unknown, or other
tccccgcggtggcggccgctctagaactagtggatcccccgggctgcaggaattcgcacgagaccattacctagaacatcctaatcgaaaagaagctctctctgctcgcagccatggcgaagaattacccaaccgtgagcgccgagtacagcgaggccgtcgagaaggccaggcgcaagctccgcgccctcatcgccgagaagagctgcgcgcccctcatgctccgcctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggcagggaggacaagcctcagccgccacctgagggccgtcttctgatgcccaccaaaggggttctgaccacccctgagcagtcttggcaagnangatggggntttgagtgatcagggacatggtgcccctctctggtggcaanccccttgggaaggccccaaagagagccgggctggggntttttaggggggggccggaactacaaaccccttttgggcctttgacaactcttaccttcaaggaaatttctgg

SEQ ID NO: 14826 - protein, 153 aa, Zea mays
  misc_feature: Ceres CLONE 1376965-F
  misc_feature (19)..(149): Pfam Name: peroxidase Pfam Description: Peroxidase
  misc_feature: SWISSPROT Homolog: EC 1.11.1.11 L-ascorbate peroxidase
  misc_feature (148)..(148): Xaa is any aa, unknown, or other
  misc_feature (149)..(149): Xaa is any aa, unknown, or other
MAKNYPTVSAEYSEAVEKARRKLRALIAEKSCAPLMLRLAWHSAGTFDVSSRTGGPFGTMKCPAELAHGANAGLDIAVRLLEPIKEEFPTLSYADFYQLAGVVAVEVTGGPEIPFHPGREDKPQPPPEGRLLMPTKGVLTTPEQSWQXXWGFE

SEQ ID NO: 14827 - DNA, 701 bp, Zea mays
  misc_feature: Ceres CLONE 1376966-F
  misc_feature: Translation starting site: 216
  misc_feature: SWISSPROT Homolog: EC 2.5.1.18 Glutathione transferase
  misc_feature (528)..(528): n is a, c, t, g, unknown, or other
  misc_feature (538)..(538): n is a, c, t, g, unknown, or other
  misc_feature (588)..(588): n is a, c, t, g, unknown, or other
  misc_feature (666)..(666): n is a, c, t, g, unknown, or other
  misc_feature (677)..(677): n is a, c, t, g, unknown, or other
ccccgcggtggcggccgctctagaactagtggatcccccgggctgcaggaattcgcacgagaccattacctagaacatcctaatcgaaaaatcacataagtccgccgcccctctccctcagtaaacccccctctcttcttcccgcggtctgctcgttcgatctgtgcagcagatctgaggtctcgagcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccctctttttgggtcttcccgtattgaacaagcccacgttgagcaatggatggattttgcgcaacagaagntgatcctggntgtgcatggtacttgtatccaaggcttgggtacctcccttatgtcagcancactgaggaaacagctatttcttcattgaagaggtcgcttggtgctctgaacaccacctggctcaacaattacttggntggcatgctgntatctagctgacattggattgact

SEQ ID NO: 14828 - DNA, 731 bp, Zea mays
  misc_feature: Ceres CLONE 1376967-F
  misc_feature: Translation starting site: 163
  misc_feature: SWISSPROT Homolog: EC 1.2.1.12 Glyceraldehyde-3-phosphate dehydrogenase (phosphorylating)
  misc_feature (513)..(513): n is a, c, t, g, unknown, or other
  misc_feature (519)..(519): n is a, c, t, g, unknown, or other
  misc_feature (571)..(571): n is a, c, t, g, unknown, or other
  misc_feature (577)..(577): n is a, c, t, g, unknown, or other
  misc_feature (590)..(590): n is a, c, t, g, unknown, or other
  misc_feature (659)..(659): n is a, c, t, g, unknown, or other
  misc_feature (677)..(677): n is a, c, t, g, unknown, or other
  misc_feature (683)..(683): n is a, c, t, g, unknown, or other
ggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtgggggttcggttggtgctgaatatgttgttgagtctactggtgttttcactgaccaggagaaggctgcagctcacttgaagggtgntgcccnagaagggtgtcatctctgctcctagcaagatgcccccatgttttgtcgttgntgtcancgagaaggagtancagtctgacattaacattgtctccaatgctagctgcacaaccaactgccttgctccctctgctaagcantccatggacaagtccggnaaccgntggaggggcctgatggacactgtccatgccatcactgctacccagaag

SEQ ID NO: 14829 - DNA, 700 bp, Zea mays
  misc_feature: Ceres CLONE 1376969-F
  misc_feature: Encodes the peptide sequence at SEQ ID NO. 14830
  misc_feature (299)..(299): n is a, c, t, g, unknown, or other
  misc_feature (379)..(379): n is a, c, t, g, unknown, or other
tggcggccgctctagaactagtggatcccccgggctgcaggaattcgcacgagaccattacctagaacatcctaatcgaaaatctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggncatgaggtcttgctgtttgaagctcttcgtgaggccttgatggaagagatggaattagatcccacagtgtgtgtatttgntgaagaatgttgccaattacggtgggttccttaaaggggggggggaacaacaaaaaaaaaagggggtttgtggggggccttggaaaaaaacctttttggggagaacctccaggtcttgcacacccctattgcgaaaaacctctttactggcaatggaaagttgaacgggaattgaaagggcttgagcccccccccttgagggcatgaaatggggattccctggtctttggttaaaacaaatccaaaaaagggggggatgggttaattaactttccggggggcagtaaaaacccctttggggcggggggccccccgggtggg

SEQ ID NO: 14830 - protein, 97 aa, Zea mays
  misc_feature: Ceres CLONE 1376969-F
  misc_feature (87)..(87): Xaa is any aa, unknown, or other
MATAFSLRAAAPATAPRAVSRSTSAARVVPVASALAGRGRLVARAAVTAKADVPSSTSDGHEVLLFEALREALMEEMELDPTVCVFXEECCQLRWVP

SEQ ID NO: 14831 - DNA, 686 bp, Zea mays
  misc_feature: Ceres CLONE 1376971-F
  misc_feature: Encodes the peptide sequence at SEQ ID NO. 14832
  misc_feature (484)..(484): n is a, c, t, g, unknown, or other
  misc_feature (485)..(485): n is a, c, t, g, unknown, or other
  misc_feature (611)..(611): n is a, c, t, g, unknown, or other
  misc_feature (675)..(675): n is a, c, t, g, unknown, or other
cacccgcggtggcggccgctctagaactagtggatcccccgggctgcaggaattcgcacgagaccattacctagaacatcctaatcgaaaaacttccgtgccctacgccccagaacctcccaccgcatcggagggctccgcgcctccgccacgccgatggcgtcccagccgccgccagagcccgcaccggccgaggcgggtctggaaagcatggagggcctcgtcctcgacacggtcatctcaagagccggcgcgcgccccgcagcggcgctcgcctgcgccagcacgcgcctccgcaccgccgttgccgacgactccctctggcgcagattctgcggtgaggacctggggctcgacgctcccgtcgatccagagggccggcctcttccctccttccaggttgcatataaagtttggtcggagtcttttggcatgtaccctctacctatggtaaagagagtgagacaattctggacttcatgannaacttggttgtctgaaaactttcctgaggcatacaaacgttattgcgaaggtgtttctgaaagctcattaagtcagcagagggatggatcttggtttcaagctccctatgcccacaaagctggtgnatcgcttttgcatgctcaactggctttttagtggaggacatgacccaaataaagcattcccctnaatggattggt

SEQ ID NO: 14832 - protein, 108 aa, Zea mays
  misc_feature: Ceres CLONE 1376971-F
MASQPPPEPAPAEAGLESMEGLVLDTVISRAGARPAAALACASTRLRTAVADDSLWRRFCGEDLGLDAPVDPEGRPLPSFQVAYKVWSESFGMYPLPMVKRVRQFWTS

SEQ ID NO: 14833 - DNA, 691 bp, Zea mays
  misc_feature: Ceres CLONE 1376972-F
  misc_feature: Encodes the peptide sequence at SEQ ID NO. 14834
  misc_feature (421)..(421): n is a, c, t, g, unknown, or other
  misc_feature (433)..(433): n is a, c, t, g, unknown, or other
  misc_feature (439)..(439): n is a, c, t, g, unknown, or other
  misc_feature (511)..(511): n is a, c, t, g, unknown, or other
  misc_feature (520)..(520): n is a, c, t, g, unknown, or other
  misc_feature (535)..(535): n is a, c, t, g, unknown, or other
ccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtcacctggcaccgccggtccatgtgccgcccgcggttcatctgccgccgccaccatgggcactacctactncaccgccccggnctcagnctcatccccagcacacccatgcccgtgtgcacagccgcatcccagcccggtgcagctgcaggaaccctgggnggtggcagnaccccgatcctgggncagggggggcaaggttctgaaggatcagggcagccggaagggaagccctactgctcccctcaagggcattcgttgggggaaaaagggttgcagcactccaggggggggggagcccaacccggtcacggggatttttcggtttggcccccagccccc

SEQ ID NO: 14834 - protein, 95 aa, Zea mays
  misc_feature: Ceres CLONE 1376972-F
  misc_feature (6)..(6): Xaa is any aa, unknown, or other
  misc_feature (10)..(10): Xaa is any aa, unknown, or other
  misc_feature (12)..(12): Xaa is any aa, unknown, or other
  misc_feature (36)..(36): Xaa is any aa, unknown, or other
  misc_feature (39)..(39): Xaa is any aa, unknown, or other
  misc_feature (44)..(44): Xaa is any aa, unknown, or other
MGTTYXTAPXSXSSPAHPCPCAQPHPSPVQLQEPWXVAXPRSWXRGGKVLKDQGSRKGSPTAPLKGIRWGKKGCSTPGGGEPNPVTGIFRFGPQP

SEQ ID NO: 14835 - DNA, 692 bp, Zea mays
  misc_feature: Ceres CLONE 1376974-F
  misc_feature: Translation starting site: 156
  misc_feature (220)..(220): n is a, c, t, g, unknown, or other
  misc_feature (422)..(422): n is a, c, t, g, unknown, or other
tccccgcggtggcggccgctctagaactagtggatcccccgggctgcaggaattcgcacgagaccattacctagaacatcctaatcgaaaaaacatattattgagaccaacaagcaacatagaaagtggaatccagtagcaacaatagagcaacaatggcgaccaagatattttccctccttatgctccttgctctttctacatgtgttgctaacgcgancattttccctcaatgctcacaagctcctatagcttcccttcttccccatacccttcatcaattatagcttcaatatgtgaaaaccagctcttcaccatataggcttcacaagcaatcgcagcaagcacataccttttatcgccttggttgttcaacaatcgcagccctatcttttgtgcagtcattggtacaaccatcaggncacacagctgcagcaactcgtgctacctctgatcaaccaagtagctctgggaaacctttcttcttactctcaggaacaactatttcttccaatccaaccactggcttaccctgaaccctggtggttatttgcagcaacaaactattacctttagccggctaggttcgggctactctcagaaaaaaaaattttttcattttaacaattgggcccgacttaaacccctttgtttatttggggaaaaaaaaaactaacctttaagccggttgt

SEQ ID NO: 14836 - DNA, 673 bp, Zea mays
  misc_feature: Ceres CLONE 1376978-F
  misc_feature: Translation starting site: 338
  misc_feature: SWISSPROT Homolog: EC 3.1.3.16 Phosphoprotein phosphatase
  misc_feature (395)..(395): n is a, c, t, g, unknown, or other
  misc_feature (407)..(407): n is a, c, t, g, unknown, or other
  misc_feature (408)..(408): n is a, c, t, g, unknown, or other
  misc_feature (448)..(448): n is a, c, t, g, unknown, or other
tccccgcggtggcggccgctctagaactagtggatcccccgggctgcaggaattcgcacgagaccattacctagaacatcctaatcgaaaaaaaagatcgcgaagcgagagggaatggatggaggcataggcactagcacctcctcgcctccacctccgtcctcttcgatcccgtccaatcccccgcgccccggcgcccctctccgccggcggctttgctgggtcccgcgctcctcctcctcctaggctgttctggttggggctgcggcggagggaactaggtaaggggaaggaaaggggaggtttgagggagagcgcagcggcagcggcagcagcgatgccatcgcacgcggatctggaccgccagatctcgcagctgcgggattgcaagtccntgcctgaggcgnnagtcaaacgctatgcgagcaggccaaggcgatctcatggnagagtgaacgtgaagcccgtgcgctgccccggcactgtctgggggaaatccaccggcagttctacaacctcatcgagttctttcaattggggggggaaggcccaaaccaaataactttttagggggaataacccaaccgggggtaccacctagggggagatggggccttatgggggggcctaaaaggacctttaagagcccaatccccattttgggagggaacct

SEQ ID NO: 14837 - DNA, 659 bp, Zea mays
  misc_feature: Ceres CLONE 1376979-F
  misc_feature: Encodes the peptide sequence at SEQ ID NO. 14838
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaaggcggcgcccgatgggtgagcaggtgaaaggcatgctccacgacaagggggccgacggcgtcccaggggctgacggtggtgacgctgttcccgctgggcgggctgctgctggtgctgtccgggctggccctgaacgccctccgggggggggctggcccgggcccaccccgggttcctgatttttagccccggggttcctccccgccgggtttttaattggaaagggcggaatggggtttccccccgccggggggcctgggggtcgggggccttgcctcccctcacggggcccccaaaaagggggggggggggggtccccgggaccccgggtaaatgggggggagggccccccccaaaagggggggggcccccggccaacccggc

SEQ ID NO: 14838 - protein, 84 aa, Zea mays
  misc_feature: Ceres CLONE 1376979-F
MADRDRSGIYGGAHATYGQQQQQGGRRRPMGEQVKGMLHDKGADGVPGADGGDAVPAGRAAAGAVRAGPERPPGGGWPGPTPGS

SEQ ID NO: 14839 - DNA, 630 bp, Zea mays
  misc_feature: Ceres CLONE 1376982-F
  misc_feature: Encodes the peptide sequence at SEQ ID NO. 14840
ctagaactagtggatcccccgggctgcaggaattcgcacgagaccattacctagaacatcctaatcgaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctggtgccctggtgccctccagtacatcagcggggtgatcctccttcggggagaccctctaccagaagaccagggggggaaagccttttggcgaggccctaggggggggggggtccccccgggatcagggccacaagggccccttggagggtggtgggccccacagggaaaccccccccccggggcccgcgaaaaccccgggaagggggtggcggaaaaaaacaaagaaggcgcggggcccccctttttccaagagggggggggttttttctccaagaaagggggccccccaaggggcgcggg

SEQ ID NO: 14840 - protein, 160 aa, Zea mays
  misc_feature: Ceres CLONE 1376982-F
  misc_feature (11)..(149): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFWCPGALQYISGVILLRGDPLPEDQGGKAFWRGPRGGGVPPGSGPQGPLGGWWAPQGNPPPGARENPGKGVAEKNKEGAGPPFFQEGGGFFSKKGGPPRGA

SEQ ID NO: 14841 - DNA, 702 bp, Zea mays
  misc_feature: Ceres CLONE 1376984-F
  misc_feature: Encodes the peptide sequence at SEQ ID NO. 14842
  misc_feature (702)..(702): n is a, c, t, g, unknown, or other
tcagaacaggtggatcccccgggctgcaggaattcgcacgagaccattacctaaacatcctaatcgaaaagtccttgtgcgttccttgaagccatatcggactccgcgcctccgttgcctcccgaaagcattgtcatctcttcacgtacaatgtgacgcgtatgcaccgcctccgccccctcttcctcttcgttctcttggcgtctctacaatgcaatgcgaagacgacggccgatggcataccgaggtgtccacctaggcattctgctcggcgcagccatccagcaagtgctccggggcccactccgatctactggaaatgcaccgatcccaccctctccccctcgcaggtcgaagatttacctgcaatcacaggaactgttattacaagggatcatgctttaataacccccaatagtcttgcattcccgccctctgccctggtgggatccataccgtaggaaccatatttgaaaacggcccaggtatttggtggccactttcattatgttatcctaccaaaaatgcaagggtttggaaaggtgtcctttatatgaacctcacggtgggaacattacaccctttggtccagaatttttgccttcacttgccaattcccttatttaatccgcctttaattggccaattccccctggccccaaaaatgggttgggtttacagggctttttcgaacaaaaaatn

SEQ ID NO: 14842 - protein, 99 aa, Zea mays
  misc_feature: Ceres CLONE 1376984-F
MHRLRPLFLFVLLASLQCNAKTTADGIPRCPPRHSARRSHPASAPGPTPIYWKCTDPTLSPSQVEDLPAITGTVITRDHALITPNSLAFPPSALVGSIP

SEQ ID NO: 14843 - DNA, 672 bp, Zea mays
  misc_feature: Ceres CLONE 1376985-F
  misc_feature: Translation starting site: 262
  misc_feature: Pfam Name: Pribosyltran Pfam Description: Phosphoribosyl transferase domain
  misc_feature: SWISSPROT Homolog: EC 2.4.2.7 Adenine phosphoribosyltransferase
  misc_feature (145)..(145): n is a, c, t, g, unknown, or other
  misc_feature (162)..(162): n is a, c, t, g, unknown, or other
  misc_feature (167)..(167): n is a, c, t, g, unknown, or other
  misc_feature (169)..(169): n is a, c, t, g, unknown, or other
  misc_feature (426)..(426): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaaagttgcgacgccgtcagcctgacggaggccggcaccaacgccaagcgntggggcaaggaggtcgnccgcnanccggctgcagcccccgccgccgcggccgacccccggctgcagggcatttccgacgccatccgcgtcgtgccgcacttccccaagcaagcatcatgttcaacgacatcaccacgctgctgctgcgccccagggtgttcaaggacgccgtcgacctgttcgtcgagcggtaccgcgggatgggcatcgacgccgtcgccgggattgaggccaggggcttcgtgttcggcccggcgatcgcgctggctattggcgcaagntcatacttctgcggagccaagggaggtcccaggtgaggtgatctcggagaagtacgttctcgagtaccggactgatggcctgaagatgcgtgtcggggccatctagcgttccggggagcgggtgctggtcatcgacgacctggtttggaccggagggacctttgtgctgggatcaggtttctagnacgtgtttgaacccatttggtcaagtgcccctgtgtctttgggctccgaaaattcaggggg

SEQ ID NO: 14844 - DNA, 728 bp, Zea mays
  misc_feature: Ceres CLONE 1376988-F
  misc_feature: Encodes the peptide sequence at SEQ ID NO. 14845
  misc_feature (412)..(412): n is a, c, t, g, unknown, or other
  misc_feature (491)..(491): n is a, c, t, g, unknown, or other
  misc_feature (587)..(587): n is a, c, t, g, unknown, or other
  misc_feature (633)..(633): n is a, c, t, g, unknown, or other
  misc_feature (634)..(634): n is a, c, t, g, unknown, or other
  misc_feature (660)..(660): n is a, c, t, g, unknown, or other
aagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatgtgggtgctgtacggnctgccgctggtgcacccgcacagcatgctggtggtgacccatcacggcaccggcatgctcatccagctgacctacgtgncgctcttcatccctctgctccgcggggcggtgcgccgcagggtcgtgctccctgtcgcccgcgaggtcgccttcgtcgtcgccttggccgcgctgntgctcaccctggcgcacacgcacgagcgcaggtccatgctcgtcgnnatcgtctccgtcttcttcggaccggnatgtacgctgcgccgctctcgtcatgagaatggtgatccagaaaggagcgtggaatactgcccctgtt

SEQ ID NO: 14845 - protein, 166 aa, Zea mays
  misc_feature: Ceres CLONE 1376988-F
  misc_feature (9)..(98): Pfam Name: MtN3_slv Pfam Description: MtN3/saliva family
  misc_feature (88)..(88): Xaa is any aa, unknown, or other
  misc_feature (120)..(120): Xaa is any aa, unknown, or other
  misc_feature (135)..(135): Xaa is any aa, unknown, or other
  misc_feature (144)..(144): Xaa is any aa, unknown, or other
MVSADTIRTAIGVIGNGTALVLFLSPVPTFVGIWKKRAVEQYSPIPYVATLLNCMMWVLYGLPLVHPHSMLVVTHHGTGMLIQLTYVXLFIPLLRGAVRRRVVLPVAREVAFVVALAALXLTLAHTHERRSMLVXIVSVFFGPXCTLRRSRHENGDPERSVEYCPC

SEQ ID NO: 14846 - DNA, 687 bp, Zea mays
  misc_feature: Ceres CLONE 1376989-F
  misc_feature: Translation starting site: 161
  misc_feature: Pfam Name: DUF502 Pfam Description: Protein of unknown function (DUF502)
  misc_feature (431)..(431): n is a, c, t, g, unknown, or other
  misc_feature (453)..(453): n is a, c, t, g, unknown, or other
  misc_feature (476)..(476): n is a, c, t, g, unknown, or other
  misc_feature (518)..(518): n is a, c, t, g, unknown, or other
tccccgcggtggcggccgctctagaactagtggatcccccgggctgcaggaattcgcacgagaccattacctagaacatcctaatcgaaaacacacccgcatctgcttcattccacccgccccgcgaggagcttctagaaggggagaccccggcggagccatggcggaggaaaaggagtcgacgtcgatcccgctcagccaggcggcggaggctgtcgaccccgaggacccggccaagtcgccgccgcgacccagctcgcccaccacctccacacgcaagtcccctatatgcaaaaattggaatcgacatatttggtcttggttttttgacttctctggtattcatatttctggttggaatatttgtttcttcatgggttggttcaaccatcttctgggtgggcgagtggtttataaagaaatccatttgntagacatatatattcagcatcnaagcaagtcagcactgcaatttncacagatcaaaatacgactgctttcaaagaagttgcaataantcgtcatccacgaaatgggggataatgcattgggattcataacatcaacggggggtcttcaaactggccagggcaatgaaaaactggggaattgggtatgggcccacaaatcatctaaacctcggggaaatattttcggggaacccggagggaatctaaagacttattt

SEQ ID NO: 14847 - DNA, 691 bp, Zea mays
  misc_feature: Ceres CLONE 1376994-F
  misc_feature: Encodes the peptide sequence at SEQ ID NO. 14848
tggagctccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggggctctaggtttaagcgcaatgatgttgttgtaagagcaatatcggaagagtgtggcccgcaggggctccccattgatctcagaggtaaaagggcattcattgctgggagtgctgatgataatggctatggatgggcaatgcaaaggcacctgctgcggctgggctgaaatcctggggggacatgggtggcgggccttacttttttggaacaaatctgaggggggggaagtttgataaatccgggactgcccaaaggggttctttatggaatttgggaaagctttccccttgggggggggcaaaaattcccccggggggtccccggaaagggccaaccaaaaaaaaaattgg

SEQ ID NO: 14848 - protein, 106 aa, Zea mays
  misc_feature: Ceres CLONE 1376994-F
  misc_feature: SWISSPROT Homolog: EC 1.3.1.9 Enoyl-[acyl-carrier-protein] reductase (NADH)
MTASAAAGVQMVAARPCISASPGILTARVAVSRTDCMLSTTATFPKISCSWGSRFKRNDVVVRAISEECGPQGLPIDLRGKRAFIAGSADDNGYGWAMQRHLLRLG

SEQ ID NO: 14849 - DNA, 727 bp, Zea mays
  misc_feature: Ceres CLONE 1377001-F
  misc_feature: Encodes the peptide sequence at SEQ ID NO. 14850
  misc_feature (540)..(540): n is a, c, t, g, unknown, or other
  misc_feature (581)..(581): n is a, c, t, g, unknown, or other
  misc_feature (635)..(635): n is a, c, t, g, unknown, or other
  misc_feature (649)..(649): n is a, c, t, g, unknown, or other
  misc_feature (650)..(650): n is a, c, t, g, unknown, or other
  misc_feature (703)..(703): n is a, c, t, g, unknown, or other
  misc_feature (725)..(725): n is a, c, t, g, unknown, or other
ggagctccccgcggtggcggccgctctagaactagtggatcccccgggctgcaggaattcgcacgagaccattacctagaacatcctaatcgaaaaatctctcaaagccaaagctctctccctctctctgtctctgcttgtgtagccatggctaactcgataatggcttcctccaaacccctcatctccctctcctcctcaactcaaccaacccgcgtcaacctccccaaatccatcaaactcccccagatccccaaacccatctcctcctccctcagcagcaaggctctgtctttctcctccgccaccgtaaagtctctagctttaatcgccgccctcgctcccccttccatggccgaagctatggagaaggcgcagctcttcgacttcaacctcacgctcccgatcatcgtcgtggagtttctcttcctgatgttcgcgctcgacaaggtgtattattcgccgcttgggaactttatggataagagagacggtgagattaaagagaagctcgcgagcgtgaaggacacttccgctgangtgaaagagctcgatgaaacagctgctgctgtgatgaaggncgctagggctgagatcgccgccgcgcttataagatgaagaagagacgcaggtgnaagtaaaagagcannctgcgtaaggaagaaaaaaagtgaggcgacttgcagaacgcgtgcgagcttgnaaagcaaaaagagagacattangt

SEQ ID NO: 14850 - protein, 156 aa, Zea mays
  misc_feature: Ceres CLONE 1377001-F
  misc_feature: SWISSPROT Homolog: EC 3.6.3.14 H(+)-transporting two-sector ATPase
  misc_feature (131)..(131): Xaa is any aa, unknown, or other
  misc_feature (145)..(145): Xaa is any aa, unknown, or other
MANSIMASSKPLISLSSSTQPTRVNLPKSIKLPQIPKPISSSLSSKALSFSSATVKSLALIAALAPPSMAEAMEKAQLFDFNLTLPIIVVEFLFLMFALDKVYYSPLGNFMDKRDGEIKEKLASVKDTSAXVKELDETAAAVMKXARAEIAAALIR

SEQ ID NO: 14851 - DNA, 681 bp, Zea mays
  misc_feature: Ceres CLONE 1377007-F
  misc_feature: Translation starting site: 139
  misc_feature (474)..(474): n is a, c, t, g, unknown, or other
  misc_feature (475)..(475): n is a, c, t, g, unknown, or other
tccccgcggtggcggccgctctagaactagtggatcccccgggctgcaggaattcgcacgagaccattacctagaacatcctaatcgaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgtttcgggaactccaaccagttcttcaccgtcgcctttcgagctggcagggctaagggctccacgctccttttacgaggagnntgtgacgatggatcccatgaatgggcaatctacggcggacccggaaagttgctatggcgaaagggtccttcaaaaaaggtaccttgccaatagggacgggcccggaaactgacaagttccattggggttttttgcccgggggttggttttccgcggaccaaaaaggggggcccccctttcttccccaaaatgggttttggggggga

SEQ ID NO: 14852 - DNA, 650 bp, Zea mays
  misc_feature: Ceres CLONE 1377008-F
  misc_feature: Translation starting site: 454
  misc_feature: SWISSPROT Homolog: EC 3.4.25.1 Proteasome endopeptidase complex
  misc_feature (253)..(253): n is a, c, t, g, unknown, or other
  misc_feature (284)..(284): n is a, c, t, g, unknown, or other
ccccgcggtggcggccgctctagaatagtggatcccccgggctgcaggaattcgcacgagaccattacctagaacatcctaatcgaaaaaagacgaactcggtgaactctttctcctcgcgcagcaccggagcacaatcaaggattccagtccagtcctgccaatggagtgcgttttgggcttggttgccgcgacttcgcggtggtggcggcgacactccgccgtgcagagtatctcgtccacagactgacgnagacaaagtatgtcctcgactcgcacagctngtgggcgcttcaggggagcctggtgaccgggtgcagtttacggaggtcatacagaagaacctcaccctgtacaggtccgcaaccacattcccgttgtcaaccgccgctgcccgcaactccaaacggggggagctcgccacagcccctcgaaaaaatccctacttgggccatggtaatccccggggttaacaaaaaggatggtgggccccccctgtaccaacacccaaaaatttggacccttgcacaaaaacaaaaagggcgtttttggaaacgaaccaaatttccgccgggtccaaaaggaaaaattaaccccccccgaaattaccgttaaaaaaaaggaaaaccccctttaaaagggcttatagg

SEQ ID NO: 14853 - DNA, 612 bp, Zea mays
  misc_feature: Ceres CLONE 1377009-F
  misc_feature (340)..(340): n is a, c, t, g, unknown, or other
cgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcgggccaggcagctgctacgcgtggacacggtcacacagtacggagtacacgcgacgtgacggtgactcgtgagacagaggcgcactgaggaaacctagcgacgggggggtggtacgggtgacattgtcccccctcggccccttccattccttgaaccaacggngggccggggtgggaggaaacccgccccctatttcaaaaaaaggggccaaccttttggtgggccttgggggagacttttcagcccaaaatcaagggcccaaaaattgggcgggaggggccctttaatattgggggccaccccaaaaccccttttaaaattaaggggggaaaccctttgggaaaaaaccccggaaccgcggggggcaaaaaaaaaggggggggcacattttcccccaatggggaattgcccccctggggggggggggagggggg

SEQ ID NO: 14854 - DNA, 897 bp, Zea mays
  misc_feature: Ceres CLONE 1377012-F
  misc_feature: Encodes the peptide sequence at SEQ ID NO. 14855
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (35)..(35): n is a, c, t, g, unknown, or other
  misc_feature (834)..(834): n is a, c, t, g, unknown, or other
  misc_feature (897)..(897): n is a, c, t, g, unknown, or other
nnnnnnnnnccccnnnnnccccccccttttgtttnatcacccagatctcgtctggtgctccaccgcggtggcggccgctctaaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagcagggctcttgcgggcggccgcacttgcgcctgcccgccccgcgcccgaacccgccgccgcggccccccccccccccacccccgctcccgcccccctccccgccgccgcgcttcgcgtggcaagcgtaatggttgagcaccaacccaccgcccgggagcccagcggggccgcctacaatcttcacaatatacactctcgcgccccccgcgagaacctgacgccccccgcatcgggcctcaccgcccccccgcgccacgcacccacatacaagcgttccggcgtcggcgtgcgcgcccgttcctcttctcccccaaatcatctaacgagccacgtctctcccaccacaccgctaaacaacacaccacccacgcaccaacgctccagaaccatcaacacacccttcgccggcccggagtctcgcccaggagacacccgccattgactcacttctgatcatcggacacacacaataccccccccagccccaacccccgcacccccccccgcaaccgcgaggcgcccggcgcgcggccccccgagcggtttgagggggcaagggaaacgggtggataaagggnagtagtgtttacgcatccaatcctcttctaactcccttgtccctcgccttgtcccgcccaccn

SEQ ID NO: 14855 - protein, 104 aa, Zea mays
  misc_feature: Ceres CLONE 1377012-F
MVEHQPTAREPSGAAYNLHNIHSRAPRENLTPPASGLTAPPRHAPTYKRSGVGVRARSSSPPNHLTSHVSPTTPLNNTPPTHQRSRTINTPFAGPESRPGDTRH

SEQ ID NO: 14856 - DNA, 728 bp, Zea mays
  misc_feature: Ceres CLONE 1377014-F
  misc_feature: Encodes the peptide sequence at SEQ ID NO. 14857
  misc_feature (552)..(552): n is a, c, t, g, unknown, or other
  misc_feature (622)..(622): n is a, c, t, g, unknown, or other
  misc_feature (623)..(623): n is a, c, t, g, unknown, or other
  misc_feature (728)..(728): n is a, c, t, g, unknown, or other
ggagctccccgcggtggcggccgctctagaactagtggatcccccgggctgcaggaattcgcacgagaccattacctagaacatcctaatcgaaaaaacacaaaacacatccatcctcgctagctcgctctctcttgcaactccagtgcttctcactgccactgccagcaggtcgagctgctccgcaagtctgctttgctgctgcacctgcaagtctgcaaccgcgcacagagatgtcgacgactgtgagccgtgcgtccctcgaccagaaactcgccctcgccaagcgctgctcccgagaggcgaccctcgccggagccaaggcggcagccgtggcgactatcgcctccgcgatccccaccctggccagcgtgcggatgctgccatgggccaaggccaacatcaaccccaccggccaggcgctcatcgtctccacggtggctgggatggcctacttcatcgcccgcgataagaagatcctgtcgctggcgaggcgccactcgttcgaccaagcccctgagcaccctcagaacacctccttccagggcaccngccgtccccacccgctttcttcaggccgtgagacgagactccgtcgagctagctagctacctgcctcttnncagtcgtcagtgcaaattaagcacaaatgtcgaccgatgcctctgaaataattaaactgcgagctagctagctgctgtacatcgatctgctagtatactacggcn

SEQ ID NO: 14857 - protein, 124 aa, Zea mays
  misc_feature: Ceres CLONE 1377014-F
  misc_feature (12)..(90): Pfam Name: ENOD93 Pfam Description: Early nodulin 93 ENOD93 protein
  misc_feature (107)..(107): Xaa is any aa, unknown, or other
MSTTVSRASLDQKLALAKRCSREATLAGAKAAAVATIASAIPTLASVRMLPWAKANINPTGQALIVSTVAGMAYFIARDKKILSLARRHSFDQAPEHPQNTSFQGTXRPHPLSSGRETRLRRAS

SEQ ID NO: 14858 - DNA, 678 bp, Zea mays
  misc_feature: Ceres CLONE 1377021-F
  misc_feature: Translation starting site: 426
tggagctccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctcccttggtgaaacgccccgctcgtttggcacggatcctcaagcccgtgccaacaccgtcgcagatgtacttctggttcaa

SEQ ID NO: 14859 - DNA, 676 bp, Zea mays
  misc_feature: Ceres CLONE 1377024-F
  misc_feature: Encodes the peptide sequence at SEQ ID NO. 14860
  misc_feature (287)..(287): n is a, c, t, g, unknown, or other
  misc_feature (293)..(293): n is a, c, t, g, unknown, or other
  misc_feature (615)..(615): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacnacgatnatgggcgccggcggcctgtacccctacgcggagtacctgaggcagccgcagtgcagcccgctggcggcggcgccctatctacgccgggtgtgggcagccgagcgccatgttccagccgctccggcaacagtgctgccagcagcatactgaggatgatgggacgtgcagtccgtctcgcagcagctgcagatgatgatgcatcttgagcgtgccgctgtcgtcagcagcagcctgtacgagccagctctgatgcagcagcagcagcagctgctggcagcccaggtctcaacccatggccatgatgatgggcaaaacatgcggnccatgggtggactctacagtacatgtgcccagtacgcancaaccctggtgtgtctcgctgc

SEQ ID NO: 14860 - protein, 92 aa, Zea mays
  misc_feature: Ceres CLONE 1377024-F
  misc_feature (43)..(43): Xaa is any aa, unknown, or other
MKMVIVLVVCLALSAASASAMQMPCPCAGLQGLYGAGAGLTTXMGAGGLYPYAEYLRQPQCSPLAAAPYLRRVWAAERHVPAAPATVLPAAY

SEQ ID NO: 14861 - DNA, 731 bp, Zea mays
  misc_feature: Ceres CLONE 1377025-F
  misc_feature: Encodes the peptide sequence at SEQ ID NO. 14862
  misc_feature (648)..(648): n is a, c, t, g, unknown, or other
aagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaaatgaaggagctgtcaagaaagcggaagagatacaagcaaagacacccaactcttacatccnttcacaatttgaaaatccagctaacccaaagattcactatgagactactggggcctgaatctgggaagctacagcaggaaaaa

SEQ ID NO: 14862 - protein, 166 aa, Zea mays
  misc_feature: Ceres CLONE 1377025-F
  misc_feature (12)..(167): Pfam Name: PALP Pfam Description: Pyridoxal-phosphate dependent enzyme
  misc_feature: SWISSPROT Homolog: EC 2.5.1.47 Cysteine synthase
  misc_feature (148)..(148): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGNEGAVKKAEEIQAKTPNSYIXSQFENPANPKIHYETTGA

SEQ ID NO: 14863 - DNA, 681 bp, Zea mays
  misc_feature: Ceres CLONE 1377028-F
  misc_feature: Encodes the peptide sequence at SEQ ID NO. 14864
  misc_feature (681)..(681): n is a, c, t, g, unknown, or other
tggagctccccgcggtggcggccgctctagaactagtggatcccccgggctgcaggaattcgcacgagaccattacctagaacatcctaatcgaaaaattcaaactagggtttactcctgccgctccgagaaagcaaacaagcgtcagctccgccggctgcctccgcgctttctccccgccgccgccgccgccgctccttccctacgccaggcacgccaagatgaagctcgtcaggttccttatgaagctgaacaatgagacggtcaccatcgagctcaagaacggcacggttgtacatggcaccatcaccggtgttgacataagcatgaacactcatctgaagacagtgaagcttacactgaaagggaggaggcgtgtaacacttgaccacctcagcgtgcgaggaaacaacatccgctactacatccttcctgacagcttaaacctggaaaccttgctggtagagggaaaccctagggtgaagcctaagaagccaactacaggaaagcctttggggcgtggtcgcggccgaggtcgtggacgtggtcgggggcgggggccacgctgagctttatcgttcccctgctggcggctccgtcccttgcaagaaaggtttcctctacaatggaaaacatctttcctctgcacgctgggggaaaagaatgttgcatccgtacccn

SEQ ID NO: 14864 - protein, 115 aa, Zea mays
  misc_feature: Ceres CLONE 1377028-F
  misc_feature (5)..(70): Pfam Name: LSM Pfam Description: LSM domain
MKLVRFLMKLNNETVTIELKNGTVVHGTITGVDISMNTHLKTVKLTLKGRRRVTLDHLSVRGNNIRYYILPDSLNLETLLVEGNPRVKPKKPTTGKPLGRGRGRGRGRGRGRGPR

SEQ ID NO: 14865 - DNA, 726 bp, Zea mays
  misc_feature: Ceres CLONE 1377032-F
  misc_feature: Translation starting site: 183
  misc_feature: SWISSPROT Homolog: EC 3.4.21.92 Endopeptidase Clp
  misc_feature (468)..(468): n is a, c, t, g, unknown, or other
  misc_feature (618)..(618): n is a, c, t, g, unknown, or other
  misc_feature (660)..(660): n is a, c, t, g, unknown, or other
  misc_feature (690)..(690): n is a, c, t, g, unknown, or other
  misc_feature (692)..(692): n is a, c, t, g, unknown, or other
  misc_feature (694)..(694): n is a, c, t, g, unknown, or other
  misc_feature (698)..(698): n is a, c, t, g, unknown, or other
tggagctccccgcggtggcggccgctctagaactagtggatcccccgggctgcaggaattcgcacgagaccattacctagaacatactaatcgaaaaatccgcactctgaccggtgctacctccaagctgagcccgctcccagactcccagtcccctccgcattccgcaccgccgcctcgccatggaggcagctgccgccgccttcttgtcccctccccgcgtcgccctcgacgcccgcacactcttctccccgccccgttgcctccccgtctcgccctcatcccagctccgccttgctgctcggccccgcgcgctcgccggcgccaagccgcggttcctgagcccccatcgagaacccgccgtcgacggcggtcgcggcgccagggatgtcgtcgcgatggtggtgccgttcctgaggggggccgcgtgggagcagccaccgccggacttgggctcattcctatacnagaaccggatcgtgtacttgggggatgtgccctcgtccgtcggtcacggagctcatgctcgcccgagttctctacctccagtatgacgacgccgagaaagccatctacatgtacatcaattccactggcacccacaagaatggcgagaangtaggctatgagacagaagctcttgcagatatgatgctatgnaggtatgtaaaagtcctaatttcactctgngngnccgnaatgcatgggggagagctgctttactct

SEQ ID NO: 14866 - DNA, 719 bp, Zea mays
  misc_feature: Ceres CLONE 1377033-F
  misc_feature: Encodes the peptide sequence at SEQ ID NO. 14867
  misc_feature (593)..(593): n is a, c, t, g, unknown, or other
  misc_feature (643)..(643): n is a, c, t, g, unknown, or other
  misc_feature (644)..(644): n is a, c, t, g, unknown, or other
  misc_feature (648)..(648): n is a, c, t, g, unknown, or other
  misc_feature (650)..(650): n is a, c, t, g, unknown, or other
  misc_feature (665)..(665): n is a, c, t, g, unknown, or other
  misc_feature (669)..(669): n is a, c, t, g, unknown, or other
  misc_feature (699)..(699): n is a, c, t, g, unknown, or other
tccccgcggtggcggccgctctagaactagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgcccgcagcatctccaccgctttgcgaggcgtcaggatctcccgtcgcagcgcccgcgcccgtcgcatcctcagctcgtcggcctccaccagcagccgcgacagcgcggccttgtagctgtccagcgccgcgtnccacctcgggcgtcgcggctcctagccgggcccgcctgaagcccgcgcgnngcgngncgtcgaagtttcggntggnagcagctgcagctcccaaccgtgccgcggnagcgagctcgcgctgccgaa

SEQ ID NO: 14867 - protein, 113 aa, Zea mays
  misc_feature: Ceres CLONE 1377033-F
MLLTSCRQGRGMASLSCARADGVVRSGALPAKLLLCASCCFPTAAPVADGEVQVLACPQHLHRFARRQDLPSQRPRPSHPQLVGLHQQPRQRGLVAVQRRVPPRASRLLAGPA

SEQ ID NO: 14868 - DNA, 717 bp, Zea mays
  misc_feature: Ceres CLONE 1377035-F
  misc_feature: Encodes the peptide sequence at SEQ ID NO. 14869
  misc_feature (656)..(656): n is a, c, t, g, unknown, or other
  misc_feature (666)..(666): n is a, c, t, g, unknown, or other
ggagctccccgcggtggcggccgctctagaactagtggatcccccgggctgcaggaattcgcacgagaccattacctagaacatcctaatcgaaaatccctttttcttttcagccgccacaccgcagctccggaaccgctgctgcccggcccattttaccaccgatccatggcggaggattcggcggcggcggccacgtggggcggcggcgacaagctcatcctgcgcggccttcagttccacggcttccatggcgtcctgcgggaggagaagacgctggggcagaagttcgtcgtcgacatcgacgcctggatggacctcgccgccgccggcgagtccgactgcatcgctgacaccgtcagctacaccgatatctacagcattgcaaaggatgttgtcgagggcacgccacgcaacctcttggagtcggtagcccactcgatcgcagaggccacgctgctcaagttccctcaggtctccgcagtccgggtgaaggttggcaagcctcacgtcgcggtgcgaggcgttctggactacctgggcgtggagataacgaggcacagaaagaagaatgagacgctgtacagtctgatcggagatgaacaattattgtacccacacccacactgccccgcataaccacatccacacttggntgcacttggncatcatggtttctcccttctcgacacacttgtggcatcacgttgattgaca

SEQ ID NO: 14869 - protein, 156 aa, Zea mays
  misc_feature: Ceres CLONE 1377035-F
  misc_feature (17)..(130): Pfam Name: FolB Pfam Description: Dihydroneopterin aldolase
  misc_feature: SWISSPROT Homolog: EC 4.1.2.25 Dihydroneopterin aldolase
MAEDSAAAATWGGGDKLILRGLQFHGFHGVLREEKTLGQKFVVDIDAWMDLAAAGESDCIADTVSYTDIYSIAKDVVEGTPRNLLESVAHSIAEATLLKFPQVSAVRVKVGKPHVAVRGVLDYLGVEITRHRKKNETLYSLIGDEQLLYPHPHCPA

SEQ ID NO: 14870 - DNA, 678 bp, Zea mays
  misc_feature: Ceres CLONE 1377038-F
  misc_feature (429)..(429): n is a, c, t, g, unknown, or other
  misc_feature (514)..(514): n is a, c, t, g, unknown, or other
  misc_feature (617)..(617): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcaacgaagaatggccggaattggcaggaacttggtggcgccgctcctggtgctcagcctcatcatgtacatcatcgtcatcggcttcgcgagctgaaccntgaaccacttcatcagcgggcagacaactaccccggcgtggccggcaacggcgcgacgttctacttcctggtgttcgcatcctgncggggcgtgtgggcgcggcgtccagcttggcggcgtgcaccacgtgcgcgcctgggccacgacagcctggccaccaacgcgcgtcgtcgctcatcgcctgggncatcacggcgctcgccttcggctgggctgcaaggagatcacatcggcggacacgcggctgg

SEQ ID NO: 14871 - DNA, 786 bp, Zea mays
  misc_feature: Ceres CLONE 1377040-F
  misc_feature (271)..(271): n is a, c, t, g, unknown, or other
  misc_feature (272)..(272): n is a, c, t, g, unknown, or other
  misc_feature (301)..(301): n is a, c, t, g, unknown, or other
  misc_feature (302)..(302): n is a, c, t, g, unknown, or other
  misc_feature (307)..(307): n is a, c, t, g, unknown, or other
  misc_feature (356)..(356): n is a, c, t, g, unknown, or other
  misc_feature (376)..(376): n is a, c, t, g, unknown, or other
  misc_feature (381)..(381): n is a, c, t, g, unknown, or other
  misc_feature (387)..(387): n is a, c, t, g, unknown, or other
  misc_feature (439)..(439): n is a, c, t, g, unknown, or other
tggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggnnagcgtccacgccgcccccgccgcctcggnngcggngccagcgcgcgcgacgccgcgctcaccgcctccgtgccagaacacggcngccaaggagcgaaggaggangaagnactccntggaggccgacccggacgccgacgacgcctgggcgggggcctgcaacaacancgggaagcggaaaggctgggcttgcagcgggccgtccaaggcccgggggggggtggtcccccggaggagaaggggttccccttccggaacgctttccgccggttttcggaggaaaaaacgtccgggtttggtaaagggccccttaacccttaaccaacaacctacctggaaggagcctaagggggggcgggggaatctggggtttccgggtttccattacccgcggaaacacccccgaggttgggggcgcgaagattgtggcggctccttgaaactctcgtgtttaatcctttggagcccagagtcttttcttgtgcaggcgcgccccccctcgcggcgtgtggggg

SEQ ID NO: 14872 - DNA, 699 bp, Zea mays
  misc_feature: Ceres CLONE 1377041-F
  misc_feature: Translation starting site: 461
  misc_feature (345)..(345): n is a, c, t, g, unknown, or other
  misc_feature (350)..(350): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (366)..(366): n is a, c, t, g, unknown, or other
  misc_feature (384)..(384): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (423)..(423): n is a, c, t, g, unknown, or other
  misc_feature (440)..(440): n is a, c, t, g, unknown, or other
  misc_feature (470)..(470): n is a, c, t, g, unknown, or other
  misc_feature (517)..(517): n is a, c, t, g, unknown, or other
  misc_feature (559)..(559): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccacccgcggtccacctggccngcgcnggtcacnnntgcacgncggtccatgtgcccgcgncggttcatctgcccgcgncnnacatgcactaccctactncaccgccccggcctcangctcatccccagccacacccatgcccgtgncaacagccgcatccaagccccgtgcagctgcagggaacctgcggcgntgccagcaccccgatccctgggcagtgcgtcaagtttctgangcatcagtgcagcccgacggggacgccctactgctcgccttcagtgcagtcgttgcggcagcagtgttgcagcaactcaggcagtggagccgccacaccggtaccaggcgatctttcggtgggcctccaagccatcctgc

SEQ ID NO: 14873 - DNA, 702 bp, Zea mays
  misc_feature: Ceres CLONE 1377043-F
  misc_feature: Encodes the peptide sequence at SEQ ID NO. 14874
tggagctccccgcggtggcggccgctctagaactagtggatcccccgggctgcaggaattcgcacgagaccattacctagaacatcctaatcgaaaagctccccttcgttcacctcgcgtacgcgacaaactaggccgaccgccgccgccctacgctcagctgcccacctgccctggtcttcgactcttcgtcgtgcgctttgccggcggcgagcacccatcacaccaggtgctttattgggtccgtccatacggcaggatggcgctaaggggggtctggcagctgcagaagctcgtggtaaactactgcgactggggagggagcagcaggggcatcagggccttcatggaggcacatcttccagcctttaaggagaagaatcacacttagaggtggtgacagagcttgtccgcggtccacatcctaactgggaggggaatttacaaaaaccataacgagggaggtggtatggcgtgagaatttaccggcagaggaaaatactccctgcaagccaccaggctaaggaactctctgggcaaggaaagtggtgaacctgccggaccagacatgtaacgaaacgcccccagggttcacggggacgtggaccaccgaaactgaaagattgtgaaacaaccaagccaaggtggtttccttggtcctttgggggggcctgattgcaaaaaaatggccagcttgggtcc

SEQ ID NO: 14874 - protein, 43 aa, Zea mays
  misc_feature: Ceres CLONE 1377043-F
MALRGVWQLQKLVVNYCDWGGSSRGIRAFMEAHLPAFKEKNHT

SEQ ID NO: 14875 - DNA, 728 bp, Zea mays
  misc_feature: Ceres CLONE 1377046-F
  misc_feature (276)..(276): n is a, c, t, g, unknown, or other
  misc_feature (395)..(395): n is a, c, t, g, unknown, or other
  misc_feature (406)..(406): n is a, c, t, g, unknown, or other
  misc_feature (503)..(503): n is a, c, t, g, unknown, or other
  misc_feature (504)..(504): n is a, c, t, g, unknown, or other
  misc_feature (514)..(514): n is a, c, t, g, unknown, or other
  misc_feature (515)..(515): n is a, c, t, g, unknown, or other
  misc_feature (519)..(519): n is a, c, t, g, unknown, or other
tccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcaaaacctatgtgtctgggtgacgccanttagtaaggatgacattaaggtcttcgccgcggtgccgtcgaagcctggcgctgagtttcctaatgccgcccgctggtacgagaccgtctctgcggctgtagcctcaagattccctggntagggctgtgntgtaaatctgcctgcgggatcagctcctgcggcagctgctcctgcggattgagctgaggatgatgatgaccttgatcttttttgtgatgaaactganngaagacaaanngcanctgatgagcgtgccgccgctgccaaggcctcttctaaaaagaaggaaggggaaaatcctccgtcctatggatggccaccctgggaccatgaaactgatttgaaaaaactgggaggagcttgcccccaatggccaaaaggaggggctgacttgggagaaatccaaacttggggcgtgttgaaaccggttcaaaaaatgactatcttgtta

SEQ ID NO: 14876 - DNA, 740 bp, Zea mays
  misc_feature: Ceres CLONE 1377047-F
  misc_feature: Encodes the peptide sequence at SEQ ID NO. 14877
  misc_feature (625)..(625): n is a, c, t, g, unknown, or other
  misc_feature (662)..(662): n is a, c, t, g, unknown, or other
  misc_feature (677)..(677): n is a, c, t, g, unknown, or other
  misc_feature (678)..(678): n is a, c, t, g, unknown, or other
ggagctccccgcggtggcggccgctctagaactagtggatcccccgggctgcaggaattcgcacgagaccattacctagaacatcctaatcgaaaaatcgcacatattatttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactattaccattcagccagctagctactgcctactctcagcaacaacaacttcttccatttaaccaanttggcgcactgaaccccgctgcttatttgcagcagcnaatactactaccatnntagcagctagctgcagcaaaccgtgcttccttcttgacacagcaacagttgctgcctttcta

SEQ ID NO: 14877 - protein, 174 aa, Zea mays
  misc_feature: Ceres CLONE 1377047-F
  misc_feature (1)..(176): Pfam Name: Zein Pfam Description: Zein seed storage protein
  misc_feature (158)..(158): Xaa is any aa, unknown, or other
  misc_feature (170)..(170): Xaa is any aa, unknown, or other
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLLPFSQLATAYSQQQQLLPFNQXGALNPAAYLQQXILLP

SEQ ID NO: 14878 - DNA, 720 bp, Zea mays
  misc_feature: Ceres CLONE 1377048-F
  misc_feature: Encodes the peptide sequence at SEQ ID NO. 14879
tccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtggaagcccgcgcgacgtccgtcgcctcgcagccgcagccggaggaggcctccttccgcggcttcggttactgcatgcagggctggtaccaccgctgcatcggtctcgacccctgaaccccgccgccacttgcttctttgatttgatttcatccggatcgttcggtgcccctcccgtcctggatctgatgcgcgagagcagcgtatcacgcgagattcgcccccttctctttctctaggaagcaggaagcaagccgaccgctcgctgagcgccgccgccgatgcccgtcgcggtgccgatgaagctctgcagggtggaaaccgcggaaagtgcgcgccgcggggccgacaaacccctgcgcgtcctggtgaacgggaccgtcctcgggagccgcgggccgttgcccttcatcgacctcgagggggacacgtcgccccgctcatccgcggg

SEQ ID NO: 14879 - protein, 56 aa, Zea mays
  misc_feature: Ceres CLONE 1377048-F
MPVAVPMKLCRVETAESARRGADKPLRVLVNGTVLGSRGPLPFIDLEGDTSPRSSA

SEQ ID NO: 14880 - DNA, 766 bp, Zea mays
  misc_feature: Ceres CLONE 1377051-F
  misc_feature: Encodes the peptide sequence at SEQ ID NO. 14881
  misc_feature (373)..(373): n is a, c, t, g, unknown, or other
  misc_feature (425)..(425): n is a, c, t, g, unknown, or other
  misc_feature (428)..(428): n is a, c, t, g, unknown, or other
  misc_feature (443)..(443): n is a, c, t, g, unknown, or other
  misc_feature (478)..(478): n is a, c, t, g, unknown, or other
  misc_feature (517)..(517): n is a, c, t, g, unknown, or other
tccccgcggtggcggccgctctagaactagtggatcccccgggctgcaggaattcgcacgagaccattacctagaacatcctaatccaaaaagcctcgcttcccaaaccctagctcctcgctctcccgcccgcgtggcctgccaggcaaccacccccagatcaactccgtacagcgtgcctccgcctcccggactccagcggcggcgggatgtggtctcactccaaggacttgctcgagatcgagcccctcgagctccgattcccattcgagacaaagaagcagatctcgtgctctatgcagttgacaaaccgaacagatgactacatcggctttaaaggtaagacgacgagcccgaagaagtactgtgtccnggccaacagcggcatcgtgccaccctcggtccacagcgatgtcattgtgacnatngacagcacaaaggangcgccacaaaacatgcaggggcaggacaagttccntggggcaaaggtgcctttggggcggaaaggaactttaanccaaggacatccctgggggatttgtttaccaaaaaaccccctatgggggggggtggaggtaaaactgaaagggtttttaaatccccccaccccaaaccaccatccccgggggttgggaaaattgaaaaaaggctttccccccgcaccttctgtgggccggggaattaattgtgaattataaaaaaaaccacgggaatttgtgggggccccggtgtttccccggtgggagaacccctattaaacaaaagg

SEQ ID NO: 14881 - protein, 162 aa, Zea mays
  misc_feature: Ceres CLONE 1377051-F
  misc_feature (8)..(107): Pfam Name: Motile_Sperm Pfam Description: MSP (Major sperm protein) domain
  misc_feature (55)..(55): Xaa is any aa, unknown, or other
  misc_feature (73)..(73): Xaa is any aa, unknown, or other
  misc_feature (78)..(78): Xaa is any aa, unknown, or other
  misc_feature (90)..(90): Xaa is any aa, unknown, or other
  misc_feature (103)..(103): Xaa is any aa, unknown, or other
MWSHSKDLLEIEPLELRFPFETKKQISCSMQLTNRTDDYIGFKGKTTSPKKYCVXANSGIVPPSVHSDVIVTXDSTKXAPQNMQGQDKFXGAKVPLGRKGTLXQGHPWGICLPKNPLWGGVEVKLKGFLNPPTPNHHPRGLGKLKKGFPPAPSVGRGINCEL

SEQ ID NO: 14882 - DNA, 712 bp, Zea mays
  misc_feature: Ceres CLONE 1377052-F
  misc_feature: Encodes the peptide sequence at SEQ ID NO. 14883
  misc_feature (320)..(320): n is a, c, t, g, unknown, or other
  misc_feature (323)..(323): n is a, c, t, g, unknown, or other
  misc_feature (486)..(486): n is a, c, t, g, unknown, or other
tccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgancgncgcgacctttcggcggtcgatgctggtgctgtcccggctgatcctggccggcaccgtgatcgcgctcacgtgggcacccccgtgctggtgatcttcagccggtgctggtgccggccgcatcgcgcttgggctcatggggggccgggtccgcaacctcgggggnctcggggtccctgcgttggcccgggtctcctggatggacaagaacctgacgggaaagaccccggcgggggccgaccagttggacccccccaagggggaggtgggggtccaaaggccccggaactttagggatggaagaacaggccccgatttcaccagggggggagggggttctttaaaaaaaaaaaccccccttcgaggggacccggggggggggcccccctttg

SEQ ID NO: 14883 - protein, 75 aa, Zea mays
  misc_feature: Ceres CLONE 1377052-F
  misc_feature (45)..(45): Xaa is any aa, unknown, or other
  misc_feature (46)..(46): Xaa is any aa, unknown, or other
MADHHRGATGGGGGYGDLQRGGGMHGEAQQQQKQGAMMTALKAAXXATFRRSMLVLSRLILAGTVIALTWAPPCW

SEQ ID NO: 14884 - DNA, 734 bp, Zea mays
  misc_feature: Ceres CLONE 1377053-F
  misc_feature: Encodes the peptide sequence at SEQ ID NO. 14885
  misc_feature (500)..(500): n is a, c, t, g, unknown, or other
  misc_feature (562)..(562): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctagaacatcctaatcgaaaaaatagcatctgcctacctgcactggactcaaaaacatgcctgccgtaggatcctgtgatgtgtccattcgcgtgttgagtcggcggcttgtgaaggcatccgacccctccctccagccgcacgtcgtcaccttctcaaacctagatctctacccggacaacgtgcaggcctccatagtgtgcctctaccccaagctgtcaacaaagtccggcccgggcggcggcttcgacgccgtcgtctccaccttcgaggccgtcctgccgaccttgcttaaccacttctaccctctcgccggtcgcattgtcgtcaacccaagctccggcgtccccgagctccactgccacaaccagggcgcggagctcgtggtgggagaggtcggcgtcgccctgggcagcctggattancgtcttgccgaggagtccctgaaagagatcatgatgccgtaccctgaggacgtcacgctctncgtgcagctgctgtccttcgcgtgcggcggcttctccgtcgtgtggggcaacaaacacctcccctcacgacgcnacgccatcaccatgtgcgtcaggatgtggtccgagctggcacgggcccgcggagcatcgccacccgtgggaagcgtgtcagtgaacacgaccgctcga

SEQ ID NO: 14885 - protein, 201 aa, Zea mays
  misc_feature: Ceres CLONE 1377053-F
  misc_feature: SWISSPROT Homolog: EC 2.3.1.160 Vinorine synthase
  misc_feature (123)..(123): Xaa is any aa, unknown, or other
  misc_feature (144)..(144): Xaa is any aa, unknown, or other
  misc_feature (169)..(169): Xaa is any aa, unknown, or other
MPAVGSCDVSIRVLSRRLVKASDPSLQPHVVTFSNLDLYPDNVQASIVCLYPKLSTKSGPGGGFDAVVSTFEAVLPTLLNHFYPLAGRIVVNPSSGVPELHCHNQGAELVVGEVGVALGSLDXRLAEESLKEIMMPYPEDVTLXVQLLSFACGGFSVVWGNKHLPSRRXAITMCVRMWSELARARGASPPVGSVSVNTTAR

SEQ ID NO: 14886 - DNA, 724 bp, Zea mays
  misc_feature: Ceres CLONE 1377057-F
  misc_feature: Encodes the peptide sequence at SEQ ID NO. 14887
  misc_feature (420)..(420): n is a, c, t, g, unknown, or other
  misc_feature (474)..(474): n is a, c, t, g, unknown, or other
  misc_feature (522)..(522): n is a, c, t, g, unknown, or other
  misc_feature (523)..(523): n is a, c, t, g, unknown, or other
  misc_feature (533)..(533): n is a, c, t, g, unknown, or other
  misc_feature (544)..(544): n is a, c, t, g, unknown, or other
  misc_feature (606)..(606): n is a, c, t, g, unknown, or other
tccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcnaatacttgccaggtataaagcttggaacgaatggtatttgcgaccctgacttgnagagcgcagtcaaagacgcgaatatgctggttttttgtgacgccccanntcatttgtgnagggtatatgntagaagcttgtagggaagctaacacccagagctggagctatctccctcatccagggcatggnagtcaagatggaaaggcccgtgcatgatatccaaggtaatcgcggatacacttggaatcaattggctgggggctcatgggtgctaacatgcaaacgaaattgccgccaaaaattcagg

SEQ ID NO: 14887 - protein, 113 aa, Zea mays
  misc_feature: Ceres CLONE 1377057-F
  misc_feature (10)..(114): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (69)..(69): Xaa is any aa, unknown, or other
  misc_feature (87)..(87): Xaa is any aa, unknown, or other
  misc_feature (103)..(103): Xaa is any aa, unknown, or other
  misc_feature (106)..(106): Xaa is any aa, unknown, or other
  misc_feature (110)..(110): Xaa is any aa, unknown, or other
MEMENGHAKYRVAVIGSGNWGSVASRLIASNTAKLPSFYDEVRMWVFEEILPTGRKLSESINEQNENCXYLPGIKLGTNGICDPDLXSAVKDANMLVFCDAPXHLXRVYXRSL

SEQ ID NO: 14888 - DNA, 711 bp, Zea mays
  misc_feature: Ceres CLONE 1377062-F
  misc_feature: Encodes the peptide sequence at SEQ ID NO. 14889
  misc_feature (186)..(186): n is a, c, t, g, unknown, or other
  misc_feature (188)..(188): n is a, c, t, g, unknown, or other
  misc_feature (204)..(204): n is a, c, t, g, unknown, or other
  misc_feature (205)..(205): n is a, c, t, g, unknown, or other
  misc_feature (299)..(299): n is a, c, t, g, unknown, or other
  misc_feature (693)..(693): n is a, c, t, g, unknown, or other
  misc_feature (694)..(694): n is a, c, t, g, unknown, or other
tccccgcggtggcggccgctctagaactagtggatcccccgggctgcaggaattcgcacgagaccattacctagaacatcctaatcgaaaaaaacagtcacacaccgctgcttcaagaaaccaccgagagcccaagcgcgcaaggcaggagagagagagagagcagggagagaagcgtggggcggngnaagcaaagatggaggnnaaggaggaggacgtgcgcctgggcgccaacaagttctcggagcggcagcccatcggcacggcggcgcagggcgccggggccggggacgacgacnaggactacaaggagcccccgccggcgccgctgttcgagcccggggagctcaagtcctggtccttctaccgcgcgggcatcgccgagttcgtcgccaccttcctcttcctctacatcaccgtcctcaccgtcatgggcgtctccaagtccacctccaagtgcgccaccgtcggcatccagggcatcgcctggtccttcggaggcatgatcttcgcgctcgtctactgcacccgcggcatctccggaggacacatcaacccagctgtgaccttcgggctgttctttgccaggaagctgtccctgactagggccatcttctacattatcatgcaatgcctggggtgcatctgtggagctggagtggtgaagggctttcagcaggggctttacatggnncaacggcggtggcgcca

SEQ ID NO: 14889 - protein, 171 aa, Zea mays
  misc_feature: Ceres CLONE 1377062-F
  misc_feature (50)..(171): Pfam Name: MIP Pfam Description: Major intrinsic protein
  misc_feature (3)..(3): Xaa is any aa, unknown, or other
  misc_feature (35)..(35): Xaa is any aa, unknown, or other
  misc_feature (166)..(166): Xaa is any aa, unknown, or other
MEXKEEDVRLGANKFSERQPIGTAAQGAGAGDDDXDYKEPPPAPLFEPGELKSWSFYRAGIAEFVATFLFLYITVLTVMGVSKSTSKCATVGIQGIAWSFGGMIFALVYCTRGISGGHINPAVTFGLFFARKLSLTRAIFYIIMQCLGCICGAGVVKGFQQGLYMXQRRWR

SEQ ID NO: 14890 - DNA, 713 bp, Zea mays
  misc_feature: Ceres CLONE 1377064-F
  misc_feature: Encodes the peptide sequence at SEQ ID NO. 14891
ggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaaattgtgttgaaggctatgggacaggctataagcaaggcagtggctattgctgagatcataaaggaagaggattcctgggtttgcatcaaaaaaaataatcagttctgtcaaaaatactgatgtatgcaaaccctttgaggaaggacttggaccattggaaaagactcggcatgtttcaaggaaatcaatttccttggcccccaaaggagaaaacaaaaattcccctgggaataagctccccaacttcggatcttaaccaaaaaaaattctgcaccca

SEQ ID NO: 14891 - protein, 65 aa, Zea mays
  misc_feature: Ceres CLONE 1377064-F
MDRYQRVEKPPPEAAAIGENEIRITTQGLVRNYVTYATSLVQEKQVKENCVEGYGTGYKQGSGYC

SEQ ID NO: 14892 - DNA, 610 bp, Zea mays
  misc_feature: Ceres CLONE 1377068-F
  misc_feature: Encodes the peptide sequence at SEQ ID NO. 14893
  misc_feature (151)..(151): n is a, c, t, g, unknown, or other
  misc_feature (351)..(351): n is a, c, t, g, unknown, or other
  misc_feature (353)..(353): n is a, c, t, g, unknown, or other
ccccgcggtggcggccgctctagaatagtggatcccccgggctgcaggaattcgcacgagacattacctagaacatcctaatcgaaaaaaaatcctccacaccctggactggagtggctgctgctcgtggccggcgatgagcggcggcggncccggaggtgcgtgcgggccggactcccgcgtggagacatctcccggtggcgcagtgccgcatcgataccttcggcccctgctcctaccggcggtcggacccctttaagctcggcatctggaactggtacctgtcggtgggagagagccgctccatgcgtgtgcgcctcttcccggaggcgggccgggtgggcaaggagnancccccctctcgggggtttctgggtcgggtctcctggggcggccggccgggacggtcctggggctcccctgggcacaagcatttttttgggtaacagggatgatttttgaatgcaaggccatggaatggcccagggggggtttacagtgggggtgggtttctaacccgggggaaaccccaacaatggttccgaaaccgcttgggggggggcaaaccaaggggggggggaaaaaatcccagaaaaaaggccctggggtt

SEQ ID NO: 14893 - protein, 46 aa, Zea mays
  misc_feature: Ceres CLONE 1377068-F
  misc_feature (16)..(16): Xaa is any aa, unknown, or other
MRVRLFPEAGRVGKEXPPSRGFLGRVSWGGRPGRSWGSPGHKHFFG

SEQ ID NO: 14894 - DNA, 668 bp, Zea mays
  misc_feature: Ceres CLONE 1377071-F
  misc_feature: Translation starting site: 134
tccccgcggtggcggccgctctagaactagtggatcccccgggctgcaggaattcgcacgagaccattacctagaacatcctaatcgaaaacatttccaggatttactagctgggtttaccatagcccgtaggatgtcgagcgatctccactcggcatcggacgtgatcgccggtcgccgcctcctctccaggctgcagcacctgagcgccagcttcatgagcttctcggcctgcacctccggccagggcccggcggacgcgtccagcacgctgtgcacggggtccatcttcaccggctcgcgcggctgctccgcgacgttgagatccagcagccccgtgagcatctgcagaatcaccatggccgaagcggacacgtccgactccgttgggagctcgccggtcttgaagaccacggggtcatgtaccccggcgggcccatcgggtttcgggcgggggccgatggtcctctccctccaggggtttcaggtgaccggcccgggcccgtcccaaagtctcccggccggttccgggttgcggggtccaaggaggatggtggtccaccttccccctccgggggaataaatggctgggggcccccctgggaaggggagaaaccccagggcgaaaagccccctccccccgggatatctggaggcgggcccttcca

SEQ ID NO: 14895 - DNA, 675 bp, Zea mays
  misc_feature: Ceres CLONE 1377072-F
  misc_feature: Encodes the peptide sequence at SEQ ID NO. 14896
  misc_feature (409)..(409): n is a, c, t, g, unknown, or other
tcaccgcggtggcggccgctctagaactagtggatcccccgggctgcaggaattcgcacgagaccattacctagaacatcctaatcgaaaagacatcacagatcacacacactcgagaactccatttcgatctcatttgaaatcaacccatcctcgtttcctccgtctagcagcctctcaccctcatggccaagatcaagatcgggatcaatgggtttggcaggatcggaaggctggtggccagggtgggcctgcagagcgacgacgtcgagctcgtcgccgtgaacgaccccttcatcagcaccgattacatgacctacatgttcaagtatgacactgtgcacggacagtggaagcaccatgaggtcgagggggagggactccaagaccctttctctttggtgagaangagggttgctgtgtttggctgcaggaaccctgaggagatcccatggggttcgggtggcggtgaatatgttgttgagtctactggtggtttcactgacccaggagagggtgcagctcacttggagggtggtgccaagaaggttgtcttttctggtccaagcaaggatgccccatgttcgttgttggtgccaacgagaagaggacaagtctgacatcacattgtctctaaggttagtggacaaccactggcttgctccggttggtagg

SEQ ID NO: 14896 - protein, 144 aa, Zea mays
  misc_feature: Ceres CLONE 1377072-F
  misc_feature (4)..(140): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (75)..(75): Xaa is any aa, unknown, or other
MAKIKIGINGFGRIGRLVARVGLQSDDVELVAVNDPFISTDYMTYMFKYDTVHGQWKHHEVEGEGLQDPFSLVRXRVAVFGCRNPEEIPWGSGGGEYVVESTGGFTDPGEGAAHLEGGAKKVVFSGPSKDAPCSLLVPTRRGQV

SEQ ID NO: 14897 - DNA, 654 bp, Zea mays
  misc_feature: Ceres CLONE 1377074-F
  misc_feature (444)..(444): n is a, c, t, g, unknown, or other
tccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattctttcaccctacaggatccaacaggcaatcacagctggcatcttacctttatcaccctggtgcctcagacatcatcagccctattacatcagttacctttggtgcatttattggcacaaacatcagggcacaacactacnacaacttgtgctagaaaccttggctgctactctcagcaacaggagttccttccattcacccactagctgcatggaactctgcttcttatttgcaccaacaacactaacattcagccagctacctggtggctacccccagaaattctttccatcaacccactggcagcatgaactctcctgcttatttaccggagcacaactactaccttt

SEQ ID NO: 14898 - DNA, 659 bp, Zea mays
  misc_feature: Ceres CLONE 1377075-F
  misc_feature: Encodes the peptide sequence at SEQ ID NO. 14899
tccccgcggtggcggccgctctagaactagtggatcccccgggctgcaggaattcgcacgagaccattacctagaacatcctaatcgaaaagaaaactaggaaccccactccccctcccgaaactaccgccgccgccgctgccgccgcgatccaggtctcccgcggtcccgccccgcctgagctctcgacctcttcactcctcgccgccgctgctcgccctcccgcgtatcctcgtctcagctctcaggttttcagcctgatcaaaccggtgtaaccagccgtgcatgactgcattggttcggctcgccggaagagcagcttcgcggagcagggtcggcatagcggcggcggcggcaccctctccctgtcgcttgtccgtgcagcgccggagggcgttccagggcgtgagaatggagacggggggcagcaagggcggccgtggcgctctggtggtcctggaaggctggaccggagcgggaaacttcgcagtgtgccggctgctgtccttctcaaaggcaaaggctacatgccgaaggatggaggtccccgataggcccacaggtggggggagatgatatctgctaccctcgctacgatcgcagcttgatgacaggacgattcatctgctcttcagcgcaacggtggggagaaagagctt

SEQ ID NO: 14899 - protein, 96 aa, Zea mays
  misc_feature: Ceres CLONE 1377075-F
MTALVRLAGRAASRSRVGIAAAAAPSPCRLSVQRRRAFQGVRMETGGSKGGRGALVVLEGWTGAGNFAVCRLLSFSKAKATCRRMEVPDRPTGGGR

SEQ ID NO: 14900 - DNA, 661 bp, Zea mays
  misc_feature: Ceres CLONE 1377076-F
  misc_feature: Encodes the peptide sequence at SEQ ID NO. 14901
  misc_feature (282)..(282): n is a, c, t, g, unknown, or other
  misc_feature (283)..(283): n is a, c, t, g, unknown, or other
  misc_feature (291)..(291): n is a, c, t, g, unknown, or other
  misc_feature (385)..(385): n is a, c, t, g, unknown, or other
  misc_feature (422)..(422): n is a, c, t, g, unknown, or other
  misc_feature (423)..(423): n is a, c, t, g, unknown, or other
  misc_feature (426)..(426): n is a, c, t, g, unknown, or other
  misc_feature (427)..(427): n is a, c, t, g, unknown, or other
aagctggagctccccgcggtggcggccgctctagaatagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtanncaccacgncccgggcggaggacggagtggtcaaacgggacgcaagaggacctgcgggtgtgcaacaagcctgccactggcaggacgaaaggacacccggcgnaagaggaatggccaaacgagtgccgccaacgggacannaanntgacgcgggcgagacgggaacggcgggggggaccctacctctcccgcttcgggaaggggcgagtgccgccccagtgcctgcgccgcaccaaggcccacccgggaaaacccagagtgattgaggggggcccgccccccggactgggcctcaattggagaaaaaaaacgtcccggaaccaaaacgccggaaattgccggaaaagtggcaacgccaccccccggggatgggggagag

SEQ ID NO: 14901 - protein, 111 aa, Zea mays
  misc_feature: Ceres CLONE 1377076-F
  misc_feature (24)..(24): Xaa is any aa, unknown, or other
  misc_feature (27)..(27): Xaa is any aa, unknown, or other
  misc_feature (58)..(58): Xaa is any aa, unknown, or other
  misc_feature (70)..(70): Xaa is any aa, unknown, or other
  misc_feature (71)..(71): Xaa is any aa, unknown, or other
  misc_feature (72)..(72): Xaa is any aa, unknown, or other
MGKGSVGASWWAFLLLAGVLLVVXTTXRAEDGVVKRDARGPAGVQQACHWQDERTPGXRGMAKRVPPTGXXXDAGETGTAGGTLPLPLREGASAAPVPAPHQGPPGKTQSD

SEQ ID NO: 14902 - DNA, 676 bp, Zea mays
  misc_feature: Ceres CLONE 1377078-F
  misc_feature: Translation starting site: 144
  misc_feature (384)..(384): n is a, c, t, g, unknown, or other
  misc_feature (478)..(478): n is a, c, t, g, unknown, or other
  misc_feature (564)..(564): n is a, c, t, g, unknown, or other
  misc_feature (610)..(610): n is a, c, t, g, unknown, or other
tccccgcggtggcggccgctctagaatagtggatcccccgggctgcaggaattcgcacgagaccattatctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgcccccgtgagcaggcgaagcagcacatgtgcacgttcgcgctgtacgcgcacgacccgaaagcggagggtggagacgcaccactacgtctcccgcctncaccaggacttccctcagtgcgccgtctatgactccgacaaagccgacgcgcgtctcatcggcgtggagtacatcgtgtcgagaaagatcttcnactcgctgcccgcggaggagcagcggctgtggcactcgcacgcgcacgagatcaagtcaggcctgggggaccagcccgccacgtgncggggctgctggaagaagggggacctggaccacatgggccgccacntttcggaagtttctggtgccacctgggaggtgggaccgcggcgaccggcctgccggttggcgcccc

SEQ ID NO: 14903 - DNA, 672 bp, Zea mays
  misc_feature: Ceres CLONE 1377081-F
  misc_feature: Pfam Name: NADPH_Ox Pfam Description: Respiratory burst NADPH oxidase
  misc_feature (278)..(278): n is a, c, t, g, unknown, or other
  misc_feature (377)..(377): n is a, c, t, g, unknown, or other
  misc_feature (439)..(439): n is a, c, t, g, unknown, or other
  misc_feature (457)..(457): n is a, c, t, g, unknown, or other
  misc_feature (458)..(458): n is a, c, t, g, unknown, or other
  misc_feature (672)..(672): n is a, c, t, g, unknown, or other
tccccgcggtggcggccgctctagaatagtggatcccccgggctgcaggaattcgcacgagaccattacctagaacatcctaatcgaaaaaatccggccgtccgcgttcttatccaccctaattaaaaatgacaaaaccaatacatttattgaaagaaaatagacgagtctcatagtagccggctaagagtggcgtaatggtgggcatggtagcggggtggtatacatggtcgaagagatctggaggcggaatcgaagctggtgtccgtgatctgctngcagatctcgcgcagctcctccttgttaattttgtcacctgcacctgacggcggcgggctcatgtgtcaaacagctcgagcgcgaactctttcgatccngtcatccctgcacgtgtacatgcagctccccaatgtttcaacgacgaagggaaatgggaganaaagccgaggggaggcanncgcgcgtggtggaaccatgcattcggcgaagtcggagcgggagaggaaaccctcggaagcgaggcggtcgaaagtggcctgcacctccatcccagcgtttgttggccttgttgctgctgaagaaacggagggccgcgaacgcctttgggcccgccggagcgcgtgcggtcaaagtgccgccctttccgcccgcggggggggggcaaccgaggcn

SEQ ID NO: 14904 - DNA, 653 bp, Zea mays
  misc_feature: Ceres CLONE 1377083-F
  misc_feature: Translation starting site: 179
  misc_feature: SWISSPROT Homolog: EC 1.1.1.1 Alcohol dehydrogenase
  misc_feature (260)..(260): n is a, c, t, g, unknown, or other
  misc_feature (398)..(398): n is a, c, t, g, unknown, or other
gctctagaactagtggatcccccgggctgcaggaattcgcacgagaccattacctagaacatcctaatcgaaaaaggtcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtgnaggtagcgcctcccgcagccatggaggtgcgcgtcaagatcctcttcacctcgctctgccacacggacgtctacttctgggagggccagactcccgtgttccctcggatcttttgccacgaggctggaggtatcatanagaatgtgggagagggtgtgactgacgtagctccgggcgacatgtccttcctggtgtcactggggagtgcaaggagtgggcccactgcaagtcggcagagagcaacatgggtgatctgctcaggatcaacaccgacggcggtgtgatgatggccgatgggcagtcgcggttttcaatcagtgggaggctatctaccactttgttgggacttccccttcagcgagtaacccgtcttgcatgggggttgtgttgcaa

SEQ ID NO: 14905 - DNA, 676 bp, Zea mays
  misc_feature: Ceres CLONE 1377089-F
  misc_feature: Encodes the peptide sequence at SEQ ID NO. 14906
  misc_feature (295)..(295): n is a, c, t, g, unknown, or other
  misc_feature (303)..(303): n is a, c, t, g, unknown, or other
  misc_feature (318)..(318): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (390)..(390): n is a, c, t, g, unknown, or other
  misc_feature (474)..(474): n is a, c, t, g, unknown, or other
  misc_feature (613)..(613): n is a, c, t, g, unknown, or other
tccccgcggtggcggccgctctagaactagtggatcccccgggctgcaggaattccacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacgnagtggtcnaacgggaccgcaggnaggaccctgcgtgnnntgcagcagcgtgcgagtggcagtacggaaaggacaccccgcggaagagggaatgcnagagcgagtggcgcgagcggcacagcaagctgacgcgggcgaggacggcgacagcggcgtggacgcctacgtctcccgctccgnaaggggcgagtgccggcgccagtgcctgcgccgccacgagggccagcccgtggagacccaggagtgcatgagggcgtgccgccgccgcggactgggcgtcaacatggagcagagtacggtcgcggagccgagagccggncaggggccgggagaggtggagcgccccaccgcggggactggtgggaaagcacgctgcggtgca

SEQ ID NO: 14906 - protein, 114 aa, Zea mays
  misc_feature: Ceres CLONE 1377089-F
  misc_feature (32)..(32): Xaa is any aa, unknown, or other
  misc_feature (35)..(35): Xaa is any aa, unknown, or other
  misc_feature (40)..(40): Xaa is any aa, unknown, or other
  misc_feature (44)..(44): Xaa is any aa, unknown, or other
  misc_feature (45)..(45): Xaa is any aa, unknown, or other
  misc_feature (64)..(64): Xaa is any aa, unknown, or other
  misc_feature (92)..(92): Xaa is any aa, unknown, or other
MGKGSVGASWWAFLLLAGVLLVVAATAGAEDXVVXRDRRXDPAXXAAACEWQYGKDTPRKRECXSEWRERHSKLTRARTATAAWTPTSPAPXGASAGASACAATRASPWRPRSA

SEQ ID NO: 14907 - DNA, 686 bp, Zea mays
  misc_feature: Ceres CLONE 1377090-F
  misc_feature: Encodes the peptide sequence at SEQ ID NO. 14908
  misc_feature (271)..(271): n is a, c, t, g, unknown, or other
  misc_feature (320)..(320): n is a, c, t, g, unknown, or other
  misc_feature (321)..(321): n is a, c, t, g, unknown, or other
  misc_feature (422)..(422): n is a, c, t, g, unknown, or other
tccccgcggtggcggccgctctagaactagtggatcccccgggctgcaggaattcgcacgagaccattacctagaacattctaatcgaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctcagcgcgggggcggcatgcacggcgaggcgcancagcagcagaagcagggcgccatgatgacggcgctcagggccgcgacgnncgcgacctttcgcgggtcgatgctggtgctgtccgggctgatcctggccggcaccgtgatcgcgctcacggtggccacccccgtgctgtatctcgcggggntttgggggggcgcgccccccatcccgggggggctcatggggggcggggttcttcccctccgggggcctcggggtccttggcctgtccgggtttccccgggagggacaaggacctggaggggaaagcaccccccgggggcccaaccagttgggaccaagcaggggggagggtggggggcccagggcccgggaatttaggggagggggaacaggaccggtttgagccagggggagggggtttttgaaaaaaaaaaccccctccggg

SEQ ID NO: 14908 - protein, 121 aa, Zea mays
  misc_feature: Ceres CLONE 1377090-F
  misc_feature (6)..(6): Xaa is any aa, unknown, or other
  misc_feature (23)..(23): Xaa is any aa, unknown, or other
  misc_feature (57)..(57): Xaa is any aa, unknown, or other
MHGEAXQQQKQGAMMTALRAATXATFRGSMLVLSGLILAGTVIALTVATPVLYLAGXWGGAPPIPGGLMGGGVLPLRGPRGPWPVRVSPGGTRTWRGKHPPGAQPVGTKQGGGWGAQGPGI

SEQ ID NO: 14909 - DNA, 709 bp, Zea mays
  misc_feature: Ceres CLONE 1377091-F
  misc_feature: Encodes the peptide sequence at SEQ ID NO. 14910
  misc_feature (214)..(214): n is a, c, t, g, unknown, or other
  misc_feature (303)..(303): n is a, c, t, g, unknown, or other
  misc_feature (304)..(304): n is a, c, t, g, unknown, or other
  misc_feature (324)..(324): n is a, c, t, g, unknown, or other
ggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgnaatcacacgcgcgccacccgcgatgacgccggcggcggcgatctccggctccagcagccacgtcgtcgtctcctccgccccgctcaggnnagcgttcacgctccctccgngcaccggttgcccaatcggccgcgccgcctcggccgtgacccgccgcggggtcgcgggtcgccgcgtgtcaagccccgttgggtccgcccgccgcggggaagatgccaaacaggctcctaaggatttccttcaaatcattgattttgacaaggatacaataatgaagattcttaatcgaaccctcgagggtaaagggattgaaaaaggctggaaaaaaagaccttccaaccggttcaaagggaaaaacatggcccatgattttttgccaggccatcgagggggggccccggggttcattttggaaaggggaattcttttttaattggggggggagggtatttttatttggggcgccagaaggataacccagaggggggaaagggg

SEQ ID NO: 14910 - protein, 136 aa, Zea mays
  misc_feature: Ceres CLONE 1377091-F
  misc_feature: SWISSPROT Homolog: EC 2.1.3.3 Ornithine carbamoyltransferase
  misc_feature (23)..(23): Xaa is any aa, unknown, or other
  misc_feature (30)..(30): Xaa is any aa, unknown, or other
MTPAAAISGSSSHVVVSSAPLRXAFTLPPXTGCPIGRAASAVTRRGVAGRRVSSPVGSARRGEDAKQAPKDFLQIIDFDKDTIMKILNRTLEGKGIEKGWKKRPSNRFKGKNMAHDFLPGHRGGAPGFILERGILF

SEQ ID NO: 14911 - DNA, 670 bp, Zea mays
  misc_feature: Ceres CLONE 1377094-F
  misc_feature (439)..(439): n is a, c, t, g, unknown, or other
  misc_feature (442)..(442): n is a, c, t, g, unknown, or other
  misc_feature (577)..(577): n is a, c, t, g, unknown, or other
  misc_feature (585)..(585): n is a, c, t, g, unknown, or other
  misc_feature (597)..(597): n is a, c, t, g, unknown, or other
tccccgcggtggcggccgctctagaactagtggatcccccgggctgcaggaattcgcacgagaccattacctagaacatcctaatcgaaaaatatgagtcgttgcctcgcagtttatatccctactgtttcggactttcgggttttggccgacacccgacaatcttaacatcaaactcgtcgtccacgcctcctcggcaaggttgcgtacggcgtggccctaaggcataccagcgggatcaagctattttgctgggcaaccgaacggtcaagccgacgatgacgctcggatcggcggcacacaagatccccgctggaggttgcgcacaccctcgtcgagatcgccgagggtcgcgcgctacgcctaaacacaccgccccggccgccctgcaacccacgagggggacccgactgcgcccgccgcaggggctgatagcagncgnggcaccaacgaagatgccgcgcggctgctggaggaaaaacgcatgctccgcgccagactcgcagatgacctcgcgctcctgcgtgagctccacggcgcgccctgcgtctccaggagtgccctcctgatctatacnaccgattngatggcggcggncacaatggtagcttccttgctcatctcgagaaatacaggatgagtcagcacgtcaactaaatgactaactgct

SEQ ID NO: 14912 - DNA, 678 bp, Zea mays
  misc_feature: Ceres CLONE 1377100-F
  misc_feature: Encodes the peptide sequence at SEQ ID NO. 14913
  misc_feature (367)..(367): n is a, c, t, g, unknown, or other
  misc_feature (482)..(482): n is a, c, t, g, unknown, or other
  misc_feature (629)..(629): n is a, c, t, g, unknown, or other
tccccgcggtggcggccgctctagaactagtggatcccccgggctgcaggaattcgcacgagaccattacctagaacatcctaatcgaaaatctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccgcgggctgtaccctacgcggagtacctgaggcagccgcagtgcagcccgctggcggcgccgccctactacgncgggtgtgggcagccgagcgccatgttccagccgctcgggcaacagtgctgccagcagcagatgaggatgatggacgtgcagtccgtcgcgcaacagctgcagatgatgatgcancttgagcgtgccgctgccgccagcagcagcctgtacgagccagctctgatgcagcagcagcagcagctgctggcaccccagggtctcaacccccatgggcatgatgatggcgcaaaaccatgccggccatggggtggactctaccantaccaggtggcccagttaccgcaccaaacccctggtggcgtcttccgtt

SEQ ID NO: 14913 - protein, 96 aa, Zea mays
  misc_feature: Ceres CLONE 1377100-F
  misc_feature (31)..(31): Xaa is any aa, unknown, or other
  misc_feature (80)..(80): Xaa is any aa, unknown, or other
MFQPLGQQCCQQQMRMMDVQSVAQQLQMMMXLERAAAASSSLYEPALMQQQQQLLAPQGLNPHGHDDGAKPCRPWGGLYXYQVAQLPHQTPGGVFR

SEQ ID NO: 14914 - DNA, 686 bp, Zea mays
  misc_feature: Ceres CLONE 1377101-F
  misc_feature (248)..(248): n is a, c, t, g, unknown, or other
  misc_feature (271)..(271): n is a, c, t, g, unknown, or other
  misc_feature (274)..(274): n is a, c, t, g, unknown, or other
  misc_feature (277)..(277): n is a, c, t, g, unknown, or other
  misc_feature (303)..(303): n is a, c, t, g, unknown, or other
  misc_feature (304)..(304): n is a, c, t, g, unknown, or other
  misc_feature (406)..(406): n is a, c, t, g, unknown, or other
  misc_feature (430)..(430): n is a, c, t, g, unknown, or other
  misc_feature (431)..(431): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (460)..(460): n is a, c, t, g, unknown, or other
  misc_feature (461)..(461): n is a, c, t, g, unknown, or other
  misc_feature (465)..(465): n is a, c, t, g, unknown, or other
tccccgcggtggcggccgctctagaactagtggatcccccgggctgcaggaattcgcacgagaccattacctagaacatcctaatcgaaaaactactagtgatcagaccagtgagctagcgactgtaccatgcagcagctgtaggagagcctggtggtaggtaggataggagtagcgccagcccgcaagtgcgcgtcccggctggctgcttcgacgagcagggaggagccgcaccgcccggctcccgnaaatgtcgctcctccgcccccgncgntgntgcgcaacgagctgtcgcgcaggacnngcgtgctgggcctgcgcctgtgggtgctggtgggcatcgccgtcggggccgccttcgtgctgctcctcgtggtcatctccctccacctcgccgcggcgcggnggaagcggccccaggagggggtcnngcacccacggccgnnncccgggggggggnncccnccccttgcccccgtccaccattccgcccggtggccagggaaatccaggggggtggccggtccacgtcggtcggctccgccactaacctcgagacggggcacgcggtccttcaagggacggggggggcaacggggaagggaaaagttggagtcccgggggcccacgggtcccaaaccgctccacaatccaaggtttgggaagggccagcggcattgggcccg

SEQ ID NO: 14915 - DNA, 696 bp, Zea mays
  misc_feature: Ceres CLONE 1377102-F
  misc_feature: Encodes the peptide sequence at SEQ ID NO. 14916
  misc_feature (217)..(217): n is a, c, t, g, unknown, or other
  misc_feature (275)..(275): n is a, c, t, g, unknown, or other
  misc_feature (314)..(314): n is a, c, t, g, unknown, or other
  misc_feature (389)..(389): n is a, c, t, g, unknown, or other
  misc_feature (434)..(434): n is a, c, t, g, unknown, or other
  misc_feature (435)..(435): n is a, c, t, g, unknown, or other
  misc_feature (644)..(644): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcgncatctacggcggcgcccacgccacctacgggcagcagcagcagcagggaggagggcgncgcccgatgggtgagcaggtgaagggcatgctccacgancaggggccgacggcgtcccaggcgctgacggtggcgaccctgttccccctgggcgggctgctgctggtgctgtcngggctgcccctgacggcctcggggggggggctggcccgtggcacnnccgggtttctgatcttccagcccctggtggtcccgcccgggtgctcatcgggacggccgggtatggggtcccttcaggtcggggggcttgggggttcgggggccttgtccttccctacagggcctccccaaacggggggggaaggggttccaagccccccccggaaaaagggaaggaggccccccccagagatggggggaggcgccggnacaaccggggaccaaaaaacacgcggggggggggccggccttcccggggggg

SEQ ID NO: 14916 - protein, 167 aa, Zea mays
  misc_feature: Ceres CLONE 1377102-F
  misc_feature (44)..(164): Pfam Name: Oleosin Pfam Description: Oleosin
  misc_feature (8)..(8): Xaa is any aa, unknown, or other
  misc_feature (40)..(40): Xaa is any aa, unknown, or other
  misc_feature (81)..(81): Xaa is any aa, unknown, or other
MADRDRSXIYGGAHATYGQQQQQGGGRRPMGEQVKGMLHXQGPTASQALTVATLFPLGGLLLVLSGLPLTASGGGLARGTXGFLIFQPLVVPPGCSSGRPGMGSLQVGGLGGSGALSFPTGPPQTGGEGVPSPPRKKGRRPPPEMGGGAGTTGDQKTRGGGAGLPGG

SEQ ID NO: 14917 - DNA, 622 bp, Zea mays
  misc_feature: Ceres CLONE 1377106-F
  misc_feature (405)..(405): n is a, c, t, g, unknown, or other
  misc_feature (530)..(530): n is a, c, t, g, unknown, or other
  misc_feature (531)..(531): n is a, c, t, g, unknown, or other
  misc_feature (533)..(533): n is a, c, t, g, unknown, or other
tggagctccccgcggtggcggccgctctagaactagtggatcccccgggctgcaggaattcgcacgagaccattacctagaacatcctaatcgaaaaatctctctcttctcctcgcctcgccttggtgttcacgccgtcgctagcgcctgccgcggcgaagcttctgccctccccggcgccaggctcgggtcgtcgtcggccaggcagctgctacgcgtgacacggtcacacagtacggcagtacacgcgacgtgaacggtgactcgtgaagacagagccgcactgaggaaccctagcgacggcgcgtgctaccgtgacattgtccccctcgcccctccatcctgagcagcgcccccagctgcagggagcagcccctatcagacaggtcgatcttgctgcctgcnagcttcaccgatcaggtcagcatggcggcggccaataataaacaaacaaaccctccaataatggaaacttggaaaacccggaccggcggcaacaggggggcatttcccattgcaattcccttttnntnttaagggtgggaggcccgggggcaaccaaaatggcaaaaagggggccctttaagcccccaaaagaaagggggtgcccccctttttaaac

SEQ ID NO: 14918 - DNA, 728 bp, Zea mays
  misc_feature: Ceres CLONE 1377107-F
  misc_feature (509)..(509): n is a, c, t, g, unknown, or other
ctagaactggtggatcccccgggctgcaggaattcgcacgagaccattacctagaacatcttaatcgaaaagcgaggtcgaaatccccaaggcgaggggttgaaacccttaaccctcttccacctcgaagcggcgcgaggagggagagtgtgagtggactcaggaggcggcgggcgaaatgaagcttaacgtcaagaccctcaggggcacccaacttcgagatcgaggcgagccccgatgcgtcggttgctgaggtgaaaggatcatcgaaactactcagggtcagagtacctacccagcagaccagcaaatgctcatataccaaggggaaaatttctgaaggatgagacgccttttggaaagcgacgggaggttgctggacaacaagcttcccttggtataatggctgtccaagggttagggcatcggtcgagtgggaggcttccaccgggtactggctggaaaaagctccctggaaactccaggcccaaccctgggtgccccctggncacatcaggttggtaaggaaacacgctaccccaggcttcctggttggcccccgggtggaaaacggccaccctcccagggggggacaggaactccagggcttgcctccgagcctggcctacgggctggctggcattcggaatggatgggctgatgggggaaacaggtgccgggcgacgtttcaaaaccccttggaatcccgggggaacacaccctaggag

SEQ ID NO: 14919 - DNA, 723 bp, Zea mays
  misc_feature: Ceres CLONE 1377108-F
  misc_feature: Encodes the peptide sequence at SEQ ID NO. 14920
  misc_feature (265)..(265): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacgggcgcgcccacgccacctacgggcagcancagcagcagggaggaagcgggcgcccgatgggtgaccaggtgaagggcatgctccacgacaaggggccgacggcgtcccaggcgctgacgggggggaccctggtccccctggggggggctgctgctggtgctgtccggggttgggcctaacgccctcccgggggggggttgggcctggccaccccggtgtttcttgattttcagccccggtgttcgtcccccgccgggcttggtcatcgggaagggccggcaatgggggttcctccacctcggggggcgctttgggtgttcgggggccctgtccctcctttcacggtggcccccgcaaaaaagggggggggggaagggggttccaagggcccccccccgaattaaggggggaggaagggccccccccacggaatggcgggaaggccccccggcgcaaccccggggcccaaaagaaaccggccgagggg

SEQ ID NO: 14920 - protein, 69 aa, Zea mays
  misc_feature: Ceres CLONE 1377108-F
  misc_feature (20)..(20): Xaa is any aa, unknown, or other
MADRDRSGIYGRAHATYGQXQQQGGSGRPMGDQVKGMLHDKGPTASQALTGGTLVPLGGAAAGAVRGWA

SEQ ID NO: 14921 - DNA, 675 bp, Zea mays
  misc_feature: Ceres CLONE 1377110-F
  misc_feature: Encodes the peptide sequence at SEQ ID NO. 14922
  misc_feature (344)..(344): n is a, c, t, g, unknown, or other
  misc_feature (363)..(363): n is a, c, t, g, unknown, or other
  misc_feature (410)..(410): n is a, c, t, g, unknown, or other
  misc_feature (411)..(411): n is a, c, t, g, unknown, or other
  misc_feature (434)..(434): n is a, c, t, g, unknown, or other
  misc_feature (494)..(494): n is a, c, t, g, unknown, or other
  misc_feature (528)..(528): n is a, c, t, g, unknown, or other
  misc_feature (529)..(529): n is a, c, t, g, unknown, or other
  misc_feature (536)..(536): n is a, c, t, g, unknown, or other
  misc_feature (537)..(537): n is a, c, t, g, unknown, or other
aagctggagctccccgcggtggcggccgctctagaactagtggatcccccgggctgcaggaattcgcacgagaccattacctagaacatcctaatcgaaaaaatcccagatccacccctccccatctccatccgcggccatggcctccgccgacgccggcacttgcccgtgggatgccctcccgttgcacctccaggagcgaatcctctccctcctccccatcaccgaactacttcccgttgccgccgtgtcccgcgccttccaccgccttctgcgctccccgaccttccatgccctcctctccccgcatcgcctcgacgccttcttcctcctttccccacggntcgccgtccacccgctgtnccgccgcgtccgcactatgcccgcgttcgccgcgctctctcctcttnnctaccgctcgtctcctccccgtncccatcactccttagtcactgcgcctcactccagttcccctccgcgatccccgacggagnctacctccctatcgctatcgtcccatcgcgcggnntcctcanncctctgcacccttgtcgccgtcatcaccggcgcaggcgcgcgttcttacaccctgaacaccggcgatccctccccggagggggcgtctagaggcgatctcccgctgtctctcacgctcctggaaaacgcgcggtctcc

SEQ ID NO: 14922 - protein, 178 aa, Zea mays
  misc_feature: Ceres CLONE 1377110-F
  misc_feature (9)..(56): Pfam Name: F-box Pfam Description: F-box domain
  misc_feature (69)..(69): Xaa is any aa, unknown, or other
  misc_feature (75)..(75): Xaa is any aa, unknown, or other
  misc_feature (91)..(91): Xaa is any aa, unknown, or other
  misc_feature (99)..(99): Xaa is any aa, unknown, or other
  misc_feature (119)..(119): Xaa is any aa, unknown, or other
  misc_feature (130)..(130): Xaa is any aa, unknown, or other
  misc_feature (133)..(133): Xaa is any aa, unknown, or other
MASADAGTCPWDALPLHLQERILSLLPITELLPVAAVSRAFHRLLRSPTFHALLSPHRLDAFFLLSPRXAVHPLXRRVRTMPAFAALSPLXYRSSPPRXHHSLVTAPHSSSPPRSPTEXTSLSLSSHRAXSSXLCTLVAVITGAGARSYTLNTGDPSPEGASRGDLPLSLTLLENARS

SEQ ID NO: 14923 - DNA, 663 bp, Zea mays
  misc_feature: Ceres CLONE 1377111-F
  misc_feature: Translation starting site: 157
  misc_feature (259)..(259): n is a, c, t, g, unknown, or other
tccccgcggtggcggccgctctagaactagtggatcccccgggctgcaggaattcgcacgagaccattacctagaacatcctaatcgaaaaagaaaaagaagatcaaggaggtttctcacgagtggtcattgatcaacaagcagaagcccatctggatgaggaagccagaagagatcacaaaggaagaatatgctgccttctacaaaagcttgacaaatgactgggaggagcatctggctgtgaagcacttctctgtgnagggtcagctggagttcaagggtgttctctttgtccctaagaggggccccatttgatctcttcgacacaaggaagaagcaaaacaccatcaagctctatgtgcgcagggtgtttatcatggacaactgtgaggaactgatccctgagtggctgagtttttgtaggggtattgttgactctgaggacttccccctcatatctcccgtgagactcttcagcagaaacagatcctgaaggggatccggaagaaccttgggaaagaggggggtggagctcctcctttgagattgctgaaaacaaggaggactacaaccaggttttatgaggttttctccaaaaaacctcaggtttggcatccatggaggactccccagaccaggggccaagaatggctggagctttcg

SEQ ID NO: 14924 - DNA, 905 bp, Zea mays
  misc_feature: Ceres CLONE 1377112-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
nnnnnnnnnnnnnnnnnnnnnnaaaacccgttnntntttgcttgccccccaaacaatggggctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaggagagagagagacatagactcggactcggaaagaaggagatgatggccgagggaagcgcagggaagggggctgctcttcaggagaagctgaaaatccctcggctccatcactccctccccacggtctggagcgaagaggtcggataaatcatggaacgccgcccggggggaggggggaggggaggtttgaaagcagaaagggggggcttgaaggccttgaacccaagggaggaattcgggggtggggctgcaaggaacccccccctgtaaaaaccccaaaagggtatttctttctttatattcccccaggggggggggaccggtgggaaatacccccctaagcgggggggtgggggggggggcgcccgggcggggtcccgggggcgagaaaccgtgggtgttctcgcggaaaaatggagagggttggcccccggtggggccgtggcctccgccccccacgggtggggtgggaagaggccctcttcggacaaagacggtgggggccttttagggggggtgtcccaagggcgccgcccggggtggtgtggtggggggcaacacccctttccccgccctaagaggaggccgtgggggaggaaaaaacaaaatccgggggggggaaacgggggggccgaca

SEQ ID NO: 14925 - DNA, 643 bp, Zea mays
  misc_feature: Ceres CLONE 1377114-F
  misc_feature: SWISSPROT Homolog: EC 5.3.1.1 Triose-phosphate isomerase
  misc_feature (327)..(327): n is a, c, t, g, unknown, or other
  misc_feature (353)..(353): n is a, c, t, g, unknown, or other
  misc_feature (643)..(643): n is a, c, t, g, unknown, or other
ggagctccccgcggtggcggccgctctagaactagtggatcccccgggctgcaggaattcgcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttctttcgtcgggtgccaactggaaatggcatgggaccacagatcaggtcgagaagatggtcaaaaccctgaatgaaggacaggttccccccttcagatggtgtgggaggtcgtgccanccctccttatgtctccctcctggggncagaaccacctgccccaggagttccatggtgccgctcaaaactggtgggttaaaaggggagggcgttcccccgggaagtcagggtgaaaatctccccaaccttgtgggtccctggggatttttgggacctttaaaggggaggtcttgttgagaaaacaaaaagaaatttttttggaaaaaaggggcggaataccccctcccccagaaaaaaggggttttgggggggggtggaaaaaactttagaagaggggggggggggccaccccaggggggggtttggtgcaaaaaan

SEQ ID NO: 14926 - DNA, 650 bp, Zea mays
  misc_feature: Ceres CLONE 1377120-F
  misc_feature: Encodes the peptide sequence at SEQ ID NO. 14927
tccccgcggtggcggccgctctagaatagtggatcccccgggctgcaggaattcgcacgagaccattacctagaacatcctaatcggaaagaacgcccagtcctagtctgatctaatgggaatgtacggaatctcgtctcccatctcgcacttgagttgagactactgttgtgactattgtgtgcgtgagagagaaacagaagaggaaagggatccatggcggcgacgctggcgaggagggcggggcgctccgcggcgacgacgctatggggcgcggcgaggggcttcgcatcgggtggggtcgacatcgtctctgcggctcccggcgtgtcgctgcagaaggcgcggtcctgggacgagggcgtcgccaccaagttctctaccacgcctctcagggacatctctacgggaagaaggtggtcatcttcggctggcccgtgcatatacaggggtttggtcacagcgcacgtcctagttacaagagaatattgacaggttgaagcaaaggatcgactctgttatcttgggagctgggaatgatcgtatgtcctgatggatgggcaaaaactaaacctaagatacattgagttcatgggggctttgaggggagttccccacaagttggatttgagaaaaacctttcgggagtt

SEQ ID NO: 14927 - protein, 91 aa, Zea mays
  misc_feature: Ceres CLONE 1377120-F
  misc_feature: SWISSPROT Homolog: EC 1.11.1.15 Peroxiredoxin
MAATLARRAGRSAATTLWGAARGFASGGVDIVSAAPGVSLQKARSWDEGVATKFSTTPLRDISTGRRWSSSAGPCIYRGLVTAHVLVTREY

SEQ ID NO: 14928 - DNA, 651 bp, Zea mays
  misc_feature: Ceres CLONE 1377122-F
  misc_feature (360)..(360): n is a, c, t, g, unknown, or other
  misc_feature (370)..(370): n is a, c, t, g, unknown, or other
tggcggccgctctagaactagtggatcccccgggctgcaggaattcgcacgagaccattacctagaacatcctaatcgaaaaaaaaggttcaactcagagaggagagaactagagaaagatccccacccccaggcgacgcgaccggcgagccccgaaaccctaggtcgcgcgacccgggcagcgcgcttctgcgtgactgcgtgtctttcggggaggggacagcgttaggacgcgacgaggttagcgaggccgtctggccgactataagcggaagaatctcctccgaagcttcctagagctgtgaagagcgcgtggatctcctggatttgcagactcgaggggagctgaaacaagatggntgtgtttgtngaaggggtgccttcttcagtggaccactgggcacagtgaccccgcgatcatagattgcacgtgggagctgccaaaagctcgactatcctaacatgcaatttgggcattgctactgggggacggaggctcctcaccatcaaaaatgattctggcgggcaatggcctggaaaaaaggtccacaaaaagcctggctattgcctgggcctagggcatgggaaaaggccggggagaagggcccttttttggccaattaggtcccctaaaaatgggaacccgcgcaa

SEQ ID NO: 14929 - DNA, 722 bp, Zea mays
  misc_feature: Ceres CLONE 1377127-F
  misc_feature: Encodes the peptide sequence at SEQ ID NO. 14930
  misc_feature (390)..(390): n is a, c, t, g, unknown, or other
  misc_feature (595)..(595): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctggcggtgggtgcaagcaggcgtgcgagtgccaatacgaaaaggacaccccgcgaanaaggaatgccaaagccagtggccccagcggcaccaacaagcttgacgcggcgaagaccgcgaccggggcgtggaccgctacctctcccgctccgggaagggcgagtggccggcgcaatgcctgcgccggcacgagggccagccgtgggagacccaggagtgcttgaagcggtgccccccgccgcggactggccgtcgaatggaancaagagtaccgtccgggagccagaagcgcggcaaatggcccggaagaggtgcgagcgccaccccgcggggaaatgggtgggagaagcaccgctgctgtgtgaaaaaaaannnnngcggggggggggg

SEQ ID NO: 14930 - protein, 171 aa, Zea mays
  misc_feature: Ceres CLONE 1377127-F
  misc_feature (61)..(61): Xaa is any aa, unknown, or other
  misc_feature (129)..(129): Xaa is any aa, unknown, or other
  misc_feature (166)..(166): Xaa is any aa, unknown, or other
  misc_feature (167)..(167): Xaa is any aa, unknown, or other
MGKGSVGASWWAFLLLAGVLLVVAATAGAEDGVVERDRKEDLAVGASRRASANTKRTPREXGMPKPVAPAAPTSLTRRRPRPGRGPLPLPLREGRVAGAMPAPARGPAVGDPGVLEAVPPAADWPSNGXKSTVREPEARQMARKRCERHPAGKWVGEAPLLCEKKXXRGGG

SEQ ID NO: 14931 - DNA, 721 bp, Zea mays
  misc_feature: Ceres CLONE 1377130-F
  misc_feature: Encodes the peptide sequence at SEQ ID NO. 14932
  misc_feature (302)..(302): n is a, c, t, g, unknown, or other
  misc_feature (303)..(303): n is a, c, t, g, unknown, or other
  misc_feature (441)..(441): n is a, c, t, g, unknown, or other
  misc_feature (497)..(497): n is a, c, t, g, unknown, or other
  misc_feature (669)..(669): n is a, c, t, g, unknown, or other
tccccgcggtggcggccgctctagaactagtggatcccccgggctgcaggaattcgcacgagaccattacctagaacatcctaatcgaaaacttcccttctgtcgctgctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacannaaacagtacaatacacccaaatacagatttgttgtgcgatttacccaacaggacatcacagcacaaatcatctctgctagtatagcaggggatatgggtcttgcttctgcttactcgcatgagttgccacgatatggntcttgaaagtggtctgaccaactatgcagctgcctactgcactggccttctgttgncctcgccgtgtgctcaaaaacccgtggtttagataaggaatatgaaggcattgttggagccacttgtgaagatttctctgttgaccagctgatgagagaagcctttccgtgctctccttggatgttgccctattaagatacgactgggaaccgtgtctttgtgccctcaggnagctttgggatgtggcctgatattctcaacgcgagaagggggttgctgtttt

SEQ ID NO: 14932 - protein, 89 aa, Zea mays
  misc_feature: Ceres CLONE 1377130-F
  misc_feature (27)..(90): Pfam Name: Ribosomal_L18p Pfam Description: Ribosomal L18p/L5e family
  misc_feature (42)..(42): Xaa is any aa, unknown, or other
MGGFVKTHKSNAYFKRFQVKFKRRRAGKTDYRARIRLINQDXKQYNTPKYRFVVRFTQQDITAQIISASIAGDMGLASAYSHELPRYGS

SEQ ID NO: 14933 - DNA, 710 bp, Zea mays
  misc_feature: Ceres CLONE 1377133-F
  misc_feature: Encodes the peptide sequence at SEQ ID NO. 14934
  misc_feature (459)..(459): n is a, c, t, g, unknown, or other
  misc_feature (552)..(552): n is a, c, t, g, unknown, or other
  misc_feature (600)..(600): n is a, c, t, g, unknown, or other
aagctggagctccccgcggtggcggccgctctagaactagtggatcccccgggctgcaggaattcgcacgagaccattacctagaacatcctaatcgaaaactgctccatttgtcctccaactatttcgccgcaaaggcctctagaagcaatcaggcgagcggcggctgcggcgcgatgggagagcaggtcgtgacggagcgtatccagcggaagctggaggaggccaacgctaccgtccaacagcacctcgccggcatccaggaccacgtcaacttcaccatgcagcaagcatacttcaagtgcgcatatgattgcttcgatcggcgccgtactcaggaagcgatcaacaattgtgtggagaattgtggtatgcctgtccttgctgtcaacatggtttttgagagtgagatgggccagtttcagggacggggtgacccggtcattgatggtctgtcangataagtttgaagctgccagctccagaagatgaaacagatggcactcaggaactggaatcctgtgtcacagatctatcgatgacagcatcggncccctccatatgtggtgcagcagatgaagtccaccctcatatcattanaggcatattaccttagcatatgaccaatataggttgaaatgttcatatcccattcaagcataagctacctttcaggggaaaccctaaactatgaagctctacgaatcgtt

SEQ ID NO: 14934 - protein, 94 aa, Zea mays
  misc_feature: Ceres CLONE 1377133-F
  misc_feature (10)..(93): Pfam Name: DUF842 Pfam Description: Eukaryotic protein of unknown function (DUF842)
MGEQVVTERIQRKLEEANATVQQHLAGIQDHVNFTMQQAYFKCAYDCFDRRRTQEAINNCVENCGMPVLAVNMVFESEMGQFQGRGDPVIDGLS

SEQ ID NO: 14935 - DNA, 691 bp, Zea mays
  misc_feature: Ceres CLONE 1377134-F
  misc_feature: Translation starting site: 156
  misc_feature: SWISSPROT Homolog: EC 1.2.1.12 Glyceraldehyde-3-phosphate dehydrogenase (phosphorylating)
  misc_feature (270)..(270): n is a, c, t, g, unknown, or other
ggcggccgctctagaactagtggatcccccgggctgcaggaattcgcacgagaccattacctagaacatcctaatcgaaaaatatccgctcccctacctctccagcatctcccgtctccgtcgtctcgtctctgctcctcacctcgccgccagccatgggcaagatcaagatcggaatcaacggtttcggaaggatcggcaggctcgtgggccaggtcgccctgcagagcgaggatgtcgagctcgtcgccgtcaacgaccccttcatcnacacggattacatgacctacatgggtcagtacgacaccgtgcacggccaatggaagcacagcgacatcacccctcaggactcccagacgcttctcttcggcgagagccggtcaccgtctttggcatcaggaacccccgagagatcccgtggggtgaggctggtgctgaatatgtcgtggagtccaccggtgtcttcactgacaaggacaggctgctgcacatctgaagggtggtgcaagaaggttgttatctctgccccagcaagatgcaccatgtttggttgtgtggcatggagacagtacccctcgatgtaacattgttccatggtagctgcacacaactggctggtccccttgctaaggcatcatgacacttgggattatgagggctgatgacaatgtcatgcatactgcaccaaaaa

SEQ ID NO: 14936 - DNA, 695 bp, Zea mays
  misc_feature: Ceres CLONE 1377135-F
  misc_feature (270)..(270): n is a, c, t, g, unknown, or other
  misc_feature (292)..(292): n is a, c, t, g, unknown, or other
  misc_feature (303)..(303): n is a, c, t, g, unknown, or other
  misc_feature (310)..(310): n is a, c, t, g, unknown, or other
tccccgcggtggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcntgctgcgcggcgtgcgcgtgcnaagcgtgccgnacggcgntcggaagcatcgggcgccgctccgcccgcatcgcctactgcggcctcttcgcgctctccctcttcgcatcctgggcgctccgcgaggtcgccgcgccccctctccagtcgatcccatggattaaccactccacaagacccccgaccgcgagtggttcgagaccgacgcggtgctcagggtcagcctcgggaacttcctcttcttcaccatcttcggcgttatcatggccgggattaaggaccagaaagacccccggtgaaaggatccaccacgggggagggatggccaagatcttcctgctgggcatcatcggcttccctctgttcttcgggccaaagggggcggcagctttatgaacctatatccaagttgggtccggctggtc

SEQ ID NO: 14937 - DNA, 657 bp, Zea mays
  misc_feature: Ceres CLONE 1377136-F
  misc_feature: Encodes the peptide sequence at SEQ ID NO. 14938
  misc_feature (258)..(258): n is a, c, t, g, unknown, or other
  misc_feature (291)..(291): n is a, c, t, g, unknown, or other
  misc_feature (379)..(379): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (537)..(537): n is a, c, t, g, unknown, or other
  misc_feature (538)..(538): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
cgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctccctgatactgctcangaaagtacgtatgtacattatataatgcattgnttgcttgctttgtttgtttattcatgcatgcacgtgtcatatatagttggcagcacatacacaaatggcagctagctgctaactgagncatgcaaaccttcttattgcattgcatgtcgatcagctggaggagaccacgaggtgtggtcgtcgtcatcctcgccggccggtgttcgtggtggcggcgccgtcctcctcccgacggcgcggatggggcgacgcgnnnnnnnnggggggggggggggnnaaaaagnnnttttttttttacccaaaaaagccccaacccctctggcccgggggttcccgggctaccccgggaagattatcaacgtctggggcggagggtgcaccttgtaccacctgccc

SEQ ID NO: 14938 - protein, 65 aa, Zea mays
  misc_feature: Ceres CLONE 1377136-F
  misc_feature (30)..(30): Xaa is any aa, unknown, or other
  misc_feature (41)..(41): Xaa is any aa, unknown, or other
MGEWCFKKRAALVIIVAIISSLQLLPDTAXESTYVHYIMHXLLALFVYSCMHVSYIVGSTYTNGS

SEQ ID NO: 14939 - DNA, 619 bp, Zea mays
  misc_feature: Ceres CLONE 1377137-F
  misc_feature: Encodes the peptide sequence at SEQ ID NO. 14940
  misc_feature (401)..(401): n is a, c, t, g, unknown, or other
  misc_feature (402)..(402): n is a, c, t, g, unknown, or other
  misc_feature (412)..(412): n is a, c, t, g, unknown, or other
  misc_feature (552)..(552): n is a, c, t, g, unknown, or other
tccccgcggtggcggccgctctagaactagtggatcccccgggctgcaggaattcgcacgagaccattacctagaacatcctaatcgaaaaacattaacgcgcatctgttaattaaacaccaccgacaaaactccaaggtgccatataatctcaagtcaaatccagtctcgattccagttttgtttccactgcagtcccagctcaaatctcgaatctttgtaagaagcccagatctactcgtatggcgaagcacacggcggcgttgaaagccggactgactttgctggcgctgagcatgatcggttacatactcggtcctcctctctactggcacctcaccgaggcactggtcgcttccgcctcttcttgctctccttgcgtctgcgactgctcttccctnngctctctcancatcccccaaggactcagcaatgggatcttttgagattgtgcaaagcatgaccccagagtgaacgaggacacagagaagaactatgctgagctcttaacagagaactgaggcacgcgaagcagcatcgatggagaacacnaacgagtagacactggtctgctcgaggcaagaagatcacatcctcttacgaaaaggaggcggataat

SEQ ID NO: 14940 - protein, 67 aa, Zea mays
  misc_feature: Ceres CLONE 1377137-F
  misc_feature (1)..(68): Pfam Name: DUF1068 Pfam Description: Protein of unknown function (DUF1068)
  misc_feature (54)..(54): Xaa is any aa, unknown, or other
  misc_feature (57)..(57): Xaa is any aa, unknown, or other
MAKHTAALKAGLTLLALSMIGYILGPPLYWHLTEALVASASSCSPCVCDCSSLXSLXIPQGLSNGIF

SEQ ID NO: 14941 - DNA, 705 bp, Zea mays
  misc_feature: Ceres CLONE 1377137-R
  misc_feature: Pfam Name: DUF1068 Pfam Description: Protein of unknown function (DUF1068)
  misc_feature (1)..(1): n is a, c, t, g, unknown, or other
  misc_feature (329)..(329): n is a, c, t, g, unknown, or other
  misc_feature (367)..(367): n is a, c, t, g, unknown, or other
  misc_feature (549)..(549): n is a, c, t, g, unknown, or other
  misc_feature (609)..(609): n is a, c, t, g, unknown, or other
  misc_feature (610)..(610): n is a, c, t, g, unknown, or other
  misc_feature (614)..(614): n is a, c, t, g, unknown, or other
  misc_feature (615)..(615): n is a, c, t, g, unknown, or other
  misc_feature (636)..(636): n is a, c, t, g, unknown, or other
  misc_feature (639)..(639): n is a, c, t, g, unknown, or other
  misc_feature (640)..(640): n is a, c, t, g, unknown, or other
  misc_feature (650)..(650): n is a, c, t, g, unknown, or other
  misc_feature (705)..(705): n is a, c, t, g, unknown, or other
ncgattgggtaccgggccccccctcgaggtcgacggtatcgataagcttttttttttttttttttctttttttgttcaaaaatccattaatacattgttgttttcgtacaatgtttcattcaatctgatccatcacagaactacaagacaatattataaatcaaaatcacagacacatggaacacagtaattttctttcgtgtgacataaaaataacttaggtgtgccactaagaagcctgaacactgcttttggatttaacagaagacttggtggctccctctttccatcctttttgacgagctctgagttcccacatagaagtcagncttcttctgctccacagtgcccttttccgaactctctnctgcttccctcacagtctccataccggagttgcacttatccgcctcccttttgtaagaagatgtgatctttctggcctcgagcagacagtgtctactcgtttgtgttctccatcgatgctgctttcgcgtgcttcaggtcctctgttaagagctcagcataagtcttctctgtgtcttccgntcacctcctgggtcatgctttgcacaatctccaaaaagatccattgctgagtcccttggnngatnngtgagaagaagcaggaaaaancanntcccaaacgncaaggagagcaagaagaagccgaaagcgaccagtgccttcgttgaagtgccagan

SEQ ID NO: 14942 - DNA, 698 bp, Zea mays
  misc_feature: Ceres CLONE 1377138-F
  misc_feature: Encodes the peptide sequence at SEQ ID NO. 14943
ccccgcggtggcggccgctctagaactagtggatcccccgggctgcaggaattcgcacgagaccattacctagaacatcctaatcgaaaagtcactcacgaacgcacgaattcaccaaccaaactccactgtctccaactctccatcgcgtctgctacgcctctcctgcaggacgaccaatggcttccaggaagttcttcgtgggtggcaactggaaatgcaacggtactggcgaggacgtgaagaagatcgtcaccgtgctcaaccaagccgaggtgccctctgaagacgtcgtcgaggtggtggtgagtccgcctttcgtttttctgcagcaggtcaaggggctgctgcggctggacttccccgtcgcagcgcagaactgctgggtgcagaagggcggcgccttcaccggcgagatcagtgctgagatgctggtaaacctgcaggtgccctgggtcattttgggacattctgagcgcagagctctgttgggggaatccagtgattttgttgctgataaaggtgcatatgcactcactcagggcctccaggtaattgctttgcattggtgagacccttgagcagagagagcaggaccaccatgggatgttgttgctgcacaaacaaggctattgctaaaaaaaatcaatggaacaaaaattgtgtggaaaaaaagaaccaagttgggcttatggaac

SEQ ID NO: 14943 - protein, 130 aa, Zea mays
  misc_feature: Ceres CLONE 1377138-F
  misc_feature (6)..(130): Pfam Name: TIM Pfam Description: Triosephosphate isomerase
  misc_feature: SWISSPROT Homolog: EC 5.3.1.1 Triose-phosphate isomerase
MASRKFFVGGNWKCNGTGEDVKKIVTVLNQAEVPSEDVVEVVVSPPFVFLQQVKGLLRLDFPVAAQNCWVQKGGAFTGEISAEMLVNLQVPWVILGHSERRALLGESSDFVADKGAYALTQGLQVIALHW

SEQ ID NO: 14944 - DNA, 692 bp, Zea mays
  misc_feature: Ceres CLONE 1377140-F
  misc_feature: Translation starting site: 230
  misc_feature (299)..(299): n is a, c, t, g, unknown, or other
  misc_feature (308)..(308): n is a, c, t, g, unknown, or other
  misc_feature (323)..(323): n is a, c, t, g, unknown, or other
  misc_feature (326)..(326): n is a, c, t, g, unknown, or other
  misc_feature (338)..(338): n is a, c, t, g, unknown, or other
  misc_feature (339)..(339): n is a, c, t, g, unknown, or other
  misc_feature (366)..(366): n is a, c, t, g, unknown, or other
  misc_feature (374)..(374): n is a, c, t, g, unknown, or other
  misc_feature (385)..(385): n is a, c, t, g, unknown, or other
  misc_feature (394)..(394): n is a, c, t, g, unknown, or other
  misc_feature (426)..(426): n is a, c, t, g, unknown, or other
  misc_feature (433)..(433): n is a, c, t, g, unknown, or other
  misc_feature (452)..(452): n is a, c, t, g, unknown, or other
  misc_feature (459)..(459): n is a, c, t, g, unknown, or other
  misc_feature (460)..(460): n is a, c, t, g, unknown, or other
  misc_feature (484)..(484): n is a, c, t, g, unknown, or other
  misc_feature (548)..(548): n is a, c, t, g, unknown, or other
  misc_feature (551)..(551): n is a, c, t, g, unknown, or other
  misc_feature (569)..(569): n is a, c, t, g, unknown, or other
  misc_feature (665)..(665): n is a, c, t, g, unknown, or other
tccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcgntgagggcgncagctgcggaggcgncgnccagggcgtgannggggaatcggggaaggagaggtgaggnagtatganagcgacatgangaagctggnagagctgctttctaagctgaccccctcggcgnaggagtncgtgccgcagtcccgccgncgcgtgnnacgcggcgctccccgccttttcgncgacgcgcccgtgttcgtgtcgccggggatcgactactacgcgcgcccacacagttcccgccgncgnagcttctgcagcacacanccgatgacttggttgaaatttgtggtgccgccccgcgggttgggatgggtggcggccggggggaatggactcagcaggacggattcgccatgtcanccgattcacgggaaaaggacggtttcc

SEQ ID NO: 14945 - DNA, 759 bp, Zea mays
  misc_feature: Ceres CLONE 1377141-F
  misc_feature: Encodes the peptide sequence at SEQ ID NO. 14946
  misc_feature (284)..(284): n is a, c, t, g, unknown, or other
  misc_feature (333)..(333): n is a, c, t, g, unknown, or other
ggagctccccgcggtggcggccgctctagaactagtggatcccccgggctgcaggaattcgcacgagaccattacctagaacatcctaatcgaaaaaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgagggcgtcgtcgcccgcccctccgccccctccccgccggnggccccggtggtctcctcctcccgccgcagatcagcggacgcgccgttngcccgggtcaggcgagtccaaacgcagtgcagttcacgctcgagcacgaccttggcgacggcaagggcttcgtctcagctggaaacttctcggccccgctcaagaccttcgcccacgggacgcagaccctcactaaacttcgcttttacaaggaatgatttttactgagggatgataaagcgcggttcaaaaaagtgcttccagggaagatggcttttatacaattaggctgccaatcctaaatgggttggacactacaaagaaacaatcatgtttgttttctcaatcagagctagatgcattcccaccggggacaagtttggatgaacacattggtatccccaaatgggatggtgaaaattaatctgggcagcaatttatggctccctgggggatggggggccaataccctaggggctatggaat

SEQ ID NO: 14946 - protein, 123 aa, Zea mays
  misc_feature: Ceres CLONE 1377141-F
  misc_feature (52)..(52): Xaa is any aa, unknown, or other
  misc_feature (68)..(68): Xaa is any aa, unknown, or other
MAPPRRALLVLAALLLSLSLGAASFHSDELLLNDDEEFEGVVARPSAPSPPXAPVVSSSRRRSADAPXARVRRVQTQCSSRSSTTLATARASSQLETSRPRSRPSPTGRRPSLNFAFTRNDFY

SEQ ID NO: 14947 - DNA, 694 bp, Zea mays
  misc_feature: Ceres CLONE 1377143-F
  misc_feature: Encodes the peptide sequence at SEQ ID NO. 14948
  misc_feature (460)..(460): n is a, c, t, g, unknown, or other
  misc_feature (520)..(520): n is a, c, t, g, unknown, or other
  misc_feature (521)..(521): n is a, c, t, g, unknown, or other
  misc_feature (627)..(627): n is a, c, t, g, unknown, or other
  misc_feature (662)..(662): n is a, c, t, g, unknown, or other
tccccgcggtggcggccgctctagaactagtggatcccccgggctgcaggaattcgcacgagaccattacctagaacatcctaatcgaaaattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcanccagtagctctggcaaacctttctccctactctcagcaacaacaatttctttccattcanncactgtctacactgacccctgctgcttatttgcagcaacaactattaccattagccagctagctactggctactctcagaaacaacaactctttcattttaaccantggccgcactgaaccccgctgctttattgcagcancaatactactacattttagccaggtagctgca

SEQ ID NO: 14948 - protein, 105 aa, Zea mays
  misc_feature: Ceres CLONE 1377143-F
  misc_feature (104)..(104): Xaa is any aa, unknown, or other
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLIXQ

SEQ ID NO: 14949 - DNA, 738 bp, Zea mays
  misc_feature: Ceres CLONE 1377146-F
  misc_feature: Encodes the peptide sequence at SEQ ID NO. 14950
  misc_feature (288)..(288): n is a, c, t, g, unknown, or other
  misc_feature (319)..(319): n is a, c, t, g, unknown, or other
  misc_feature (335)..(335): n is a, c, t, g, unknown, or other
  misc_feature (418)..(418): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcttccttatgctccttggtctttctgcaagtgttgctaccgcaaccattttcccacaatgctcacaagctcctatagcttcccttcttcccccatacctctcaccagcgntgtctttcatgtgtgaaaacccaattgttcnaccctacaggatccancagggcatcgcaacaggcatcttaccatttatcacctttgtcctccaacaaccgtcagccctaatacagcagttacctttggnccatttngnnggacaaaacatcagggaacaacactacaacactggggctagaaaacttgctgcaactcctaaaaaaatcagtttcttcaatccaccaattggtgcattgaacccggctgtttattgcaaaaacataacctttccgccggttgtttctggcaaccccaaagatttttttccattccacccataagaatttgaattcttggtgttttttaggaggaaaaattaaaccttttcccctttttttatggggcccttggtctttttaaaaaaaaaaaagttgggggcgttttcccgggcatttattaaaagggggc

SEQ ID NO: 14950 - protein, 150 aa, Zea mays
  misc_feature: Ceres CLONE 1377146-F
  misc_feature (44)..(44): Xaa is any aa, unknown, or other
  misc_feature (54)..(54): Xaa is any aa, unknown, or other
  misc_feature (59)..(59): Xaa is any aa, unknown, or other
  misc_feature (87)..(87): Xaa is any aa, unknown, or other
  misc_feature (89)..(89): Xaa is any aa, unknown, or other
  misc_feature (90)..(90): Xaa is any aa, unknown, or other
MAAKIFCFLMLLGLSASVATATIFPQCSQAPIASLLPPYLSPAXSFMCENPIVXPYRIXQGIATGILPFITFVLQQPSALIQQLPLXHXXGQNIREQHYNTGARKLAATPKKISFFNPPIGALNPAVYCKNITFPPVVSGNPKDFFPFHP

SEQ ID NO: 14951 - DNA, 728 bp, Zea mays
  misc_feature: Ceres CLONE 1377147-F
  misc_feature (224)..(224): n is a, c, t, g, unknown, or other
  misc_feature (276)..(276): n is a, c, t, g, unknown, or other
  misc_feature (280)..(280): n is a, c, t, g, unknown, or other
  misc_feature (285)..(285): n is a, c, t, g, unknown, or other
  misc_feature (286)..(286): n is a, c, t, g, unknown, or other
  misc_feature (336)..(336): n is a, c, t, g, unknown, or other
  misc_feature (344)..(344): n is a, c, t, g, unknown, or other
  misc_feature (350)..(350): n is a, c, t, g, unknown, or other
  misc_feature (547)..(547): n is a, c, t, g, unknown, or other
  misc_feature (548)..(548): n is a, c, t, g, unknown, or other
  misc_feature (582)..(582): n is a, c, t, g, unknown, or other
  misc_feature (604)..(604): n is a, c, t, g, unknown, or other
  misc_feature (606)..(606): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (616)..(616): n is a, c, t, g, unknown, or other
  misc_feature (625)..(625): n is a, c, t, g, unknown, or other
  misc_feature (626)..(626): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (640)..(640): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
ggagctccccgcggtggcggccgctctagaatagtggatcccccgggctgcaggaattcgcacgagaccattacctaagaacatcctaatcgaaaacaccgtagggcacataggctctgggctctggcgctaatgttcgagcaaggcgctgctcctgttgctgtagaagggattttttgaccaacccctccaccggtgcggcttcgatctttcctctcctatcnactgaaatcctcgagtattcatcgccggcgcagcgcgtctctttcctccccnctgnagaannggggaaggggacacgaaacggagcagaaggccatggacacgatgcggggncgcgctgnaagcgncccaagatgcttggtgggcatgggaggtccaacgagggattcccccgtttgccccccgccccaaggaagaattccttttttttcaaaaaaatttaattggggaattgggaccccttcaaaaaaccttttaagaggggtctttttgggttttccccaaaaaatttttttttttgtgttcgcccccaaaaaaaaaaaannccacaatttttttttttttttgaaagaggtgggnttttttgttttctccccccccncncnnnncccanaagagggannaggggtgtgnnntntggnnnnnnntgtaattttttcttctcaacccccccccccccccctggtggttagggggttggcgaccaaaaaagaattaattctatt

SEQ ID NO: 14952 - DNA, 725 bp, Zea mays
  misc_feature: Ceres CLONE 1377148-F
  misc_feature: Encodes the peptide sequence at SEQ ID NO. 14953
  misc_feature (308)..(308): n is a, c, t, g, unknown, or other
  misc_feature (322)..(322): n is a, c, t, g, unknown, or other
  misc_feature (502)..(502): n is a, c, t, g, unknown, or other
  misc_feature (510)..(510): n is a, c, t, g, unknown, or other
  misc_feature (617)..(617): n is a, c, t, g, unknown, or other
  misc_feature (649)..(649): n is a, c, t, g, unknown, or other
  misc_feature (695)..(695): n is a, c, t, g, unknown, or other
tccccgcggtggcggccgctctagaatagtggatcccccgggctgcaggaattcgcacgagaccattacctagaacatcctaatcgaaaaatctcatatcattcgtctgttctgtccttgatgtgctaaacgcgtgcatgcaggcgcgatctgcgggccggcgagcctggtgaacgcgatgatggacctgcaggagggggcgctgatgctgctgggccccacgatgaacgccaaggtggcgttcgagctgtcggagcggctgccacacctgccgctgcggatgcaggagcactcgcgccgcgcgctgncgttcgccgagcgnatgcaggggctgggcctgcgcgtgctgtacccgggcctcccgggccacccgcaccacgcgcgcctgggccgcatgggcaacccgggctacggctggcgcggcatgctgtgcctcgacatgggcaccgaggagcgcgcccaccgcctcatgcaccacctccagaacacaccccagttcggnctcatggncgtcagcctcggctactacgagacgctcatgtcctgctcccgcagcagcaccagcagcgagatgcccgcccgaggaccgcgcgcgcgcggcatctccccgggcctcncccggatgtcccgtcgctacaccgcaccctgnaaccacgccttgggccccaattccgagcgcgcgctcccgctcatgnaaacgcccgacgcccaggaccatcttcagg

SEQ ID NO: 14953 - protein, 182 aa, Zea mays
  misc_feature: Ceres CLONE 1377148-F
  misc_feature: SWISSPROT Homolog: EC 2.5.1.48 Cystathionine gamma-synthase
  misc_feature (44)..(44): Xaa is any aa, unknown, or other
  misc_feature (111)..(111): Xaa is any aa, unknown, or other
  misc_feature (147)..(147): Xaa is any aa, unknown, or other
  misc_feature (157)..(157): Xaa is any aa, unknown, or other
  misc_feature (173)..(173): Xaa is any aa, unknown, or other
MMDLQEGALMLLGPTMNAKVAFELSERLPHLPLRMQEHSRRALXFAERMQGLGLRVLYPGLPGHPHHARLGRMGNPGYGWRGMLCLDMGTEERAHRLMHHLQNTPQFGLMXVSLGYYETLMSCSRSSTSSEMPARGPRARGISPGLXRMSRRYTAPXNHALGPNSERALPLMXTPDAQDHLQ

SEQ ID NO: 14954 - DNA, 734 bp, Zea mays
  misc_feature: Ceres CLONE 1377151-F
  misc_feature: Translation starting site: 200
  misc_feature: Pfam Name: DapB_N Pfam Description: Dihydrodipicolinate reductase, N-terminus
  misc_feature: SWISSPROT Homolog: EC 1.3.1.26 Dihydrodipicolinate reductase
  misc_feature (560)..(560): n is a, c, t, g, unknown, or other
  misc_feature (620)..(620): n is a, c, t, g, unknown, or other
tccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgagggggcttcacctagtccctggttcattcagcagtagagagaaggttgaaaaacaatgggcagtggacaaacagacattcaaatatatggtccttctaaaagagagatgttctttcatctattgctgatgaattcccagatgtcattggntgtgactacacaggaacccggttctgtgaactctaatgctgagctctattgcaagctggnattgccatttgtgatgggcacaactggtgggaacaagcatttgctcctacagtcagtgcaagattcaaaaattatgcacaatattctccacgatgggcaaacaggtggttgcat

SEQ ID NO: 14955 - DNA, 752 bp, Zea mays
  misc_feature: Ceres CLONE 1377152-F
  misc_feature: Translation starting site: 242
  misc_feature: Pfam Name: HSP20 Pfam Description: Hsp20/alpha crystallin family
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (444)..(444): n is a, c, t, g, unknown, or other
  misc_feature (470)..(470): n is a, c, t, g, unknown, or other
  misc_feature (471)..(471): n is a, c, t, g, unknown, or other
  misc_feature (506)..(506): n is a, c, t, g, unknown, or other
  misc_feature (614)..(614): n is a, c, t, g, unknown, or other
  misc_feature (662)..(662): n is a, c, t, g, unknown, or other
  misc_feature (667)..(667): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccatttacctaagaacattcctaaatcgaaaaaatcccaatccagagcgaagatcgcgatcagaagcaggagcaggcaacgcgcaccgaaatcttccaatccacaagaactcgctacttcgcagttggcagactcgcccgcagcgagccgctagcaaccaagcagaaatgtcgctggtgaggcgcggcagcgtgttcgacccatttctccgtggacctcttcgaccccttcgacagcgtgttccgctccatcgtgccgcgcgcnnnnngggggggggggggggcctccgagaacgccggccttcgccagcgcccgcatcgactgggaaggagacgcccgaggcgcacgtgttcaaggccgacctccccgncgtgaaaaaggaggaggtgaaggtgnnaggtggaggacggcaacgtgctgctcatcagcggnaagcgcagcaggggagaaggaggacaagggcgacaagtggcatcgcgtggagcgcagcagcggccagttcgtgcggcgcttccgcctccccgagacgccaagacgganggaggtgagggcgcgcttggagaacgcgtgctcacggtcacgtgcccnaaggncgagtcaaaaagcccgaggtgaagacatcaaatctcccgctgaaaanaatgaccccaggggggatgtcccgtcccgcgttcgtat

SEQ ID NO: 14956 - DNA, 710 bp, Zea mays
  misc_feature: Ceres CLONE 1377155-F
  misc_feature: Encodes the peptide sequence at SEQ ID NO. 14957
  misc_feature (319)..(319): n is a, c, t, g, unknown, or other
  misc_feature (445)..(445): n is a, c, t, g, unknown, or other
  misc_feature (577)..(577): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggtcgcccgatgggtgagcaggtgaatggcatgctccacgancaggggccgacggcgtcgcaggcgctgacggtggcgacgctgttcccgctggggcggctgctgctggtgctgtcggggctggcgctgacggcctcgtggggtggggctggccgtggccaccgcggntgtcctgatcttcagcccccgtgctggtcccccgcgcgctgctcatccggacggccggtcatgggtccctcacgtcggccgcctggggggctccgggggcctgtcctcgctcacgtgcctcgccaaacgggngcgggaggcgttcagcgcacccgggactaacggggaggaggcgcacgcaggaatgggggaagccgcggcgcacgcgggcaaaagaccgcggaaggaggcagggcatccagggaagggcgaaggaggccgctct

SEQ ID NO: 14957 - protein, 135 aa, Zea mays
  misc_feature: Ceres CLONE 1377155-F
  misc_feature (40)..(40): Xaa is any aa, unknown, or other
MADRDRSGIYGGAHATYGQQQQQGGGGRPMGEQVNGMLHXQGPTASQALTVATLFPLGRLLLVLSGLALTASWGGAGRGHRGCPDLQPPCWSPARCSSGRPVMGPSRRPPGGLRGPVLAHVPRQTGAGGVQRTRD

SEQ ID NO: 14958 - DNA, 724 bp, Zea mays
  misc_feature: Ceres CLONE 1377156-F
  misc_feature: Translation starting site: 156
  misc_feature (531)..(531): n is a, c, t, g, unknown, or other
  misc_feature (609)..(609): n is a, c, t, g, unknown, or other
  misc_feature (613)..(613): n is a, c, t, g, unknown, or other
  misc_feature (614)..(614): n is a, c, t, g, unknown, or other
aagctggagctccccgcggtggcggccgctctagaactagtggatcccccgggctgcaggaattcgcacgagaccattacctagaacatcctaatcgaaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcatgaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcggggtccgggttcaccccttccatgtccttcgtatcaacaagatgctttcgtgtgctggggctgataggctcagactggaaatggagggtgccttttgcaagctcaggcactgntgctagggtgaccattggtcagtaactcctttctggtcgatgcaaggacacatgctgcacatgccagtgagctctgcnaccnncccagttcaagttccctggcgccaaaaagatatgagaagagaaagtggggcttccccaaggtcagcctgcgaactactgaaagacaaaaggggggggagattggtccccg

SEQ ID NO: 14959 - DNA, 716 bp, Zea mays
  misc_feature: Ceres CLONE 1377157-F
  misc_feature: Encodes the peptide sequence at SEQ ID NO. 14960
  misc_feature (251)..(251): n is a, c, t, g, unknown, or other
  misc_feature (334)..(334): n is a, c, t, g, unknown, or other
  misc_feature (344)..(344): n is a, c, t, g, unknown, or other
  misc_feature (617)..(617): n is a, c, t, g, unknown, or other
tccccgcggtggcggccgctctagaactagtggatcccccgggctgcaggaattcgcacgagaccattacctagaacatcctaatcgaaaacagcctcgccgccccaccaccccagcattgccttaccttgccttgccttcccctccattccacctccacctcgccgcccgaatcccccccaacccaacaatcccccatggggtcgctggccatcgatgcgcaccgcgcgggcgcgaaggtgtaccgcggncgcgcgctgtgcgcggagaagtcgaacgagctgctggcagatgcgcacctcccgctgggcctgctgccgctggacgacatggnagaaagtcgntacaaccgcgccacgggcttcggggggctgcgccaaagaatccgtcacgcacccgttccgccggatcgcggccaggtctctacgccgccagggcaccgccttcgggaagaccgcgaataaaaccatgaacggggtaaaaacagggatcccccttcgggcaccctccccaaatgggcccgaaaggggaacacctcaaaaatcctttaaaaccccccggggttgggagaaccaaccccccccccctcccaaagaaaacccccggggaaacccccnccacaaaaaagagagattccccccccccccccccccaaaaggttggccaaaaaggggggggcccccccaaagttttttttgtgggaaaaacaatttctc

SEQ ID NO: 14960 - protein, 88 aa, Zea mays
  misc_feature: Ceres CLONE 1377157-F
  misc_feature (46)..(46): Xaa is any aa, unknown, or other
MGSLAIDAHRAGAKVYRGRALCAEKSNELLADAHLPLGLLPLDDMXESRYNRATGFGGLRQRIRHAPVPPDRGQVSTPPGHRLREDRE

SEQ ID NO: 14961 - DNA, 718 bp, Zea mays
  misc_feature: Ceres CLONE 1377158-F
  misc_feature: Encodes the peptide sequence at SEQ ID NO. 14962
  misc_feature (402)..(402): n is a, c, t, g, unknown, or other
  misc_feature (481)..(481): n is a, c, t, g, unknown, or other
  misc_feature (493)..(493): n is a, c, t, g, unknown, or other
  misc_feature (502)..(502): n is a, c, t, g, unknown, or other
  misc_feature (503)..(503): n is a, c, t, g, unknown, or other
  misc_feature (611)..(611): n is a, c, t, g, unknown, or other
  misc_feature (632)..(632): n is a, c, t, g, unknown, or other
  misc_feature (633)..(633): n is a, c, t, g, unknown, or other
ggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccaccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggnatccattgggtgagggctccgctggtcaggtcacaaggaacatgcttgcaaatggaggtgtccgttcttttctacaggntttgtctgccgnattgctganngcagcgacgtacacgactgctcgtcttggatcctttaggggtctaaactaacaagcagttgaaaagaatgaggggaagcatttgctctattcagaaagcttttatggntctgactgctggagcaatggnntgcttgttttggagccctgctgatctggcactcattagaatggcagcgactcgaccctggcagctgcacacgacgcaactataga

SEQ ID NO: 14962 - protein, 101 aa, Zea mays
  misc_feature: Ceres CLONE 1377158-F
  misc_feature (23)..(102): Pfam Name: Mito_carr Pfam Description: Mitochondrial carrier protein
  misc_feature (52)..(52): Xaa is any aa, unknown, or other
  misc_feature (78)..(78): Xaa is any aa, unknown, or other
  misc_feature (82)..(82): Xaa is any aa, unknown, or other
  misc_feature (85)..(85): Xaa is any aa, unknown, or other
MADAKQQQQQPQQAAAAATGVWKTVKPFVNGGASGMLATCVIQPIDMVKVRXPLGEGSAGQVTRNMLANGGVRSFLQXLSAXLLXAATYTTARLGSFRGLN

SEQ ID NO: 14963 - DNA, 709 bp, Zea mays
  misc_feature: Ceres CLONE 1377159-F
  misc_feature (598)..(598): n is a, c, t, g, unknown, or other
  misc_feature (650)..(650): n is a, c, t, g, unknown, or other
  misc_feature (651)..(651): n is a, c, t, g, unknown, or other
  misc_feature (705)..(705): n is a, c, t, g, unknown, or other
tggagctcaccgcggtggcggccgctctagaactagtggatcccccgggctgcaggaattcgcacgagaccattacctagaacatcctaatcgaaaaatcaaccatattattgagaaccaacaagcaacatagaaagtggaatacagtagcaacaatagagcaacaatggcggccaagatattttccatccttatgctccttgcttctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcaacaatcgccagccctatctttggtgcagtcattggtacaaaccatcagggcacaacagctgcagcaactcgtgctaccagtgatcagccaagtagctctggcaaacctttctccctactctcagcaacaacaatttcttccattcaaccaactgtctacactgaaccctgctgcttatttgcagcaacaacaactactaccattcangcagctagctactgcctactctcagcagcaacaatttctttcatttaaacannttcgcgcactgaacccctctgcttattttcagcagcaatactactaccatttgncagt

SEQ ID NO: 14964 - DNA, 714 bp, Zea mays
  misc_feature: Ceres CLONE 1377160-F
  misc_feature: Translation starting site: 125
  misc_feature (305)..(305): n is a, c, t, g, unknown, or other
  misc_feature (306)..(306): n is a, c, t, g, unknown, or other
  misc_feature (398)..(398): n is a, c, t, g, unknown, or other
  misc_feature (473)..(473): n is a, c, t, g, unknown, or other
  misc_feature (530)..(530): n is a, c, t, g, unknown, or other
  misc_feature (532)..(532): n is a, c, t, g, unknown, or other
  misc_feature (686)..(686): n is a, c, t, g, unknown, or other
  misc_feature (714)..(714): n is a, c, t, g, unknown, or other
tccccgcggtggcggccgctctagaactagtggatcccccgggctgcaggaattcgcacgagaccattacctagaacatcctaatcgaaaaacttccattccaccggctccgatcccaactgccatggcgctctccatctacacgcccacctcctcctccctcgtcccgccctccattcaggaggtcaggttgacttcgcgaccgccaaagcccgcgactttcagcctacggaggccacatctggccgcgcgggccgccgctggcaacgcacccacgtccccgggtccgcgaggtcgtcactgannctcgacgcggtcgccggcttcagcgagatcgtggcggacaccgtcgtgttcgatgatttcgagaggttcgcacccacggcggccacagtgangctcgtcgctgctgcttgggatcactgggctcccagacactaagttcaagagtgcgatagatactgcactggcangatggtgagtgcacgcaactggagaaggctgaaggacaggatgtcctgttacctcancnaggctcttgcaaatggtggcgctgactggctcatcagtcccctgggagaagttcgacggaaatagatgcccgggtagcttatgacacccaggcataaatcacagggtacctggactggttgaatctatacaccacatgatgtctcaactgaccngctggtattcaaaattctgctactggan

SEQ ID NO: 14965 - DNA, 730 bp, Zea mays
  misc_feature: Ceres CLONE 1377164-F
  misc_feature: Translation starting site: 191
  misc_feature (255)..(255): n is a, c, t, g, unknown, or other
  misc_feature (258)..(258): n is a, c, t, g, unknown, or other
  misc_feature (293)..(293): n is a, c, t, g, unknown, or other
  misc_feature (386)..(386): n is a, c, t, g, unknown, or other
  misc_feature (441)..(441): n is a, c, t, g, unknown, or other
  misc_feature (462)..(462): n is a, c, t, g, unknown, or other
  misc_feature (482)..(482): n is a, c, t, g, unknown, or other
  misc_feature (483)..(483): n is a, c, t, g, unknown, or other
  misc_feature (496)..(496): n is a, c, t, g, unknown, or other
  misc_feature (550)..(550): n is a, c, t, g, unknown, or other
  misc_feature (560)..(560): n is a, c, t, g, unknown, or other
aaactggagctccccgcggtggcggccgctctagaactagtggatcccccgggctgcaggaattcgcacgagaccattacctagaacatcctaatcgaaaaacttctctgcttccgacctcgtagcgaatcggaccggggggctagggttccggtgcgcctctgcaatcggacgcgaggctaggctgggcatggagggaaccgctgcggcccggaagaggtcccggccggagacggcgaacggggctgccgccgnccnggaagcgtccaagtacgattgggtgcccgtttggncgaggatgtcatttttctgcacttgtccctggtggttacgcggcagttgcaaaatgctgaatctaagtagctctgctgtatctgcgccatcangaactcatgtggatcatgccgctctttacggtgcctctcatccagcttctacggncaagacacgcatgtgcaccangtacacactacagaaggctnngcagtcggtgatnagtggcatttcgctcatagcgaaagagagctggcgagcccagctacatgtctcnagaagacctncctatgggtggccgatatggacgagctgaaactatgcaaccagcttgcatgggccctcagcagggaacttttgtgcctcgcgactggcaagatcagggtgaaccctctctggcggtgataaacggggagaggggggggcaaccttagcagatagtaaaaatacgggcgcc

SEQ ID NO: 14966 - DNA, 740 bp, Zea mays
  misc_feature: Ceres CLONE 1377165-R
ccaattgggtaccgggccccccctcgaggtcgacggtatcgataagcttttttttttttttttttagcaccacaaaccaaagtactagagcatcactagattcaagccagctctcgagactagaccactggcaatacattacgctggaaagcatacctcatttacacacctaaactactcggcgaaagctccagccgagccaacacaaacagacattaccgcaggagcagcacgggaagggaacgctccttcctactcccacacgtcgtccagagaggagtcctcgtcttcatcccgctggttcgccagcgccagctcctcggagacgtaggagagcccctgcatcagcctcaccacctccgccgcgtcgtcgaggtagtacttggccttgctgggcttgcggccgacggtgcacgcgaacacctccgccttggacgccagcgagtccccgcaggcagcggtggcgatcagctggaacatgtcctcgtcggacttgtcgtcgccgatgcacaggacgaagtccgggcactggccccgctccttcatcgacacaagcatgcgccgggccaccaagcccttgctcacgccctgcaaaagcgaacaatctcgtcgccaggcagtgagttcatgcgcctggtctatttgcccaatgcaaagaagatgcggagatcgaggatcgatgcttcacctgcggtttcacttcaactgagtgaggcgtggtcttcaccgacacaggctcg

SEQ ID NO: 14967 - DNA, 713 bp, Zea mays
  misc_feature: Ceres CLONE 1377166-F
  misc_feature: Encodes the peptide sequence at SEQ ID NO. 14968
  misc_feature (418)..(418): n is a, c, t, g, unknown, or other
  misc_feature (446)..(446): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (548)..(548): n is a, c, t, g, unknown, or other
  misc_feature (549)..(549): n is a, c, t, g, unknown, or other
  misc_feature (610)..(610): n is a, c, t, g, unknown, or other
ccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattgncacaaaacatcagggcacaacaactacnacaacttgtgctagcaaaccttgctgcctactctcagcaacagcagtttcttccatttcaccactagctgcattgaactctgctttctattnnngcacacanncactacattcagccagctacctgctgcctaccccccgaatttcttccattcaccaactggnagcattgaactctcctgcttaattacagcagcaacaactactaccattcagccagttagctggggtgagccctgctaccttctgaatacaacaacagtgttgc

SEQ ID NO: 14968 - protein, 121 aa, Zea mays
  misc_feature: Ceres CLONE 1377166-F
  misc_feature (91)..(91): Xaa is any aa, unknown, or other
  misc_feature (100)..(100): Xaa is any aa, unknown, or other
MAAKIFCLLMLLGLSASAATATIFPQCSQAPIASLLPPYLSPAVSSVCENPILQPYRIQQAITAGILPLSPLFLQQSSALLHQLPLVHLLXQNIRAQQLXQLVLANLAAYSQQQQFLPFHH

SEQ ID NO: 14969 - DNA, 688 bp, Zea mays
  misc_feature: Ceres CLONE 1377167-F
  misc_feature: Encodes the peptide sequence at SEQ ID NO. 14970
  misc_feature (231)..(231): n is a, c, t, g, unknown, or other
  misc_feature (235)..(235): n is a, c, t, g, unknown, or other
  misc_feature (276)..(276): n is a, c, t, g, unknown, or other
  misc_feature (277)..(277): n is a, c, t, g, unknown, or other
  misc_feature (288)..(288): n is a, c, t, g, unknown, or other
  misc_feature (289)..(289): n is a, c, t, g, unknown, or other
  misc_feature (313)..(313): n is a, c, t, g, unknown, or other
  misc_feature (454)..(454): n is a, c, t, g, unknown, or other
tggagctccccgcggtggcggccgctctagaactagtggatcccccgggctgcaggaattcgcacgagaccattacctagaacatcctaatcgaaaaatatttcagtcgtcgctcgcggagccgtggcgcatcgcgactcaggcactcaccgaccgcggatatggccccgccgccatggcctctccttgcgacttccctcctcctcatcctattccaccactcgcctcgcngcgnggtggcgtttccgccgtctctgggcgacagcctcctgggcnngcgccgcgcgnncggtttcgcggcttgcctgcgcgncttggcgcgccgcatccacgagcgccccgagctcgcctttccagagcacgcacagcgagctcgtccgcgagagctcgacgcgatcggggtgccgtacgcgtggcccgtcgcgcagacgggcgtcgtggcgacatcgccggnggagcgatgggcccgtcgtcgcgttccgagccgaatgaacgcgctacccttgcagaatttggagactgggaacccagagcaagagagggaaagatgcctgcttgtgaactgatgctcaaccacgatggttcttggggagctaaattgcttcttgtcgaaagatgatttaaaggaaccgggagttttgctcccaccaagggaaaaaggtacggggggctttacatgttttacaag

SEQ ID NO: 14970 - protein, 134 aa, Zea mays
  misc_feature: Ceres CLONE 1377167-F
  misc_feature (24)..(24): Xaa is any aa, unknown, or other
  misc_feature (25)..(25): Xaa is any aa, unknown, or other
  misc_feature (39)..(39): Xaa is any aa, unknown, or other
  misc_feature (43)..(43): Xaa is any aa, unknown, or other
  misc_feature (51)..(51): Xaa is any aa, unknown, or other
  misc_feature (98)..(98): Xaa is any aa, unknown, or other
MAPPPWPLLATSLLLILFHHSPRXXVAFPPSLGDSLLGXRRAXGFAACLRXLARRIHERPELAFPEHAQRARPRELDAIGVPYAWPVAQTGVVATSPXERWARRRVPSRMNALPLQNLETGNPEQERERCLLVN

SEQ ID NO: 14971 - DNA, 701 bp, Zea mays
  misc_feature: Ceres CLONE 1377169-F
  misc_feature: Encodes the peptide sequence at SEQ ID NO. 14972
  misc_feature (218)..(218): n is a, c, t, g, unknown, or other
  misc_feature (231)..(231): n is a, c, t, g, unknown, or other
  misc_feature (272)..(272): n is a, c, t, g, unknown, or other
  misc_feature (278)..(278): n is a, c, t, g, unknown, or other
  misc_feature (279)..(279): n is a, c, t, g, unknown, or other
  misc_feature (417)..(417): n is a, c, t, g, unknown, or other
acccgcggtggcggccgctctagaactagtggatcccccgggctgcaggaattcgcacgagaccattacctagaacatcctaatcgaaaaaacacgcgaatcctccaatctgcccttgccgccgccgccgacggatccaggtctgtagactgctcactcctctacgctccgctccgaatggcccgcacgaagcagacggcgcgcaagtcgaccggcgncaaggcgccgcgnaagcagctggccaccaaggcggcgcgcaagtcggccccggncacggnncgcgtgaagaacccgcaccgcttccgccccgaaacgtcgcgctccgggagatcgcagtaccagaagagactgagctgtcatccgaagctccccttcagggctggtcgggaaatcgcgaggacttcagacggactgggntccatcctccgggtgggggcttcaggaggcccgaaggcacctggggttttttaaagaaccacctttgggcttcccgccaaagggccctttttgccaggatatcccctcccccccctatagggaaaaagggttaacctccccctttttccccttataaatttaaaaaggggcccccttttgggggttttgggggggggcccccccccgaggggagggccccgcccgcaaaaaaaaaggcgcctttctcccaaaaaatttggcggtttttatggccccccgaccca

SEQ ID NO: 14972 - protein, 97 aa, Zea mays
  misc_feature: Ceres CLONE 1377169-F
  misc_feature (14)..(14): Xaa is any aa, unknown, or other
  misc_feature (32)..(32): Xaa is any aa, unknown, or other
  misc_feature (34)..(34): Xaa is any aa, unknown, or other
MARTKQTARKSTGXKAPRKQLATKAARKSAPXTXRVKNPHRFRPETSRSGRSQYQKRLSCHPKLPFRAGREIARTSDGLGSILRVGASGGPKAPGVF

SEQ ID NO: 14973 - DNA, 722 bp, Zea mays
  misc_feature: Ceres CLONE 1377171-F
  misc_feature: Encodes the peptide sequence at SEQ ID NO. 14974
  misc_feature (327)..(327): n is a, c, t, g, unknown, or other
  misc_feature (346)..(346): n is a, c, t, g, unknown, or other
  misc_feature (413)..(413): n is a, c, t, g, unknown, or other
  misc_feature (414)..(414): n is a, c, t, g, unknown, or other
  misc_feature (430)..(430): n is a, c, t, g, unknown, or other
  misc_feature (530)..(530): n is a, c, t, g, unknown, or other
  misc_feature (669)..(669): n is a, c, t, g, unknown, or other
tccccgcggtggcggccgctctagaactagtggatcccccgggctgcaggaattcgcacgagaccattacctagaacatcctaatcgaaaactcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcggntcgatgctggtgctgtccnggctgatcctggccggcaccgtgatcgcgctcacggtggcacccccgtgctggtgatctcagcgggnnttttgttggggcccgncccccattcggggtgggggttctggggggccgggtttcgtccccttccggggggcctcggggtccctggcgctgggcccggggttctcctgggttggccnggtcctgggcggggcgggccccccgcggggggccgcccggttgggcccccgccggggggggggttggggtcccggggccccgggccttgggggtggggggccggcccgctttggccgggggcggggggcttgggggggnggccccccccttggggggggcggggggggggttttcctcttggccccgtgggg

SEQ ID NO: 14974 - protein, 75 aa, Zea mays
  misc_feature: Ceres CLONE 1377171-F
  misc_feature (58)..(58): Xaa is any aa, unknown, or other
MADHHRGATGGGGGYGDLQRGGGMHGEAQQQQKQGAMMTALKAATAATFGGSMLVLSXLILAGTVIALTVAPPCW

SEQ ID NO: 14975 - DNA, 719 bp, Zea mays
  misc_feature: Ceres CLONE 1377176-F
  misc_feature: Encodes the peptide sequence at SEQ ID NO. 14976
  misc_feature (152)..(152): n is a, c, t, g, unknown, or other
  misc_feature (252)..(252): n is a, c, t, g, unknown, or other
  misc_feature (379)..(379): n is a, c, t, g, unknown, or other
  misc_feature (622)..(622): n is a, c, t, g, unknown, or other
  misc_feature (630)..(630): n is a, c, t, g, unknown, or other
tccccgcggtggcggccgctctagaatagtggatcccccgggctgcaggaattcgcacgagaccattacctagaacatcctaatcgaaaaaactactccgtcactttgtttgcaaagctcctcctcgatccatcgatcactgcaccggccgncggcaccgcgctcgcaggggctagccaaacgagacgcagcaatggcggaccgtgaccgcagcggcatctacggcggcgcccacgccactacgggcagcancagcagcagggaagaagcgggcgcccccatgggtgagcaggtgaagggcatgctccacgacaaggggccgacggcgtcccaggcgctgaacgtggcgaccctgtccccgctgggcgggctgctgtgntgctgtcccggcttgccctaacgccctccggggggggctggccgtgcccaccccgggttcctgatcttcaccccggggtggtcccgccgcgttgctattgggaaggcggcatgggttcctcccgtcggcgccgttggggttcgggggccttcctccctcagtggctccccaaaaggggggggaaaggttccagccccccggaaattaaggggaggagcccccccaggatggggagagcccccncccacccngcccaaaaaaaccggaaggagggcaggccttccgggggggggcgaaggagcccccccccccaaaaaaaaataaatcccccccccttaac

SEQ ID NO: 14976 - protein, 68 aa, Zea mays
  misc_feature: Ceres CLONE 1377176-F
  misc_feature (20)..(20): Xaa is any aa, unknown, or other
  misc_feature (62)..(62): Xaa is any aa, unknown, or other
MADRDRSGIYGGAHATTGSXSSREEAGAPMGEQVKGMLHDKGPTASQALNVATLSPLGGLLXCCPGLP

SEQ ID NO: 14977 - DNA, 746 bp, Zea mays
  misc_feature: Ceres CLONE 1377184-F
  misc_feature: Encodes the peptide sequence at SEQ ID NO. 14978
  misc_feature (413)..(413): n is a, c, t, g, unknown, or other
  misc_feature (416)..(416): n is a, c, t, g, unknown, or other
  misc_feature (438)..(438): n is a, c, t, g, unknown, or other
aagctggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaagcaggcgcccgccgcgncgntgcaggggttcctgtgcctggnagaggtggacaggaggccggggaactacctgttggacgggggggcccgctaggggaagacaagggcggggccccccccgctggggccgcctaaggccctgcccctggatccccccttccccctgccaggaaaaaagggattcaaaaaacaatggggggcgcgaagggtttcaaaaaaggggacccccttaaaaggacctaaaaggacgggggggctcaaaaaaatttttttgggggagggggggggggtttacaaaaaaaccctggggaggttggtggggccccaccaaaaaagaaaaaccggggctt

SEQ ID NO: 14978 - protein, 77 aa, Zea mays
  misc_feature: Ceres CLONE 1377184-F
  misc_feature (53)..(53): Xaa is any aa, unknown, or other
  misc_feature (54)..(54): Xaa is any aa, unknown, or other
  misc_feature (61)..(61): Xaa is any aa, unknown, or other
MAPAVGLKRSATQTITLPPPDTRLAVRDVMRSTIPSQPAVAPASTEKQAPAAXXQGFLCLXEVDRRPGNYLLDGGAR

SEQ ID NO: 14979 - DNA, 723 bp, Zea mays
  misc_feature: Ceres CLONE 1377185-F
  misc_feature: Encodes the peptide sequence at SEQ ID NO. 14980
aagctggagctcaccgcggtggcggccgctctagaactagtggatcccccgggctgcaggaattcgcacgagaccattacctagaacatcctaatcgaaaactcagctgctggaccgctgcctgtaatcattgaccgctcctcaaggttaaatggaccctgaccccgatctcaccgacacatccgaactgaagcgatcacacctacccgacgaacactcgttggactgtcgccgccagccgcggacgaaccgcgaatcgtcagctttctccagcgatcccgccgccccctgcttcatggtagcaaggatctgaagaggatgctaatagtctcctctgaactagcgttacaggttccttctagaaaaataacatcggataggacgaggtgttgcctactcagaaagcgctgaagaataaatcacattttttgaacattttaaagattgccaactccattattcccaatataatgctggtgagaacaattctcagacaggagcacccgtgcttcaattacatggatcactaccaggtattatgcaccaactttgctgatattgaagtttgatgctatagtaaaatcaagtgccaaggattttattgaatcaataaacatgccagatgctatcgctgtggactatatcagagcagctgtcatcaagactctgtttgaattccaatatgtcactattgaggatgaagtacttaacctctcagctaat

SEQ ID NO: 14980 - protein, 36 aa, Zea mays
  misc_feature: Ceres CLONE 1377185-F
MPDAIAVDYIRAAVIKTLFEFQYVTIEDEVLNLSAN

SEQ ID NO: 14981 - DNA, 756 bp, Zea mays
  misc_feature: Ceres CLONE 1377190-F
  misc_feature: Encodes the peptide sequence at SEQ ID NO. 14982
  misc_feature (467)..(467): n is a, c, t, g, unknown, or other
  misc_feature (472)..(472): n is a, c, t, g, unknown, or other
  misc_feature (512)..(512): n is a, c, t, g, unknown, or other
  misc_feature (513)..(513): n is a, c, t, g, unknown, or other
  misc_feature (524)..(524): n is a, c, t, g, unknown, or other
  misc_feature (534)..(534): n is a, c, t, g, unknown, or other
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgangctgnagacgatgatgaccttgatctttttggtgatgaaactganngagacaagaangcagctgatngacgtgccgccgctgccaaggcctctctaaaaagaaagaaagggaaaaatcctcccgtccttatgaatggcaacccctgggacgatgaaactggaatgaaaaanctggaagaggctggccccaaggtcccaaatggaggggctgacttgggggaaaatccaacctggggcccggtgggaacggcctccagaaaagggctttccgggtcacaattggccccaa

SEQ ID NO: 14982 - protein, 187 aa, Zea mays
  misc_feature: Ceres CLONE 1377190-F
  misc_feature (91)..(91): Xaa is any aa, unknown, or other
  misc_feature (93)..(93): Xaa is any aa, unknown, or other
  misc_feature (106)..(106): Xaa is any aa, unknown, or other
  misc_feature (107)..(107): Xaa is any aa, unknown, or other
  misc_feature (110)..(110): Xaa is any aa, unknown, or other
  misc_feature (114)..(114): Xaa is any aa, unknown, or other
  misc_feature (148)..(148): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPAAAAPADXAXDDDDLDLFGDETXXDKXAADXRAAAAKASLKRKKGKNPPVLMNGNPWDDETGMKXLEEAGPKVPNGGADLGENPTWGPVGTASRKGLSGSQLAP

SEQ ID NO: 14983 - DNA, 714 bp, Zea mays
  misc_feature: Ceres CLONE 1377193-F
  misc_feature: Encodes the peptide sequence at SEQ ID NO. 14984
  misc_feature (714)..(714): n is a, c, t, g, unknown, or other
atagctggagctccccgcggtggcggccgctctagaactagtggatcccccgggctgcaggaattcgcacgagaccattacctagaacatcctaatcgaaaaagaaacaccaccaccaccacatagctgagttcctgtgaagtttatctgagttacctgacgaattaagggcctcttccccagcatctggtggggaagaaccctacctgacgtcccggatcccatccggtgggcaaggtgagttacacgctaggcgggggtcggacagccgacgccaagcgtctcatgcccaacagtcgcaccgccgccgccgaggaaaactcaaaggcacccccgccgtcgcaggcacagccgcgccgagcttgagccgtctgtgctccgctgaatcgcccccatcgtctctcctgaagagagaggacatttattgagacagcatggctaagataaagaccagtcgtgtcaaggatcctgaatgatggtagcttattgaaccaaccatccgagagttggatgccacaatgagagaagctgaatatgatccacatgatggaaagagaaagcgtgaagcgctctggtctattttccgtatttctcatcagacgagccgctacatatatgatctgtactagctaagggacgagatatcacggcaggtttatgagctctgcctggatcatagttatgcagaccgacaacctgatcgcaaagtggtan

SEQ ID NO: 14984 - protein, 36 aa, Zea mays
  misc_feature: Ceres CLONE 1377193-F
MREAEYDPHDGKRKREALWSIFRISHQTSRYIYDLY

SEQ ID NO: 14985 - DNA, 477 bp, Zea mays
  misc_feature: Ceres CLONE 1377194-F
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
cgcggtggcggccgctctagaactagtggatcccccgggctgcaggaattcgcacgagaccattacctagaacatcctaatcgaaaacattccaccggctccgatcccaactgccatggcgctctccatctacacggcccaccttcctcctccctcgtcccgccctccattcaggaggtcagggctgaacttcgcgacccgccaaagccccgcgacttttcaggcctacgggagggccaaaattttgggcccccggcggggccccccctttggaaaaagaaccccaagttcccccggttccggaggggggtccctggaattcaaagggggccccggtttttaagaaaaaattgggggggaaacccccccgggggggccaaaaagttttccagaaggaggggtgcgccccccccccccgcgggggnnnnnnnnaggnnnnnnnnnaaaaaaggagggggggggggggggggggggggg

SEQ ID NO: 14986 - DNA, 660 bp, Zea mays
  misc_feature: Ceres CLONE 1377195-F
  misc_feature: Encodes the peptide sequence at SEQ ID NO. 14987
  misc_feature (383)..(383): n is a, c, t, g, unknown, or other
  misc_feature (386)..(386): n is a, c, t, g, unknown, or other
  misc_feature (387)..(387): n is a, c, t, g, unknown, or other
tccccgcggtggcggccgctctagaactagtggatcccccgggctgcaggaattcgcacgagaccattacctagaacatcctaatcgaaaactcttccagagtaccgcggtctcatctcctcccgggacgggcatgcagagcacggctgccatcggtctcgttcggccatgcgccgcgcggccactccccacctaccctagcccacggcgcggcgccggcgcgtgcagcggcgccgcacagccgatcctcgcgccccgcggcctctgcctctccgcccgcgccagcctactgccggactcgccgctggaggaggagtaccggagatgcagggccggccggcacgtggccgcggccgggaaggtggcggcggctgatggggcgnaannaggaagcggggggagggctcgtcaagacgctgcagctggggtcgctcttcgggctctggtacctcttcaacatctacttcaacatcacaacaagaggggttctgaaggttctgccataccctataaacatcaccacagtgcagtttggccgttggaagtgccattgctttggtttatgtggatcaccggtatccttaaaaggcaaaagatttctggtgcccagctttttgctatccttcctctagctatcgttcataccatgggcaatctttt

SEQ ID NO: 14987 - protein, 175 aa, Zea mays
  misc_feature: Ceres CLONE 1377195-F
  misc_feature (84)..(84): Xaa is any aa, unknown, or other
  misc_feature (85)..(85): Xaa is any aa, unknown, or other
MQSTAAIGLVRPCAARPLPTYPSPRRGAGACSGAAQPILAPRGLCLSARASLLPDSPLEEEYRRCRAGRHVAAAGKVAAADGAXXGSGGRARQDAAAGVALRALVPLQHLLQHHNKRGSEGSAIPYKHHHSAVWPLEVPLLWFMWITGILKRQKISGAQLFAILPLAIVHTMGNL

SEQ ID NO: 14988 - DNA, 666 bp, Zea mays
  misc_feature: Ceres CLONE 1377200-F
  misc_feature: Encodes the peptide sequence at SEQ ID NO. 14989
  misc_feature (345)..(345): n is a, c, t, g, unknown, or other
  misc_feature (404)..(404): n is a, c, t, g, unknown, or other
  misc_feature (428)..(428): n is a, c, t, g, unknown, or other
  misc_feature (489)..(489): n is a, c, t, g, unknown, or other
cacccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgcgcgcgcggttgtttgagaggagaggaggagatgagggagtgcatctccgtccacatcggcaggccggcatccaagtcgcaacgcgtgctgggactttactgcctcgagcacggcatccagcctgatggncaagtgctggagataaagagcgcggacatcacgatgatgccttcagcacctttctcagncagactgggtgctgggagccacgntcccccggtgcatccttcgttgatctaaaacccactgggatcgatgaaggggcgcattggnacggaccggcaggttcttccacctgggaagttatccgggggaagggaggatgccgttaaaaatttcccccggggggccctaacaattggaaaagggaattgtggattttggcccttaacccataccccaaagttgtgtggaaagtggcgggccccccgggttttggggttttagggg

SEQ ID NO: 14989 - protein, 69 aa, Zea mays
  misc_feature: Ceres CLONE 1377200-F
  misc_feature (53)..(53): Xaa is any aa, unknown, or other
  misc_feature (61)..(61): Xaa is any aa, unknown, or other
MRECISVHIGRPASKSQRVLGLYCLEHGIQPDGQVLEIKSADITMMPSAPFSXRLGAGSHXPPVHPSLI

SEQ ID NO: 14990 - DNA, 669 bp, Zea mays
  misc_feature: Ceres CLONE 1377204-F
  misc_feature: Encodes the peptide sequence at SEQ ID NO. 14991
  misc_feature (523)..(523): n is a, c, t, g, unknown, or other
  misc_feature (646)..(646): n is a, c, t, g, unknown, or other
  misc_feature (647)..(647): n is a, c, t, g, unknown, or other
  misc_feature (649)..(649): n is a, c, t, g, unknown, or other
cgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagattggggaagaggtttggcgaggcggcccgcaagaccgagaccatcaccggcaatttctggcagcacttgaaaactggaccaagcattactgatgcagcaatgagcaggatctcacgngtcaccaaagtcattggcagaaaggtggatatgacaaaattttcctgaaaaacttttgaggtcgcccctggtgaaaagctcaagagccatatgccatgttattgcaaacctcgggtggtcccnngntttatgggggggggggctta

SEQ ID NO: 14991 - protein, 114 aa, Zea mays
  misc_feature: Ceres CLONE 1377204-F
MNPPAAAASTGAGGHAAAPAAAREYVHYPRLSPEEVAPPPPPPYHAATAAPSAYGGNPYIYSPAGGAATSPKNTMDSVKDVLGKIGEEVWRGGPQDRDHHRQFLAALENWTKHY

SEQ ID NO: 14992 - DNA, 663 bp, Zea mays
  misc_feature: Ceres CLONE 1377208-F
  misc_feature: Encodes the peptide sequence at SEQ ID NO. 14993
  misc_feature (483)..(483): n is a, c, t, g, unknown, or other
  misc_feature (598)..(598): n is a, c, t, g, unknown, or other
  misc_feature (663)..(663): n is a, c, t, g, unknown, or other
cgctctagaactagtggatcccccgggctgcaggaattcgcacgagaccattacctagaacatcctaatcgaaaaacccaaaaaccccagcgcacccaacccaagagcgaaaatggatccgcaccagttcgccccctcccagcagtcggcgctgaccatggaatcggcggagagcacggccgccgccgccgcgcgggcgtccaacggcgctgcccgagctgtcgtcgaggacgacgacgaggacgacgacgtccccgaggtggccgcctgcatatcgacgatgctcgaccgcgggggtagcgtggagagccaccgcctcttcctggcgcgccgcaccgcgctggagatgctccgcgaccgcgggtacgccgttccggaggaagagctcgcccgcaccctcccggagttccgcgcctggtgggaatacaggccggagctcgaacgcctcgccttctccactaccctcacctccgaccgtccagnaagggtggaaggtttgtgttctgtccacctggacctgtcaaaatcgcagctatccggctgtaattataccgaagtcaaagatgagaacttgtccagactgattcctgagactgcnagggcaaaataatgtctacaaccagagaatccatcaaggagatctttcgaatttagagttgaccn

SEQ ID NO: 14993 - protein, 165 aa, Zea mays
  misc_feature: Ceres CLONE 1377208-F
  misc_feature (57)..(135): Pfam Name: RNA_pol_Rpb5_N Pfam Description: RNA polymerase Rpb5, N-terminal domain
  misc_feature (124)..(124): Xaa is any aa, unknown, or other
MDPHQFAPSQQSALTMESAESTAAAAARASNGAARAVVEDDDEDDDVPEVAACISTMLDRGGSVESHRLFLARRTALEMLRDRGYAVPEEELARTLPEFRAWWEYRPELERLAFSTTLTSDRPXRVEGLCSVHLDLSKSQLSGCNYTEVKDENLSRLIPETARAK

SEQ ID NO: 14994 - DNA, 746 bp, Zea mays
  misc_feature: Ceres CLONE 1377210-F
  misc_feature: Translation starting site: 185
  misc_feature: Pfam Name: Methyltransf_2 Pfam Description: O-methyltransferase
  misc_feature: Pfam Name: Dimerisation Pfam Description: Dimerisation domain
  misc_feature: SWISSPROT Homolog: EC 2.1.1.68 Caffeate O-methyltransferase
  misc_feature (542)..(542): n is a, c, t, g, unknown, or other
  misc_feature (547)..(547): n is a, c, t, g, unknown, or other
  misc_feature (599)..(599): n is a, c, t, g, unknown, or other
  misc_feature (600)..(600): n is a, c, t, g, unknown, or other
  misc_feature (721)..(721): n is a, c, t, g, unknown, or other
  misc_feature (739)..(739): n is a, c, t, g, unknown, or other
aaagctggagctccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggcgccaccgccgccgccgccgccgcgagggacgacatgtccccggcggaggccaggctggcgatgatggagctggcgaacatggtgtcggtgccgatggcgctggcggccgtgatccggctgggcgtgccggccgcggtgtgggcgggcggcgccaacgcgcccatgtcagcggccgacctcctcccgccgggccacccggacccgtccgtcctggagcggctgctccgcctgctggcgtcccgcggcgttttctccgagtccaccgagtccacgcccaccacgcggcggcggctattcgcgctcaccgcggtgggccgcaccctgggtgccgggncccgncctcgggcgcgtcctacgccgactacgtgctgcacaccacaggacgccttgnnttggcgggcgtggccccgcctgcacgaggccgtgtttggaccccgcggggcccgagccgttcgcgcgcgcccaacgccggggtcaccgcctacgcctactacggcagggaccaggacgccnaccgggtcatgtcgcggnccatggg

SEQ ID NO: 14995 - DNA, 670 bp, Zea mays
  misc_feature: Ceres CLONE 1377218-F
  misc_feature (498)..(498): n is a, c, t, g, unknown, or other
  misc_feature (517)..(517): n is a, c, t, g, unknown, or other
  misc_feature (641)..(641): n is a, c, t, g, unknown, or other
  misc_feature (655)..(655): n is a, c, t, g, unknown, or other
tccccgcggtggcggccgctctagaactagtggatcccccgggctgcaggaattcgcacgagaccattacctagaacatcctaatcgaaaaaacggacaaccgcccttctccatccgggctccaagccaacgactcgagtcgttcaaaactggacacagcagtgaaccggagctgcttgcttgctgtctcgccaagaagcaagagtaggaggagcagctggtctctcgccaagtcgcgcctctccctcctctcttctcttttctccctcgcgtcgcgcgctccacatgctgagcctgaggtcaggatccggctccaactcctcgaggggcattgccgccgtgtgtcggcgtcggccccaggctggggctcggcggtggagcgcaagtccgcctccgagggctacaccatcgccatcctctcgcgcgacctcgagaagctgtcgcagctgcgtggaggagatcgcgcaggcggtcaagagcgcaggtgctcgctgctgncggctggactgcgtcgacngcccggcaccgagcgcgaggacctttcgagggcgtgctctccctcggccaccggtcgaggtgctcgtactaccacggctgtcgagccgcctgctaaccacacgagagacgagcgccctggtgcnccttcctagccgangacccgcggaagcct

SEQ ID NO: 14996 - DNA, 679 bp, Zea mays
  misc_feature: Ceres CLONE 1377225-F
  misc_feature: Encodes the peptide sequence at SEQ ID NO. 14997
  misc_feature (359)..(359): n is a, c, t, g, unknown, or other
  misc_feature (439)..(439): n is a, c, t, g, unknown, or other
  misc_feature (453)..(453): n is a, c, t, g, unknown, or other
  misc_feature (454)..(454): n is a, c, t, g, unknown, or other
  misc_feature (490)..(490): n is a, c, t, g, unknown, or other
tggagctccccgcggtggcggccgctctagaactagtggatcccccgggctgcaggaattcgcacgagaccattacctagaacatcctaatcgaaaaaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacnacatccagaaggagagcaccctccaccttggtctccgcctcaggggaggcatgcagatcttcgtcaagaccctcactggnaagactatcacccnntcgaggtggagtcttctgacacccatcgacacgtcnagggccaggatcaggaacagggaggcattcctccggaaacaggaggggttcattttttgttggcaagaacttcaaggagggggggacgcctggccaattacaaatttcgaagggaagcccccccccacttggggggtggggtctcagaggggggatgtggaaatttttcgggaaaacctttaatgggaa

SEQ ID NO: 14997 - protein, 163 aa, Zea mays
  misc_feature: Ceres CLONE 1377225-F
  misc_feature (6)..(74): Pfam Name: ubiquitin Pfam Description: Ubiquitin family
  misc_feature (60)..(60): Xaa is any aa, unknown, or other
  misc_feature (91)..(91): Xaa is any aa, unknown, or other
MQIFVKTLTGKTITLEVESSDTIDNVKAKIQDKEGIPPDQQRLIFAGKQLEDGRTLADYXIQKESTLHLGLRLRGGMQIFVKTLTGKTITXSRWSLLTPIDTSRARIRNREAFLRKQEGFIFCWQELQGGGDAWPITNFEGKPPPTWGVGSQRGDVEIFRENL

SEQ ID NO: 14998 - DNA, 657 bp, Zea mays
  misc_feature: Ceres CLONE 1377227-F
  misc_feature: Encodes the peptide sequence at SEQ ID NO. 14999
  misc_feature (435)..(435): n is a, c, t, g, unknown, or other
  misc_feature (454)..(454): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (510)..(510): n is a, c, t, g, unknown, or other
tccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgctctctgccgtcgtcgccaccctccgggccgccaattcccggtggtggacctctcggtgacgcggcgcgaggacctagtcgagcaggtgagcacgcggcccgggacggtgggcttcttnctggctgtgaaccacggcngtggcggaggagctgatggtcgcatgccttcccggnnntgcgcagttcacaggggnccccggggaggggaaaaccagggcctccaatcaagggactgggttgggaaccggggttcctcctcaaattccaccctcttaaggggcggtgggggccgaatgggagaaaagtcctttttgggaggggggttccaaacccacggcttg

SEQ ID NO: 14999 - protein, 79 aa, Zea mays
  misc_feature: Ceres CLONE 1377227-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPALSAVVATLRAANSRWWTSR

SEQ ID NO: 15000 - DNA, 679 bp, Zea mays
  misc_feature: Ceres CLONE 1377228-F
  misc_feature: Encodes the peptide sequence at SEQ ID NO. 15001
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (526)..(526): n is a, c, t, g, unknown, or other
  misc_feature (527)..(527): n is a, c, t, g, unknown, or other
  misc_feature (597)..(597): n is a, c, t, g, unknown, or other
  misc_feature (642)..(642): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcccatcctggccccgnnnngggggggnncgccgcgtccaagcttgggcggccgtgcacccacgtgcgcgcctggcgccacgacagcctggccaccaancggccgcgtcgtcgcttcatcgcctgggccaatcacggcgctcgncccttcggctggccctgtgaaaggagatcccacatcg

SEQ ID NO: 15001 - protein, 109 aa, Zea mays
  misc_feature: Ceres CLONE 1377228-F
  misc_feature (14)..(83): Pfam Name: AWPM-19 Pfam Description: AWPM-19-like family
  misc_feature (62)..(62): Xaa is any aa, unknown, or other
  misc_feature (65)..(65): Xaa is any aa, unknown, or other
  misc_feature (89)..(89): Xaa is any aa, unknown, or other
  misc_feature (104)..(104): Xaa is any aa, unknown, or other
MAGIGRNMVAPLLVLNLIMYIIVIGFASWNLNHFINGQTNYPGVAGNGATFYFLVFPSWPRXGGXRRVQAWAAVHPRARLAPRQPGHQXAASSLHRLGQSRRSXLRLAL

SEQ ID NO: 15002 - DNA, 760 bp, Zea mays
  misc_feature: Ceres CLONE 1377229-F
  misc_feature: Encodes the peptide sequence at SEQ ID NO. 15003
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (73)..(73): n is a, c, t, g, unknown, or other
nnnnnccccccccccccnncnccccncnncccccccccccctcccacccccccgcccacgcggtggggatggnggctccccgcggtggcggccgctctagaactagtggatcccccgggctgcaggaattcgcacgagaccattacctagaacatcctaatcgaaaaagatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggggctctccagtacatcagggggggggatcctcttcgagggaagaacccctggaccagaaagaccaagggatgggaaggccttttggtggatggccctcaagggaggggaggggggcctccccctgggcatcaaggggtggacaagggccccccttttgggggggttggtggggcacctgggttagggagaaacccccccccccccagaggggccttggaacgacccttttgggtgaaagggg

SEQ ID NO: 15003 - protein, 144 aa, Zea mays
  misc_feature: Ceres CLONE 1377229-F
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYIRGGDPLRGKNPWTRKTKGWEGLLVDGPQGRGGGPPPGHQGVDKGPPFGGVGGAPGLGRNPPPPRGALERPFWVKG

SEQ ID NO: 15004 - DNA, 720 bp, Zea mays
  misc_feature: Ceres CLONE 1377231-F
  misc_feature: Translation starting site: 343
  misc_feature (620)..(620): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactaccgcgagtgccactgtgccgcagctgcctgctcgccattactgcaagctgtgttcaatcaaaacttaattaggctccctctacatctgatccacctaagtagctaaccagcactacagaagggcgtgggaacaatcaggagagagataccatgtctgctagctagctgagctcgtgcgacgaaaaatgcacgaaattggaactaacatggtgccgccgctcctggtgctcaacctcatcatgtacatcatcctcatcgacttcgcgagctggaacctgaaccacttcatcaaagaccagaccaactaccccgcaactgtacggaaacggtgccgaacgctctacttcctagccgtctccatcctggcgaaagagaggttgcgcgggcaccctacttgtctcaataacccctcctatggctggtccctatgcacctgctgaacctatgcaaccagctgctctgngccctccagcagcaaactttggtgtctcggctgctgcgaaaatcaatgtcgacgcctctctggccgggggcataatgggcaaggtgggggtcaacactaa

SEQ ID NO: 15005 - DNA, 724 bp, Zea mays
  misc_feature: Ceres CLONE 1377232-F
  misc_feature: Encodes the peptide sequence at SEQ ID NO. 15006
  misc_feature (482)..(482): n is a, c, t, g, unknown, or other
  misc_feature (497)..(497): n is a, c, t, g, unknown, or other
aagctggagctccccgcggtggcggccgctctagaactagtggatcccccgggctgcaggaattcgcacgagaccattacctagaacatcctaatcgaaaaatctatccacctttccaccgtcaccatggccaccgccactacgtccgcctatcattgcaacgccggcctctaccttcccagacctccgcagttccgccggctcctgccccctctcccctccctcgtcacccgcagagccgcgagcgtcgggctgggggtcgcccgtctcggttcgagggcgagggcaagggcaagttccgtaccgccaccgccaccattttttgaaaccgtggagcacgaggaggacgaggacgaggagcgcgtgtgttcagatgcggaggcggtattcagtgacgagccagaggatgatcatgagtgttcgggcggcaacggcgcgaagcgcgtagagcacctgggcgcggacgccgtcgagacttaggnggtgtgggccgcagnatggttcgagcccgcgggatctcgtggtgtgcaaccctgcttcaccgtcgagacatgcaggacctgctctgggtacttatcggctcagggaccctacctctcagtagaaatctcaacatatgccgcactgcagagttaacctaaggatggcttctggaaaaagatgggatgcctcccccaggcttcaggaaacaataaatggttcgttctaaaatgaagccgtttgc

SEQ ID NO: 15006 - protein, 117 aa, Zea mays
  misc_feature: Ceres CLONE 1377232-F
MATATTSAYHCNAGLYLPRPPQFRRLLPPLPSLVTRRAASVGLGVARLGSRARARASSVPPPPPFFETVEHEEDEDEERVCSDAEAVFSDEPEDDHECSGGNGAKRVEHLGADAVET

SEQ ID NO: 15007 - DNA, 777 bp, Zea mays
  misc_feature: Ceres CLONE 1377234-F
aagctggagctccccgcggtggcggccgctctagaactagtggatcccccggtgtgcaggaattcgcacgagaccattacctaaaacatcctaatcgaaaacccaacctcatcttctctccctttgctcggaacgcacacaccgcccggactccgatctccgatccccgatcccctcgtcgatccaagatggagatcttcgtcaagactctcactgcaaagactatcaccctcgaggttgttgtcctctggcaccattgacaacatcatggacaaaatcagtatgatgtagggcattcccccgatccaaatatgagtcatcgtcgatagtataacatcttgagcatgcaagtgacttgtctacttacatcttcagcaaggaaagccccctccaccctggtcccccgcctccaggaagggtatggaaaaactttcctttgaccctccaggggaaaaactttcacccccaagggggggacttgttgggcctcctttaaaacaagactgggtattatacctattgaaggggggtgtcttccctctcgctacggcaagtaaatttttttttggaaattatatgtttaagaagtattgtttaggaggaaacacaaactttcatgagggaggaacctccccccgtggggatttttcctgctgttagttgtatattttctgggatcacactagggggaataacaaccctaggggaagggcctctgccaacccaaaggcgtggagggtacttctcataacgggtgagtcctccttccaaaattga

SEQ ID NO: 15008 - DNA, 723 bp, Zea mays
  misc_feature: Ceres CLONE 1377236-F
  misc_feature: Encodes the peptide sequence at SEQ ID NO. 15009
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcgaaaaaatgccactgtgagtctgtgaccacaccaaacgccggcggagtcgtcagtcgtgcgtgcccgtcccgttctgcccccacctcccctcccccgactccctcactcttcctcttccgttccatttcaagatccctgcagccgtccgtccatccatccatccatccatccgttaagaggagaggggaagccggccggccggccggccggtggagcggagatgagggggcagacagagacaggccggtggcgaggaggcgacggcgctgcggcgtggtgggtggccgtggtggccctgcagctgggccattcactgagccgcgcgcgggcggggctgctggagtccaacccgggcctggcctacaacttctaccagagcagctgccccagcgcggagtccatcgtccgcagcgtcacctgggcgcaggtcgccgccgaccccgcgctcccggnccgcctcctccgcctccacttccatgactgcttcgtcaagggctgcgacgcgtcgatcctgctggacaacgcgcagagcgagaagacggcggcgccgaacctgtcggtgggcgggtacgaggcgatcgactccatcaaggcgcaggtggagaaagcgtgcccgggggtggtg

SEQ ID NO: 15009 - protein, 135 aa, Zea mays
  misc_feature: Ceres CLONE 1377236-F
  misc_feature: SWISSPROT Homolog: EC 1.11.1.7 Peroxidase
  misc_feature (78)..(78): Xaa is any aa, unknown, or other
MRGQTETGRWRGGDGAAAWWVAVVALQLGHSLSRARAGLLESNPGLAYNFYQSSCPSAESIVRSVTWAQVAADPALPXRLLRLHFHDCFVKGCDASILLDNAQSEKTAAPNLSVGGYEAIDSIKAQVEKACPGVV

SEQ ID NO: 15010 - DNA, 668 bp, Zea mays
  misc_feature: Ceres CLONE 1377241-F
  misc_feature: Encodes the peptide sequence at SEQ ID NO. 15011
  misc_feature (316)..(316): n is a, c, t, g, unknown, or other
  misc_feature (396)..(396): n is a, c, t, g, unknown, or other
  misc_feature (533)..(533): n is a, c, t, g, unknown, or other
  misc_feature (552)..(552): n is a, c, t, g, unknown, or other
  misc_feature (582)..(582): n is a, c, t, g, unknown, or other
  misc_feature (621)..(621): n is a, c, t, g, unknown, or other
  misc_feature (642)..(642): n is a, c, t, g, unknown, or other
  misc_feature (643)..(643): n is a, c, t, g, unknown, or other
  misc_feature (650)..(650): n is a, c, t, g, unknown, or other
gcggtggcggccgctctagaactagtggatcccccgggctgcaggaattcgcacgagaccattacctagaacatcctaatcgaaaaatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggcgtgaggaaangggggaaacttgaggaggaggaggacgacgagaaggatctcgagcagggggaacccgggccgaggatggaggagcgtcgncgagcaggagcgccgagacgaagactcgcccgcggtcgggggacggcccaaagcgccgccgcgaccccggtgaagggaggatgaggagcccgaggagctagagctgcaaacggaggatccccgtggaggagggatcnccgatggcggggccgtaanctgtagggggaccccggtcagatcactggncaaggggaagaagcagaagaagcactatgctttcctccnagtacgagggcaacagcttcnnagctggnaggaccccgtgcttctcc

SEQ ID NO: 15011 - protein, 57 aa, Zea mays
  misc_feature: Ceres CLONE 1377241-F
MGRRRRFAQLDDDDDDDEDVPINFKPSGGASSSDAKPRKPQPPPQQRRGVSDDDDEA

SEQ ID NO: 15012 - DNA, 678 bp, Zea mays
  misc_feature: Ceres CLONE 1377242-F
  misc_feature: Encodes the peptide sequence at SEQ ID NO. 15013
  misc_feature (489)..(489): n is a, c, t, g, unknown, or other
  misc_feature (555)..(555): n is a, c, t, g, unknown, or other
  misc_feature (599)..(599): n is a, c, t, g, unknown, or other
  misc_feature (625)..(625): n is a, c, t, g, unknown, or other
  misc_feature (637)..(637): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnagggggcgagtgccggcgccagtgcctgcgccgccacgagggccagccgtgggagacccaggaagncatgaggcggtgccgccgccgccggactggccgtcgactggagncaagagtacggtcgcggcagcgaagncgcggtcagtgnccccggaagaagttgcgagcccacaccgcgggggaatgtgg

SEQ ID NO: 15013 - protein, 155 aa, Zea mays
  misc_feature: Ceres CLONE 1377242-F
  misc_feature (114)..(114): Xaa is any aa, unknown, or other
  misc_feature (129)..(129): Xaa is any aa, unknown, or other
  misc_feature (138)..(138): Xaa is any aa, unknown, or other
  misc_feature (142)..(142): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGRVPAPVPAPPRGPAVGDPGXHEAVPPPPDWPSTGXKSTVAAAKXRSVXPEEVASPHRGGMW

SEQ ID NO: 15014 - DNA, 856 bp, Zea mays
  misc_feature: Ceres CLONE 1377243-F
  misc_feature: Translation starting site: 314
  misc_feature (20)..(20): n is a, c, t, g, unknown, or other
  misc_feature (21)..(21): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (856)..(856): n is a, c, t, g, unknown, or other
gggggggggggggggggggnntttttcttantttnnnatcccgggnnatttaataaagatggagctccccgcggtggcggccgctctagaactagtggatcccccgggctgcaggaattcgcacgagaccattacctagaacatcctaatcgaaaaacttcctcgcagcggcggcgctccatcttccgctccctcccccaccttcgatcggcacgcaggctcggcgtcgtcgtcagcggttcctcctcccgcctctcgccagtagactcgcgccctcgccgactggcgaccctgccttgaaggggctggcaagatgatcggcgtagggaaggcgaagcagtacgccaacgtccttgacaagcccctcagccgtggcaggcaggaggtcaggttgagggggatttggattccttgttctcggcagttggttcggggagacccagactccaggttgaacaacattaactgggagccggaaccggggggtgggagggatgccggttaaatggtgggggagggcaaggggtgggttaaaaaaaacctcgggccccaggggaggagggggaaaataagcccgcagggggcccggcccttcccgggggggatttatatatcctttctcccacccagggaacagggttgggaaaaagggggggtgggtttggaaaaaaggggcctgttgggcccgctgggtgagacgcggggccccgcagaccgccgggaggcgaggaaagggggggctcccgggggaaaagggcggcctcttcttggaacaggcgttcccgtttctgcggaggcgccacagaagaccccggggcgccacacatctcagcggtataaatcccacgccccgtcn

SEQ ID NO: 15015 - DNA, 706 bp, Zea mays
  misc_feature: Ceres CLONE 1377244-F
  misc_feature: Encodes the peptide sequence at SEQ ID NO. 15016
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggaatgcatgaggcggtgccgccgccgcggactggccgtcgacatggagcaagagtacggtcgcggcagcgagagcgcgggcaagtgccgggagaggtgcgagcgccacacccgcgggactggtgggagagcagcgctgctgtgtgaaaaaaaacgg

SEQ ID NO: 15016 - protein, 164 aa, Zea mays
  misc_feature: Ceres CLONE 1377244-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMEQEYGRGSESAGKCRERCERHTRGTGGRAALLCEKKR

SEQ ID NO: 15017 - DNA, 737 bp, Zea mays
  misc_feature: Ceres CLONE 1377248-F
  misc_feature: Encodes the peptide sequence at SEQ ID NO. 15018
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (43)..(43): n is a, c, t, g, unknown, or other
  misc_feature (44)..(44): n is a, c, t, g, unknown, or other
nnnnnnnnnnnnnnnnnnnnnnnnggtttttaggggggacccnnccccaacactggggctccccgcggtggcggccgctctagaactagtggatcccccgggctgcaggaattcgcacgagaccattacctagaacatcctaatcgaaaaagagaccattcacaacttcagctgcgcctcgactcgtagcccgaaccctagccaccaagccggaggcgagagagcagccatggcgcggtgcctcgcgctcgtcgccctcctcgtactcggcctcgccgccgccgccgcctccgcggccgacgcgcccttcgtcgtcgcgcacaagaagatttcgctctcccgccccaagccgggcgtcgagcgcgtcgccgtctccgtcgacctctacaaccagggatccgcgactgcctatgatgtgtccattaatgacgactcttggccaacagaagtgtttgagcttgtcactggagagaaatcgaagagattggaaaggttgggaccctggtgccactgcttcacacacatatgtcctggagaccaaaacacagggcaggttccagggttcaccagctatcattacataccgtggtcccacaaagacagctcttcaggaggcatactcaactccccatcttcccactggatattctcgctgagagacctccagagaagaagtttgaatggcctaagaggcttgtgatgaaatacgggacactggtgtctggtggtctctttgc

SEQ ID NO: 15018 - protein, 156 aa, Zea mays
  misc_feature: Ceres CLONE 1377248-F
  misc_feature (10)..(151): Pfam Name: TRAP_beta Pfam Description: Translocon-associated protein beta (TRAPB)
MARCLALVALLVLGLAAAAASAADAPFVVAHKKISLSRPKPGVERVAVSVDLYNQGSATAYDVSINDDSWPTEVFELVTGEKSKRLERLGPWCHCFTHICPGDQNTGQVPGFTSYHYIPWSHKDSSSGGILNSPSSHWIFSLRDLQRRSLNGLRGL

SEQ ID NO: 15019 - DNA, 655 bp, Zea mays
  misc_feature: Ceres CLONE 1377249-F
  misc_feature: Encodes the peptide sequence at SEQ ID NO. 15020
tccccgcggtggcggccgctctagaactagtggatcccccgggctgcaggaattcgcacgagaccattacctagaacatcctaatcgaaaaagttcctgccctatcgtcgtgtctaccctcctcaaatcctacaccacgccccccggcccccagaccccggccttctaccaacccgagagcgcatcggcggcgcagaaccggaccctggcgtggggttgatcaccccgctcggcgtcgcccggcgacgtcggcgcctttgatgtatcctacctgcgagctcggattcctctgcccccggtcgcacaagagctcccaagaggtcccccgagccaccgcttccggcgaccagagattggcttccccagcgaagccgagatgagcatgcgacgaatagaagatgatgttgattgtctcctttacggaggacgagagtaagttgttacagggacggcgcctctgaagccaactaatagtgtcggcaaagaatgggaacgtacggagatccaggttggcagcctgaagttgccagagctgaatttagagaaaaatctactatcagagttgttcttcctgcaaaatcactagaggcgacagcagtgccatctataaggagaagtgctgtaatcatcgatagaaagctgcagggtgcagcct

SEQ ID NO: 15020 - protein, 72 aa, Zea mays
  misc_feature: Ceres CLONE 1377249-F
PRGGGRSRTSGSPGLQEFARDHYLEHPNRKSSCPIVVSTLLKSYTTPPGPQTPAFYQPESASAAQNRTLAWG

SEQ ID NO: 15021 - DNA, 667 bp, Zea mays
  misc_feature: Ceres CLONE 1377253-F
  misc_feature: Translation starting site: 197
  misc_feature: SWISSPROT Homolog: EC 5.2.1.8 Peptidylprolyl isomerase
  misc_feature (414)..(414): n is a, c, t, g, unknown, or other
  misc_feature (486)..(486): n is a, c, t, g, unknown, or other
tggagctccccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggnagctggacggccgcaacatcaccgtcaacgaggcccagtcccgcggcggccgtggaggcggcggcggtgggntaaacggtggtggccgtggaggcggcggctacggcggtggcgggcgccgtggatggcggtggcggctacggcggtggcggcggctacggtggcggcggggctaccgggggtgggtggcgggggttacggcggtggcaaccgtggcggcggctacgcaactccgacggggactgggggactg

SEQ ID NO: 15022 - DNA, 737 bp, Zea mays
  misc_feature: Ceres CLONE 1377256-F
  misc_feature: Encodes the peptide sequence at SEQ ID NO. 15023
  misc_feature (329)..(329): n is a, c, t, g, unknown, or other
  misc_feature (330)..(330): n is a, c, t, g, unknown, or other
  misc_feature (346)..(346): n is a, c, t, g, unknown, or other
  misc_feature (459)..(459): n is a, c, t, g, unknown, or other
aaagctggagctccccgcggtggcggccgctctagaactagtggatcccccgggctgcaggaattcgcacgagaccattacctagaacatcctaatccaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctgnngtcggggcggccaggnccgtctcccaggaggcctacgtcgtcaccgtcgagggctttcaggagactcgtccgggctagacgcccggacgcggagcgggagccatttcctcagcatcagaggtgacgacngcccagaggtcgctcgacgcagtggtatgtcacaaacatagctcaaagttggaattccgtgggggaaattcataatgggtttcccccccccccccccttgacaattttgaggaaaaaagggcgggaaaggggccttcccgggggggtttgggacccgaaacttaccaggggttcccaaaccccttgggagggcccggggttcccccctgggaaaaaagggcccttcggggggccctttggggggggggggggggcccccggggggcccccccgccccc

SEQ ID NO: 15023 - protein, 66 aa, Zea mays
  misc_feature: Ceres CLONE 1377256-F
  misc_feature (41)..(41): Xaa is any aa, unknown, or other
  misc_feature (47)..(47): Xaa is any aa, unknown, or other
MSTLDTRTLKDELTSMDRKCLVDLGHPLLNRVADSFIRAAXVGAARXVSQEAYVVTVEGFQETRPG

SEQ ID NO: 15024 - DNA, 636 bp, Zea mays
  misc_feature: Ceres CLONE 1377260-F
  misc_feature: Encodes the peptide sequence at SEQ ID NO. 15025
gctctagaactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcatcgcacagtgtctgtatctagtctgtctctcttgtggcctggttgcaacgggaatggcgacatcacctcctccgtggcccttgctgctgctggtcctgcgcgagctgatgatgtgctccttctacgtcggtcagcttgaatcagaagctgacacatcacgtgtggcgacgagagaggcaaggtcctggacaacgagaggctgctgacgctgtcggtggaccgcacgtccggctccgtgatccagtcccggcacgagtacctgttcgacaagatcgacatgcacttgcggctggtgacggacaactccgccggcaccgacaccgcctactacctgtctgcgcacgacgtcgcgcacgacgagatccacttcgagctcctgaacaacgtgaacgccgagccctacacgctgtacagcaacgtgtgcacgcgaggacagcaccagaggacaactgcagctccgactactgactcgacgccgccgccgaca

SEQ ID NO: 15025 - protein, 70 aa, Zea mays
  misc_feature: Ceres CLONE 1377260-F
  misc_feature: SWISSPROT Homolog: EC 2.4.1.207 Xyloglucan:xyloglucosyl transferase
MHLRLVTDNSAGTDTAYYLSAHDVAHDEIHFELLNNVNAEPYTLYSNVCTRGQHQRTTAAPTTDSTPPPT

SEQ ID NO: 15026 - DNA, 753 bp, Zea mays
  misc_feature: Ceres CLONE 1377260-R
  misc_feature: SWISSPROT Homolog: EC 2.4.1.207 Xyloglucan:xyloglucosyl transferase
  misc_feature (13)..(13): n is a, c, t, g, unknown, or other
  misc_feature (17)..(17): n is a, c, t, g, unknown, or other
  misc_feature (22)..(22): n is a, c, t, g, unknown, or other
  misc_feature (45)..(45): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (55)..(55): n is a, c, t, g, unknown, or other
  misc_feature (56)..(56): n is a, c, t, g, unknown, or other
gggggaggtattngttngtgtnttttggtgtgtggctttggtgtnttttgnnngnnggggccgattgggtaccgggccccccctcgaggtcgacggtatcgataagcttttttttttttttttttggaacaactttttttttgatggggaggacgagtataatacagacacgagacacgacgaacacgaacagcgcgcggcggcagactacgtacaccgtacacgtaccaacagggtgggcgaggacgaggaggctacaagaacacaggcagcagaagaatttcttaccaccacaccacgcacgcaccagctactgcgttacaaatcgtcaagtcctttatttatctaccatgtttcgatgcctttcgtcttgccttgatccggtgatcgacaccgatcgtcgtagcggtagcagtagagcggaccacatgcacacacacgcgcgcgcgcgccattgttggacgggcgaggaataaccgggcgctactgcatggagcactcggcggggaggccctgctgggagcgcttggggtccgtgcagtagttgtagattaggtactttcgcagcacccggcgcatccgctgctgcacggtgagggccagctcccgggttggttaccaattcccatgcacttggcttgacggaatggcggggggataccggtgttccctactgagtcccaaaaagtcgcccatcttacaacgggttgcaatgacatcccctgggtatggggcaaatctctcattgtgtgg

SEQ ID NO: 15027 - DNA, 675 bp, Zea mays
  misc_feature: Ceres CLONE 1377271-F
  misc_feature: Encodes the peptide sequence at SEQ ID NO. 15028
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (415)..(415): n is a, c, t, g, unknown, or other
  misc_feature (467)..(467): n is a, c, t, g, unknown, or other
  misc_feature (480)..(480): n is a, c, t, g, unknown, or other
  misc_feature (483)..(483): n is a, c, t, g, unknown, or other
  misc_feature (498)..(498): n is a, c, t, g, unknown, or other
  misc_feature (536)..(536): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (567)..(567): n is a, c, t, g, unknown, or other
  misc_feature (611)..(611): n is a, c, t, g, unknown, or other
tggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggcagccgtccacgccgcccccgccgcctcggcgccggcgccagcgcgcgcgacgccgcgctcaccgcctccgtgcaggacgnnnnncaaaggaggagcggaggaagaaggaggaactccgtggaggccgacccggacgcggacgancgtctggcgcgggctgcagcagcagcgggagcgggaggcgtggctgcggcgngcgcgaggccgcnggntggtggtcgccggcngaggaggggtcccctccggacgcctccgccggctcggnggagagcggcggnnngggggtagggcgcggnagcctgaccgacgacgacctgtaggagctcaaggggtgcggggnatctgggggatcgggtttcagcttaccgagagatcccccgaggctgggcggccactgctggcgg

SEQ ID NO: 15028 - protein, 133 aa, Zea mays
  misc_feature: Ceres CLONE 1377271-F
  misc_feature (55)..(55): Xaa is any aa, unknown, or other
  misc_feature (56)..(56): Xaa is any aa, unknown, or other
  misc_feature (76)..(76): Xaa is any aa, unknown, or other
  misc_feature (93)..(93): Xaa is any aa, unknown, or other
  misc_feature (116)..(116): Xaa is any aa, unknown, or other
  misc_feature (121)..(121): Xaa is any aa, unknown, or other
MWSSGSDRDEALDTANASSVDASSPARQPSTPPPPPRRRRQRARRRAHRLRAGRXXKEERRKKEELRGGRPGRGRXSGAGCSSSGSGRRGCGXREAAGWWSPAEEGSPPDASAGSXESGGXGVGRGSLTDDDL

SEQ ID NO: 15029 - DNA, 676 bp, Zea mays
  misc_feature: Ceres CLONE 1377278-F
  misc_feature: Encodes the peptide sequence at SEQ ID NO. 15030
  misc_feature (422)..(422): n is a, c, t, g, unknown, or other
  misc_feature (423)..(423): n is a, c, t, g, unknown, or other
  misc_feature (430)..(430): n is a, c, t, g, unknown, or other
  misc_feature (432)..(432): n is a, c, t, g, unknown, or other
  misc_feature (433)..(433): n is a, c, t, g, unknown, or other
  misc_feature (435)..(435): n is a, c, t, g, unknown, or other
  misc_feature (457)..(457): n is a, c, t, g, unknown, or other
  misc_feature (486)..(486): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagaaatgatggtggcggcagctctgctggccttggccctggccgtgtcgaccgccgaggcgaggaacatcaagaccacgacgacggaaaagaaggacgacgcggtggtgcagccgcagaccttcccgcccttcgaccnngctcggngnngncgcgtccccggcgttcggcggnctcccccggcgacagcattctggcagagnaattccccgggtcagcatggccgggagcgcagaaccctaacccgggttcagtttgccggaggatggcccccttttttngtggtgggggggggtcccccggggttttaggggtttcggggggtgggggcggggcccccccgggggggtttctgccccgggaaagccaaaagcccggaggcaaaaagggtgg

SEQ ID NO: 15030 - protein, 101 aa, Zea mays
  misc_feature: Ceres CLONE 1377278-F
  misc_feature (45)..(45): Xaa is any aa, unknown, or other
  misc_feature (48)..(48): Xaa is any aa, unknown, or other
  misc_feature (49)..(49): Xaa is any aa, unknown, or other
  misc_feature (57)..(57): Xaa is any aa, unknown, or other
  misc_feature (66)..(66): Xaa is any aa, unknown, or other
  misc_feature (92)..(92): Xaa is any aa, unknown, or other
MMVAAALLALALAVSTAEARNIKTTTTEKKDDAVVQPQTFPPFDXARXXRVPGVRRXPPATAFWQXNSPGQHGRERRTLTRVQFAGGWPPFXVVGGGPPGF

SEQ ID NO: 15031 - DNA, 669 bp, Zea mays
  misc_feature: Ceres CLONE 1377279-F
  misc_feature: Translation starting site: 525
  misc_feature: SWISSPROT Homolog: EC 3.2.1.14 Chitinase
  misc_feature (314)..(314): n is a, c, t, g, unknown, or other
  misc_feature (376)..(376): n is a, c, t, g, unknown, or other
  misc_feature (390)..(390): n is a, c, t, g, unknown, or other
  misc_feature (622)..(622): n is a, c, t, g, unknown, or other
tccccgcggtggcggccgctctagaactagtggatcccccgggctgcaggaattcgcacgagaccattacctagaacatcctaatcgaaaaatcacctcagtatttgtcagaagctcaaatactgatctcactgatccagtatggctatggcaaaggcaggcgcgccgagggtctcggcggcccagctggtgactctcgggctatcacttcctctgcgctgtcgccggcccggccgccgcgcagaactgcggctgccagccaaacgtatgctgcagcaagtttggctactgcggcacgaccgacgagtactgcnggcgacgggtgccagtcgggcccgtgccgctcgggcggcggcggcagcagtgggcggcggtnggtgcgaacgtggnttagcgtcgtcaccggctccttcttcaacggcattcaaagccaggcccggggagcgggggtgcgaagggcaagaacttctacaccccggagcgcgttccctgagcgcccgtcaaggcgtacccaggttccccccatgggggggtccccacaaggtgcaggcaaaaagcgcggagatcgccgcccttttttcgcgcacgccacgcacgagaaccgggggcatttctgctccantttcagcgagatcaacaagagcaacgcctactgcgcccgaccaaaaa

SEQ ID NO: 15032 - DNA, 657 bp, Zea mays
  misc_feature: Ceres CLONE 1377280-F
  misc_feature: Translation starting site: 226
  misc_feature (646)..(646): n is a, c, t, g, unknown, or other
cgcggtggcggccgctctagaactagtggatcccccgggctgcaggaattcgcacgagaccattacctagaacatcctaatcgaaaaatcaccatttcgctagctccatagtacttgttccagctagctaggagagagagctttggttaggcggagtatagatgaacacggaagcaccagactgggactgcagggcgtgccagcacctcaacttcagccgtcgggatgcatgccagcgctgcagcgaaccacgtgcagttgctgatcgcagcggcggcgtcggcgacttggatgcccgtgttggttcctccttcatcggtgagtttggcgctggttctgatgtacgtcctagcagactggtactgctcctgcggagcacaccaattcaccagccgctccaactgcttcaggagctctgcctaccaggaggaggctgccgtagcctttgatagtgatatgtcacgctcatgcggatactccggattcggaagtgctgctgtcgcccgtaccaaccgccccggatgcaagtctggagactggatctgcaccaggtccggttgcaacgagcacaacttcgctagcaggatggaatgtttcaggtgcaacgcgccacggaactccggtagcggtgccacgacgacctacngaaactacttg

SEQ ID NO: 15033 - DNA, 662 bp, Zea mays
  misc_feature: Ceres CLONE 1377287-F
  misc_feature: Encodes the peptide sequence at SEQ ID NO. 15034
  misc_feature (298)..(298): n is a, c, t, g, unknown, or other
  misc_feature (433)..(433): n is a, c, t, g, unknown, or other
  misc_feature (434)..(434): n is a, c, t, g, unknown, or other
ggagctccccgcggtggcggccgctctagaactagtggatcccccgggctgcaggaattcgcacgagaccattacctagaacatcctaatcgaaaaaaaggaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtgngataacctggacgtggtcgataggctcattgacgatgcggaggctcagtacaggaacttccagcaccccgatccctacattgttccatgggcaccaggcggcactaaattcacaagaaacccccctccacctcanngggatcgagatcatctacaattatggcaaggaggaccagtaaacaagagtcctgcaagcggggggcagaacttccacagttccaaatcacttcctggtttaattcgagttgttgtacgagaaataagaatggaaattactggactccatccatgcttctcattttgcttggtctgataatcatgtgctcttcatctagggcatattgggaaggggatgtttcctgtca

SEQ ID NO: 15034 - protein, 56 aa, Zea mays
  misc_feature: Ceres CLONE 1377287-F
  misc_feature (13)..(58): Pfam Name: Complex1_LYR Pfam Description: Complex 1 protein (LYR family)
MASTAGYLARRAAQKERVRLLYRRALKDTLNWAVHRHLFYQDASDLRDKFEANRHV

SEQ ID NO: 15035 - DNA, 682 bp, Zea mays
  misc_feature: Ceres CLONE 1377291-F
  misc_feature: Encodes the peptide sequence at SEQ ID NO. 15036
  misc_feature (433)..(433): n is a, c, t, g, unknown, or other
  misc_feature (472)..(472): n is a, c, t, g, unknown, or other
  misc_feature (512)..(512): n is a, c, t, g, unknown, or other
  misc_feature (682)..(682): n is a, c, t, g, unknown, or other
cgctctagaactagtggatcccccgggctgcaggaattcgcacgagaccattacctagaacatcctaatcgaaaaaccgattcggcaaccgtgctaatcgatatccgtgcaattccacctcccgaaccgaatccctccaccgacccaaaccctagcgcgcacccttctccgtcgtcctttcctggggcgcggggcggtgtcggagatgcggccgctgctcgcggacggcgatatggcactggcggtgtcgccggaggccaacgagtcgtcggatggcgctgcggtgtcgctagggccgttatcgtgggcgtcggactgccacggagtactgtacaacctggccttgatgctgccatcgctggcgctttgtggggttcctggcgtggagcgcgcggcggagcttccgtagcctcagctacggccgtctccacgntcgttgtcgtcgggcactacgcgctccctctgggatcgntcgacgtagtcaatcctcctctggtggcttcgctggaggncatggggaatgtatgctctgacagagtattcctcttgggaatggacttgtcactggttacaaaatcatgaaatggatattccttggggagtaaggtctcatacgcctttctacttcaaggaagggttgcccaggggttctagaatctttggaacgggacgtattgttgtn

SEQ ID NO: 15036 - protein, 67 aa, Zea mays
  misc_feature: Ceres CLONE 1377291-F
MRPLLADGDMALAVSPEANESSDGAAVSLGPLSWASDCHGVLYNLALMLPSLALCGVPGVERAAELP

SEQ ID NO: 15037 - DNA, 653 bp, Zea mays
  misc_feature: Ceres CLONE 1377292-F
  misc_feature: Encodes the peptide sequence at SEQ ID NO. 15038
  misc_feature (606)..(606): n is a, c, t, g, unknown, or other
tccccgcggtggcggccgctctagaactagtggatcccccgggctgcaggaattcgcacgagaccattacctagaacatcctaatcgaaaaaggagaaaaaccatcccactccaatcttcgaagggtcgaactaggcccgtcagagaatcagagctctgaggctgctcacatcaggccaccaccaacccctcacgtcggcggtggcgtcgtcggcgaaggcagagatggcgtccgtggccgcggcggaggtcgcggcggcggcgctccggtcggtgctgtcgcgcgcgcaacaggcggcggcgcggtcggggcgcgcgccggggtccgtgcgcgtggtggcggtgagcaagaccaagccggtgcctgtcatccggggcgtctacgacgcgggccaccgctgcttcggcgagaactacgtccaggagctcatcgacgaggcgcctcaccttcctgaggatattgagtgacacttcattggtaatctgcaaagcaacaaagccagagccctacttgctgacgtgccaaatcttgatatggctgagagtgccgaagatgaagagattgctaaccgtcttgatcgagtggtagctgatttgccgagaaancctctttagggtttcggccaagtcatcactagtgcagaagtatcgat

SEQ ID NO: 15038 - protein, 80 aa, Zea mays
  misc_feature: Ceres CLONE 1377292-F
MASVAAAEVAAAALRSVLSRAQQAAARSGRAPGSVRVVAVSKTKPVPVIRGVYDAGHRCFGENYVQELIDEAPHLPEDIE

SEQ ID NO: 15039 - DNA, 659 bp, Zea mays
  misc_feature: Ceres CLONE 1377294-F
  misc_feature: Encodes the peptide sequence at SEQ ID NO. 15040
  misc_feature (475)..(475): n is a, c, t, g, unknown, or other
ctagaactagtggatcccccgggctgcaggaattcgcacgagaccattacctagaacatcctaattgaaaactcgcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagccggaccagagggaacgcgtcgggtgctgtggacgggnagccaaggacgtgggcaagggcttccgctgcatccgcatggtcaacaacacccgcctcaacttcgacgccttccacggcgacaggacccccgggggggggggcacgagggaccccgccgtcggggtcttttgggaggtggtggcaagggcgagaaacaagagctggaaatcccctgggcggggg

SEQ ID NO: 15040 - protein, 175 aa, Zea mays
  misc_feature: Ceres CLONE 1377294-F
  misc_feature (115)..(115): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSRTRGNASGAVDGXPRTWARASAASAWSTTPASTSTPSTATGPPGGGARGTPPSGSFGRWWQGRETRAGNPLGG

SEQ ID NO: 15041 - DNA, 631 bp, Zea mays
  misc_feature: Ceres CLONE 1377298-F
  misc_feature: Encodes the peptide sequence at SEQ ID NO. 15042
  misc_feature (458)..(458): n is a, c, t, g, unknown, or other
  misc_feature (459)..(459): n is a, c, t, g, unknown, or other
  misc_feature (484)..(484): n is a, c, t, g, unknown, or other
aagctggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccaccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctgggtcagtcacaagggacatgcttgcannatgagggtgtcccgtcttttctacnagggttttgtcttgccggattgcgtgaagcaaagggaagtaaaccaactggtccgtcttggaacccccttttaggggtctaaaaataaaaaaaaggggtttttaaaaaaaatggaggggggaaaccctttttcccttttatatttaa

SEQ ID NO: 15042 - protein, 68 aa, Zea mays
  misc_feature: Ceres CLONE 1377298-F
MADAKQQQQQPQQAAAAATGVWKTVKPFVNGGASGMLATCVIQPIDMVKVRIQLGEGSAGSVTRDMLA

SEQ ID NO: 15043 - DNA, 672 bp, Zea mays
  misc_feature: Ceres CLONE 1377301-F
  misc_feature: Translation starting site: 198
  misc_feature (517)..(517): n is a, c, t, g, unknown, or other
  misc_feature (581)..(581): n is a, c, t, g, unknown, or other
  misc_feature (602)..(602): n is a, c, t, g, unknown, or other
  misc_feature (655)..(655): n is a, c, t, g, unknown, or other
  misc_feature (659)..(659): n is a, c, t, g, unknown, or other
  misc_feature (669)..(669): n is a, c, t, g, unknown, or other
  misc_feature (672)..(672): n is a, c, t, g, unknown, or other
ggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaggagcatgacggcgcggtccggggcggcggcgtcagcatggccaacgccgccaacatccccggnaaagtgcggcgtcttcccgtcggcgtgcccatcagcccccaccgtcgactgcaccaagatcaanctgatcgatggacccggaaantgggaggtagctatgcctctgcatgcctcgttgggatgggcagcgtggcatcncaancatgcggggnccn

SEQ ID NO: 15044 - DNA, 699 bp, Zea mays
  misc_feature: Ceres CLONE 1377302-F
  misc_feature: Encodes the peptide sequence at SEQ ID NO. 15045
  misc_feature (338)..(338): n is a, c, t, g, unknown, or other
  misc_feature (344)..(344): n is a, c, t, g, unknown, or other
  misc_feature (364)..(364): n is a, c, t, g, unknown, or other
  misc_feature (391)..(391): n is a, c, t, g, unknown, or other
  misc_feature (392)..(392): n is a, c, t, g, unknown, or other
  misc_feature (409)..(409): n is a, c, t, g, unknown, or other
  misc_feature (420)..(420): n is a, c, t, g, unknown, or other
  misc_feature (427)..(427): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
tacccgcggtggcggccgctctagaactagtggatcccccgggctgcaggaattcgcacgagaccattacctagaacatcctaatcgaagaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacgggcgtcgcaggncgctgnacggtggcgacgctgttccncgctgggcggctgctgctggtgttgtnncggggctgggcgtgagngcctccggggnggggggntttggccgggcccccccccgcggggggtccctgatcttcagccccccgtgctgggtcccccgccgcgctgcttcatccgggacggcgggnnnccatgggtcccctcaccgtcgggggggctgggggggttccttggggggccctgtccctccgctcacggtgcctcgccaacagggggggggggagggcgttccagcgcaccccgggattttagggggggaggagggcgcaccgcaagaaaagggcgagaaggccgcgggcgcacgcgggcc

SEQ ID NO: 15045 - protein, 70 aa, Zea mays
  misc_feature: Ceres CLONE 1377302-F
  misc_feature (50)..(50): Xaa is any aa, unknown, or other
  misc_feature (57)..(57): Xaa is any aa, unknown, or other
  misc_feature (66)..(66): Xaa is any aa, unknown, or other
MADRDRSGIYGGAHATYGQQQQQGGGGRPMGEQVKGMLHDKGPTGVAGRXTVATLFXAGRLLLVLXRGWA

SEQ ID NO: 15046 - DNA, 655 bp, Zea mays
  misc_feature: Ceres CLONE 1377306-F
  misc_feature: Encodes the peptide sequence at SEQ ID NO. 15047
  misc_feature (314)..(314): n is a, c, t, g, unknown, or other
  misc_feature (336)..(336): n is a, c, t, g, unknown, or other
  misc_feature (370)..(370): n is a, c, t, g, unknown, or other
  misc_feature (371)..(371): n is a, c, t, g, unknown, or other
  misc_feature (378)..(378): n is a, c, t, g, unknown, or other
  misc_feature (438)..(438): n is a, c, t, g, unknown, or other
  misc_feature (439)..(439): n is a, c, t, g, unknown, or other
tggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttncaccctacaggatccaacaggncatcacagctggcatcttacctttatcacccttnngtctccnacatcatcagccctatacatcagttacctttggtgcatttattggcacaaaacatcaggnnaacaacactacaaaaacttggggtaagaaaacttggtggcaaactttaaaaaaaggatttttttccatttaacccaaataggggattgaacccgggtcttttttgggaaaaaaaaaaaaaactttttggccggttttgtggtggtaaccccccaaatttttttctctttaaccacggggggagaaaaaaaaccccccccggttttatataaaaaaa

SEQ ID NO: 15047 - protein, 118 aa, Zea mays
  misc_feature: Ceres CLONE 1377306-F
  misc_feature (54)..(54): Xaa is any aa, unknown, or other
  misc_feature (61)..(61): Xaa is any aa, unknown, or other
  misc_feature (72)..(72): Xaa is any aa, unknown, or other
  misc_feature (73)..(73): Xaa is any aa, unknown, or other
  misc_feature (75)..(75): Xaa is any aa, unknown, or other
  misc_feature (95)..(95): Xaa is any aa, unknown, or other
MAAKIFCLLMLLGLSASAATATIFPQCSQAPIASLLPPYLSPAVSSVCENPILXPYRIQQXITAGILPLSPXXLXHHQPYTSVTFGAFIGTKHQXNNTTKTWGKKTWWQTLKKGFFSI

SEQ ID NO: 15048 - DNA, 622 bp, Zea mays
  misc_feature: Ceres CLONE 1377312-R
ccgattgggtaccgggccccccctcgaggtcgacggtatcgataagcttttttttttttttttttaaactaatgtaaacggttgatataactatataagcatcaggctttcagtcgctgtggacaacaaatgcgaggggcagatctgaagggggctagggagggctccagcccccgctacgtccatgaaactggtgaagtatagaggacaaaggagaagaagaaaaatgaacccctactgcattggagaaagaggtggaggatatagaagcaagaagagactatcagcttgtgctgtcttcgccactgccagtaagctttgagaatttaacaatatttggtaatttctgcagtttgaggcaagccttatatagtacaataaatggtgttagcaggcactacgcagtttcataaccactaaagaatgatactccatgtgctgtttggagagcaggaattctcacaagaaaacagtccaatcggcaggtcttggagaaaactatagccttgcaaactgagaccaacagcactgagctcgagccttgcaaccgcgtgtccacgcttcatgggcgatttaacttacagtaaattagcacaatatcgatcgtttttgtttcttgcaa

SEQ ID NO: 15049 - DNA, 674 bp, Zea mays
  misc_feature: Ceres CLONE 1377312-F
  misc_feature: Encodes the peptide sequence at SEQ ID NO. 15050
  misc_feature (443)..(443): n is a, c, t, g, unknown, or other
  misc_feature (497)..(497): n is a, c, t, g, unknown, or other
  misc_feature (578)..(578): n is a, c, t, g, unknown, or other
  misc_feature (609)..(609): n is a, c, t, g, unknown, or other
tccccgcggtggcggccgctctagaactagtggatcccccgggctgcaggaattcgcacgagaccattacctagaacatcctaatcgaaaaggttgctttatattccttctcggctgcaatctgcgtccatctatccagccgtctcggggcgtcgtgtgcgcgtggatctctccgtagaagggatgaagatcacggcgctccttgtgctgaagccgtcgacctccggagccggtagctcctcgtccggcggccagtcgggcccggaggcggtcgtgctcgcgaacgcgacggacgtcagccacttcggctacttccagcgcagcgccgcccgcgagttcatcgtcttcgttgcccgcaccgtcgctcagcgcacccagccaggccagcggcagtccgtccagcacgaagaatataaggttcactcccacaacagaaatgggcntttgtgcggtggcatttatggatgatcactatccctgtacgaagtgcattttcntcttctgaatcaggcttcttgatgagtaccagaaagggcttttggggactcctggaaatctgctactgcagatggaactcnaacagtgggctttcctgacagacgccttggncaagatttcaggacccctgcggaagctgacaaactaatgaaaatttcgagggggacttggatgaa

SEQ ID NO: 15050 - protein, 94 aa, Zea mays
  misc_feature: Ceres CLONE 1377312-F
  misc_feature (87)..(87): Xaa is any aa, unknown, or other
MKITALLVLKPSTSGAGSSSSGGQSGPEAVVLANATDVSHFGYFQRSAAREFIVFVARTVAQRTQPGQRQSVQHEEYKVHSHNRNGXLCGGIYG

SEQ ID NO: 15051 - DNA, 697 bp, Zea mays
  misc_feature: Ceres CLONE 1377313-F
  misc_feature (291)..(291): n is a, c, t, g, unknown, or other
  misc_feature (335)..(335): n is a, c, t, g, unknown, or other
  misc_feature (349)..(349): n is a, c, t, g, unknown, or other
  misc_feature (357)..(357): n is a, c, t, g, unknown, or other
  misc_feature (412)..(412): n is a, c, t, g, unknown, or other
  misc_feature (459)..(459): n is a, c, t, g, unknown, or other
  misc_feature (464)..(464): n is a, c, t, g, unknown, or other
  misc_feature (559)..(559): n is a, c, t, g, unknown, or other
tggagctccccgcggtggcggccgctctagaactagtggatcccccgggctgcaggaattcgcacgagaccattacctagaacatcctaatcgaaaaggaagcttgccgacaactgcactggtctccagggcttcctcgtcttcaacgctgttggcggaggaacaggctctggccttggttccctcctcctggagcgtctgtctgttgactacggcaagaagtctaagcttggtttcactgtgtacccatccccccaagtttcgacctcagtgggttgagccatacaacangtgtcctggtccacccactcccctccttgagcacactgatgtgnctatcctgctggancacgaggncatctatgacatctgccgccgttcccttgacattgagcgcccaacctacaccaancctcacaggcttgtgtcccaggtcatctcatccctgactggctcccntgagntcgatggtgctcttaacgtggatgtgaatgagtcccagaacaacttgggtgccctacccgaggatccccttcatgcttccctcccatgctccagncatccctgctggagagggctacccccaaaaacttgcttggggccccaaataaccaaaagggcctttagagcttccctcatggagggccaaaggggaccccccccctggaaaaaaatggggccgtttgccccaaggacg

SEQ ID NO: 15052 - DNA, 665 bp, Zea mays
  misc_feature: Ceres CLONE 1377314-F
  misc_feature: Translation starting site: 205
  misc_feature (339)..(339): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacagcggcgcccacgccacctacgggcagcagcagcagcagggaggaaggcggcgcccgatgggtgagcaggtgaaggcatgctcacgacaggggccgaccgcgtcncaggcgctgacggtggcgacgctgttcccgctgggccggctgctgctggtgctgtcgggctggcgctgaccgcctccgggtggggctgcccgggcccacccggggttctgatcttcagcccggggtggtccccgccggctgctcatcgggacggcggtaatggggtccctccactcggcgcgctggggctcgggggccggccctccctcacgggctcgccaaacgggggggaggggtcccggggccccccggatacggggagaaggccccccaagatgggggagccccgggcaccgggcccaaaaaccgggaggggggcagggcta

SEQ ID NO: 15053 - DNA, 649 bp, Zea mays
  misc_feature: Ceres CLONE 1377315-F
  misc_feature: Encodes the peptide sequence at SEQ ID NO. 15054
ggagctccccgcggtggcggccgctctagaactagtggatcccccgggctgcaggaattcgcacgagaccattacctagaacatcctaatcgaaaagttatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgagggcggcgacgtcgcgacggaggcggacgacgagttcatgatgcacgagttcaaggtgcggcggtgcgcgcgcgcgcggagccacgactggacggcgtgcccctacgcgcacccgggggaggccgcgcggtgtggggacccgcgccgcgtggcctacgcgtcggagccgtgcccggacttccggcgccccccgggcgcgggcgaagcgtgtccgcgcggacatgctcgtccgatcgggcatgtcaacgtctggacgtttctaagagcgtttcgccatcggaggtgaaag

SEQ ID NO: 15054 - protein, 140 aa, Zea mays
  misc_feature: Ceres CLONE 1377315-F
MVSRENLHLVLDPASLGAPWADPSAAEIPPQLLAALGEYLSSTRAEGGDVATEADDEFMMHEFKVRRCARARSHDWTACPYAHPGEAARCGDPRRVAYASEPCPDFRRPPGAGEACPRGHARPIGHVNVWTFLRAFRHRR

SEQ ID NO: 15055 - DNA, 708 bp, Zea mays
  misc_feature: Ceres CLONE 1377316-F
  misc_feature: Translation starting site: 314
  misc_feature (333)..(333): n is a, c, t, g, unknown, or other
aagctggagctccccgcggtggcggccgctctagaactagtggatcccccgggctgcaggaattcgcacgagaccattacctagaacatcctaatcgaaaaatccagtcgcacctccctctccgaaatcaaggtagcatacaccgctgcagtttctagagccctctctgccactcgtgatcccactagtcacgatgcctgccctcgctaagcccgcctcccgcaccgccagcccgccgcggctccgaagccgaagcctgccgccgccaagccgaaggcggccaccgctggtgcctcccacccccttactcgagatgatcagaggctatcacgncgctaaaggagaggaccggctccagctcgccaggggatccgcaagaatgtgggggacaagcacgggggggcctctgcgggccaatttcaaaaagaggctttccattccagctccgggggcccccacccagggcaaattccggaaagtcaagggttcctaaaaagttcccgaaacccgccaaaaaggcttccccccaaaacaaagtgtaacccggaaaaggccccccgtttgcaaaaacccccgcccccaaccggggcaaggggccccccccccaaatccaaaaaagggaaggggtgtgccaacccaaaaaaaggcccgttgggttggggccaaacgccaaaagggcccccaaaaaaaaggggggggggaaaacca

SEQ ID NO: 15056 - DNA, 684 bp, Zea mays
  misc_feature: Ceres CLONE 1377319-F
  misc_feature: Translation starting site: 472
  misc_feature (684)..(684): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctggcaccgccggtccatgtgccgccgccggttcatctgccgccgccaccatgccactaccctactcaacccgccccgggctcagcctcatccccagccacacccatgcccgtgccaacagccgcatccaagcccgtgccagctgcagggaacctgcggcggtggcagcaccccgatcctggggcagggcgtcgagtttctgaagcatcagggcagcccgacggggacgccctactgctccgctcagtgcccagccgttgcgcagcaggggtgccagcagctcaggcaggtggaggcgcagaaccggtaccaggcgan

SEQ ID NO: 15057 - DNA, 668 bp, Zea mays
  misc_feature: Ceres CLONE 1377323-F
  misc_feature: Encodes the peptide sequence at SEQ ID NO. 15058
  misc_feature (388)..(388): n is a, c, t, g, unknown, or other
  misc_feature (444)..(444): n is a, c, t, g, unknown, or other
  misc_feature (490)..(490): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaagagcttttcttgtgcgcagccgcagccgcagccgctgcttttcgttcgtcttcatcctacgcgagggcgaaacccacaaaccctctccctcccgtactccggcctacacatccaggggcgatgacgctgggtagctccggcgccggatcgagcgtcgtcgttccccgaaacttcaggctattagaggagctcgagcgtggagagaagggcattggtgatggaacagtgagctatggaatagatgatgccgatgacatctacatgcggtcatggactggtaccatcattnggcctcacaatactgtacatgagggtcgcatctaccagctgaaagtgttttgtgancaggactatccggagaaagcaccatctgtcagattcactcaagaantcacatgacatgcgttaatcacgagacaggattggntgatccaaggaagtttggttttgctaacgaaactgggagcgggactaaccgatgggaaaacatcctcccccagttcaaggaaaaaaatggctggctcccaaaatcaaagtaagggagcctcagaggggaatttttttaagga

SEQ ID NO: 15058 - protein, 92 aa, Zea mays
  misc_feature: Ceres CLONE 1377323-F
  misc_feature: SWISSPROT Homolog: EC 6.3.2.19 Ubiquitin--protein ligase
  misc_feature (57)..(57): Xaa is any aa, unknown, or other
  misc_feature (75)..(75): Xaa is any aa, unknown, or other
  misc_feature (91)..(91): Xaa is any aa, unknown, or other
MTLGSSGAGSSVVVPRNFRLLEELERGEKGIGDGTVSYGIDDADDIYMRSWTGTIIXPHNTVHEGRIYQLKVFCXQDYPEKAPSVRFTQEXT

SEQ ID NO: 15059 - DNA, 672 bp, Zea mays
  misc_feature: Ceres CLONE 1377326-F
  misc_feature: Encodes the peptide sequence at SEQ ID NO. 15060
  misc_feature (672)..(672): n is a, c, t, g, unknown, or other
tggagctccccgcggtggcggccgctctagaactagtggatcccccgggctgcaggaattcgcacgagaccattacctagaacatcctaatcgaaaggtacccaatctaatcgacacccggccgagatgggccgcaagttcttcgttggtggcaactggaaatgcaatggaaccacagatcaggttgagaagattgtcaaaaccctgaatgaaggaaatgttccctcttcagatgttgttgaggtcgttgtcagtcctccttatgtgttcctcccggtggtcaagagccagctgcgccaagagttccaagttgctgctcagaactgctgggtgaagaagggaggtgcattcaccggtgaaattagtgctgagatgctcgtcaaccttggcgttccctgggtcattcttggacactctgaaaggagagctctgctgggagaatcaaatgagtttgttggagacaaggttgcttttgctctgtctcagggactaaaggtcattgcatgtgttgggaacaaacccttgaggagagggaggctggttcaaccatggatgtttgttgctgcacaaacaaaaacaattgctgaagaaaatcaaggacttggaagcaacgttggttcttggcctatgaaacccagtctggggttattggaaactggccaaagtcgcccn

SEQ ID NO: 15060 - protein, 182 aa, Zea mays
  misc_feature: Ceres CLONE 1377326-F
  misc_feature (5)..(175): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGNKPLRRGRLVQPWMFVAAQTKTIAEENQGLGSNVGSWPMKPSLGLLETGQSRP

SEQ ID NO: 15061 - DNA, 667 bp, Zea mays
  misc_feature: Ceres CLONE 1377330-F
  misc_feature: Encodes the peptide sequence at SEQ ID NO. 15062
  misc_feature (621)..(621): n is a, c, t, g, unknown, or other
aagctggagctccccgcggtggcggccgctctagaactagtggatcccccgggctgcaggaattcgcacgagaccattacctaaacatcctaatcgaaaagtccttgtgcgttccttgtagccatctccgactccgcgcctccgctgcctcccgaaagcattgccagttcctccgcacaacatgacgcgcatccaccgcctccggcccctcttcctcttcgttctcttggcgtcgctgcaatgcggtgcggcgacggcggcggttggatacggaggtggcgccagagatgttctggctcggcggagccgtccagcaagtgctccggcgatcagccgctctactggaaggtcacccatcccaccctcgcgaccgcgcacctccaagatttacctggcttcacacgtagtgttttcagaagggatcatgctttaataacaccagagagtcatgtattcagtcctttgcctgattgtagtcatacagtaggagcatatctgatcagtccagctatctgggcacacttcagtatgtatctagcagacatgcaaggctgtaaggctcctttaatgaaccaagctgtaagattaacacttgtcagatctgatctcactgacatcccntattatcaccttattgcgatactctgccctaaatgggtgatcaagg

SEQ ID NO: 15062 - protein, 142 aa, Zea mays
  misc_feature: Ceres CLONE 1377330-F
MRCGDGGGWIRRWRQRCSGSAEPSSKCSGDQPLYWKVTHPTLATAHLQDLPGFTRSVFRRDHALITPESHVFSPLPDCSHTVGAYLISPAIWAHFSMYLADMQGCKAPLMNQAVRLTLVRSDLTDIPYYHLIAILCPKWVIK

SEQ ID NO: 15063 - DNA, 908 bp, Zea mays
  misc_feature: Ceres CLONE 1377331-F
  misc_feature: Encodes the peptide sequence at SEQ ID NO. 15064
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
nnnnnnnnnnnnnnnnnnnnnnaaaagggaaacnnnttctttnnncccaaactggcgctccaccgcggtggcggccgctctagaactagtggatcccccgggctgcaggaattcgcacgagaccattacctagaacatcctaatcgaaaacacgcccctcccaacactcccagacccatttccctttccttcccctccggctccgcctcctcgaccactccgacaacccccagcgcctcctctccggcgagctccacctctccaccggcggcggcgagaagcgggggggctaactaagtctgtaggctgcggcggaggtgatcccggagccggagccgagtctagggggatggggcagcagtcgctgatctacccgttcgggggggcgtggcacccgggggggctgggccgagtaacaccggaagttcacccgggaaaaatttccaccaaccattccgcccgcccaaggggccctcaaaaaagcctcccccccgcccagacaaaaaaaaaagggtccaacccgaaacaacgtgggggggaggggccccacacccttttcaaactaaaacctcccgggcgagaggggacggcggattttccaccggaaatttgggcgggaaaagttggcccggggtcggaagaatccacggttggggggggggcaaaaagatccccccccataagagggttttccgcgggggacaaggaagggttaaggggaaagaaactttctcccgcacaaaaaaaaaatgggggaggggcggggaaaaaagaaaagctaaatctggggggggaaggggaaaaaaaccttttggaaacaaggggagacttttgggaaacaaaagggctttaaaagggagcacaacggccctgtacctgggggggggacccccccctcggaggagggg

SEQ ID NO: 15064 - protein, 167 aa, Zea mays
  misc_feature: Ceres CLONE 1377331-F
MGQQSLIYPFGGAWHPGGLGRVTPEVHPGKISTNHSARPRGPQKSLPPAQTKKKGSNPKQRGGEGPHTLFKLKPPGREGTADFPPEIWAGKVGPGSEESTVGGGAKRSPPIRGFSAGDKEGLRGKKLSPAQKKNGGGAGKKEKLNLGGEGEKNLLETRGDFWETKGL

SEQ ID NO: 15065 - DNA, 666 bp, Zea mays
  misc_feature: Ceres CLONE 1377332-F
  misc_feature (347)..(347): n is a, c, t, g, unknown, or other
  misc_feature (368)..(368): n is a, c, t, g, unknown, or other
  misc_feature (417)..(417): n is a, c, t, g, unknown, or other
  misc_feature (419)..(419): n is a, c, t, g, unknown, or other
aagctggagctccccgcggtggcggccgctctagaactagtggatcccccgggctgcaggaattcgcacgagaccattacctagaacatcctaatcgaaaaacaaaatttctctacttttcttcgaccgtcctaccctatccgctcccctcgccggcgccgcggcggcggcgagaaagagagaacgcgctcctcttccttctcgactcgatctgccccttccagcccgctcgcccctcatcgagcggcctccgtagccctaggtgatccgcgcctccttccgcgcagcggaacaggacgcctgaccgtcgacgtcgaagcgattcctctctcgcgggcgtcctcgtntcgccctccctcgcctctcgntggcagtgggtcggcgcggggaggcatccgtccgggctacggtcgattngntcctccactgctggtgaacttaaatagacaatggatctggagacagaaaaacgccttgcttctttacctactggaaagaggcccgaagattaacattagaggctaacaggggagggggttcagcatatctgccaaaacctaatgtttaggatcgtccaaactctcggttctcacagccacagttcgtggaggtcagcaagcaaatctggtggggaagggcatgaaatgtggcgtgcagggaaaagga

SEQ ID NO: 15066 - DNA, 748 bp, Zea mays
  misc_feature: Ceres CLONE 1377333-F
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (19)..(19): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (53)..(53): n is a, c, t, g, unknown, or other
ttttttttnnnnccccncncccctccccctctctccgtccatttttcannnangggccaaagctggagctccaccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctggcacatccggtgcattctccaccgccggtccacctggcgccgccgggtccacttggcacccgccggcccatggggccgcccccgggttcatcttgccgccgccccccatggccactacccttatttaaacgggcccccggcccctcagccttctttccccagagccaaccccctggccccgggggacaaaagggcccattcccaaaccccctggccacctttggagggaaaaccctgcggggggttggggaaacaccccccgcaatctctggggcccacggagggggcctgaaggtccctggggggggcttctggggggcggccccccgcacggggagcacccctctaatcggggcgcccccccccaagagcg

SEQ ID NO: 15067 - DNA, 627 bp, Zea mays
  misc_feature: Ceres CLONE 1377337-F
  misc_feature: Encodes the peptide sequence at SEQ ID NO. 15068
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (533)..(533): n is a, c, t, g, unknown, or other
  misc_feature (538)..(538): n is a, c, t, g, unknown, or other
  misc_feature (540)..(540): n is a, c, t, g, unknown, or other
tggagctccccgcggtggcggccgctctagaactagtggatcccccgggctgcaggaattcgcacgagaccattacctagaacatcctaatcgaaaacgccgatcaatcagctgactctaacaagatcgaagtcgaggaagaagatgtttctcactaggaccgagtatgacagaggagtcaacactttctctcctgaaggcaggctcttccaagttgagtatgccattgaagctatcaagcttggttccactgcaattggagtgaagacaaaagaaggagttgtgcttgctgtggagaagcgtatcacctctcctttactggagccgagcagtgtggagaagattatggaaattgatgaccatattggttgcgccatgagcggtttaattgctgatgctcgtacacttgttgagcatgcaagagttgagactcaaaaccacagaattctcggatggggaagccatggcccgggggagcccccaaaaaaccgggggggggggggggacctccgggtttttaacaaaaannnntnggggngnagggaggaaaagaaaaaaaaaaaacggcccccccccctgggaagaatctccctttttggggggggagaaaaaaaccccccccctttt

SEQ ID NO: 15068 - protein, 161 aa, Zea mays
  misc_feature: Ceres CLONE 1377337-F
  misc_feature (31)..(155): Pfam Name: Proteasome Pfam Description: Proteasome A-type and B-type
  misc_feature: SWISSPROT Homolog: EC 3.4.25.1 Proteasome endopeptidase complex
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (132)..(132): Xaa is any aa, unknown, or other
MFLTRTEYDRGVNTFSPEGRLFQVEYAIEAIKLGSTAIGVKTKEGVVLAVEKRITSPLLEPSSVEKIMEIDDHIGCAMSGLIADARTLVEHARVETQNHRILGWGSHGPGEPPKNRGGGGDLRVFNKXXXGXREEKKKKKRPPPLGRISLFGGGEKNPPPF

SEQ ID NO: 15069 - DNA, 734 bp, Zea mays
  misc_feature: Ceres CLONE 1377338-F
  misc_feature: Encodes the peptide sequence at SEQ ID NO. 15070
  misc_feature (538)..(538): n is a, c, t, g, unknown, or other
tggagctccccgcggtggcggccgctctagaactagtggatcccccgggctgcaggaattcgcacgagaccattacctagaacatcctaatcgaaaaatcaccaatcagtcagtcacagctcacagcaaacaccgcgaagccgcccccgctcccaaacccgaccgagcaaagcgcaaagccccccaaccgcggatcaatccgcagcatcgatggcgcccaaggcggagaaaaagccggcggcgaagaagcccgcggaggaggagcccgcgaccgagaaggcggagaaggctccggcagggaagaagccgaaggcggagaaacgcctccccgcgggcaagtccggcgccggcgagggcaagaagggcaagaagaaggccaggaagagcgtggagacctacaagatctacatcttcaaggtgctcaagcaggtgcaccccgacatcggcatctcgtccaaggccatgtccatcatgaattccttcatcaacgacatcttcgagaagctcggccgcggaggccgccaagctcgcccgctancacaagaagcccaccatcacctccccgcgagatccagacctccggtccggctcgtcctacccggggagctcgcccagcacgccgtctctgaaggcacaaaggcggacacccaagtcactccgtcttagattggttgccctcccccctcggttgggacggggggcctgcaaaaaaatctcaccctagtggggggggg

SEQ ID NO: 15070 - protein, 151 aa, Zea mays
  misc_feature: Ceres CLONE 1377338-F
  misc_feature (110)..(110): Xaa is any aa, unknown, or other
MAPKAEKKPAAKKPAEEEPATEKAEKAPAGKKPKAEKRLPAGKSGAGEGKKGKKKARKSVETYKIYIFKVLKQVHPDIGISSKAMSIMNSFINDIFEKLGRGGRQARPLXQEAHHHLPARSRPPVRLVLPGELAQHAVSEGTKADTQVTPS

SEQ ID NO: 15071 - DNA, 730 bp, Zea mays
  misc_feature: Ceres CLONE 1377339-F
  misc_feature: Encodes the peptide sequence at SEQ ID NO. 15072
  misc_feature (341)..(341): n is a, c, t, g, unknown, or other
aaagctggagctccccgcggtggcggccgctctagaactagtggatcccccgggctgcaggaattcgcacgagaccattacctagaacatcctaatcgaaaaagaagcatcacacactaatcaacaagcaggaccagctagctagctcctctcactgctatcacccgcccagccatctcgctgaaagagaaaagcgcagccatgaagactactagctcgggcattgcagtcgtcctactggtggccatgctggcagtccattccgcgttggccgacatctcgtgctccgacgtgctcaacgacctgtcgccgtgcctgcccttcctgcagggcaaggcagncaaaacccagcgagagcaaccaaccagttgctggccaacggcgtgaggggccctgtacgccgggggggggacaccagggccggacaggcaaggccacgtgcccgtggccctcaggggggcctacgggtcaggggccacgctgggctcctccgccggggcaggaagctggcccggcggactgcgggcctcctcggttggcctaaaaaaatcccccccccggaaattgaatggcgaaaaagaatcgaattggaaggggaaaactggttccccttacccggaaatccataccaacggggaaggggggaaggtccaaggggccccgggtaaaaaaaaagggctgcactccgggcccggggggggacaaaaaaaaaaagggattttggggggag

SEQ ID NO: 15072 - protein, 61 aa, Zea mays
  misc_feature: Ceres CLONE 1377339-F
  misc_feature (47)..(47): Xaa is any aa, unknown, or other
MKTTSSGIAVVLLVAMLAVHSALADISCSDVLNDLSPCLPFLQGKAXKTQREQPTSCWPTA

SEQ ID NO: 15073 - DNA, 732 bp, Zea mays
  misc_feature: Ceres CLONE 1377342-F
  misc_feature: Encodes the peptide sequence at SEQ ID NO. 15074
  misc_feature (471)..(471): n is a, c, t, g, unknown, or other
aagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatgacatcaggctgacggtcagatgcccggggaacagaccattggggggaggtgatgatgcttttcaacaccttccttccagtgagactggtggcctgggaaagcacgtggccccgtggctggtttttgttgaactttgaacccactggcattcaatgaggtggaggactggnaccctaccggccaggttcttccaccctggaagaactcatcaagtggggaaaggggaatgcaacccaacaacttttggcccggggggccactaaccccttgggaaaaggaaaattgttgaacccaatgcccttgaacccaatacgggaaaatttggcccaaaaaactggacaggtgtcccccaggggttttccccccgtttttaaaaattttgtggggggggaagaaaagggccctggggccctgggggtccccccccccac

SEQ ID NO: 15074 - protein, 73 aa, Zea mays
  misc_feature: Ceres CLONE 1377342-F
MRECISIHIGQAGIQVGNACWELYCLEHDIRLTVRCPGNRPLGGGDDAFQHLPSSETGGLGKHVAPWLVFVEL

SEQ ID NO: 15075 - DNA, 682 bp, Zea mays
  misc_feature: Ceres CLONE 1377345-F
  misc_feature: Translation starting site: 193
  misc_feature (440)..(440): n is a, c, t, g, unknown, or other
  misc_feature (466)..(466): n is a, c, t, g, unknown, or other
  misc_feature (472)..(472): n is a, c, t, g, unknown, or other
  misc_feature (477)..(477): n is a, c, t, g, unknown, or other
  misc_feature (653)..(653): n is a, c, t, g, unknown, or other
  misc_feature (682)..(682): n is a, c, t, g, unknown, or other
tggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccgtggctggntggccggccgccatcgcgctggcgtncatggncgggncgggttcgtcacctccggcggcctcggcgtcgctgcgctgtccgtgttctcctggatgtacaagtacctgacgggcaagcacccgccgggcgccgaccagctggacacgccaagggcgaggctggcgtccaaggcccgcgacatcaaggatgcagcacagcaccgatcgacaaggnggcagggggtcctggagagaagaaccacn

SEQ ID NO: 15076 - DNA, 682 bp, Zea mays
  misc_feature: Ceres CLONE 1377346-F
  misc_feature: Encodes the peptide sequence at SEQ ID NO. 15077
  misc_feature (305)..(305): n is a, c, t, g, unknown, or other
  misc_feature (539)..(539): n is a, c, t, g, unknown, or other
  misc_feature (553)..(553): n is a, c, t, g, unknown, or other
aagctggagctccccgcggtggcggccgctctagaactagtggatcccccgggctgcaggaattcgcacgagaccattacctagaacatcctaatcgaaaaaaaaccctagcagccacccggttctccctcgctccagatctcccttcgcagccggccagggaccccttcacagcgcgggagatggctgatcaggaggccccagttgcagttgaggcaccaaccccagttcttggagagccaatggacttgatgactgcgctgcagctggtgatgaagaagtcaagtgctcatgatggacttgtngaagggtcttcgcgaggctgccaaggccattgagaagcatgctgctcagctttgcgttcttgctgaggactgtgaccagccagattatgtcaagctggtgaaggcgctctgtgctgaacacaatgttcaccttggcactgttcctgctgctaagactcttggcgagtgggctgggctttgcaagattgactccgagggcaaggcaaggaaggttgtaggctgctcctgtgtcgntgtcaaggactacnggtgagaatctgagggccttacatagtgcaggagtatgtcaagtcgcactagatgtaacacgtttcagtaatactctacatttggatctgggcttatattatgcttgcgtcttgggcttgctaggagat

SEQ ID NO: 15077 - protein, 87 aa, Zea mays
  misc_feature: Ceres CLONE 1377346-F
  misc_feature (1)..(84): Pfam Name: Ribosomal_L7Ae Pfam Description: Ribosomal protein L7Ae/L30e/S12e/Gadd45 family
  misc_feature (5)..(5): Xaa is any aa, unknown, or other
  misc_feature (83)..(83): Xaa is any aa, unknown, or other
MMDLXKGLREAAKAIEKHAAQLCVLAEDCDQPDYVKLVKALCAEHNVHLGTVPAAKTLGEWAGLCKIDSEGKARKVVGCSCVXVKDY

SEQ ID NO: 15078 - DNA, 716 bp, Zea mays
  misc_feature: Ceres CLONE 1377347-F
  misc_feature: Encodes the peptide sequence at SEQ ID NO. 15079
  misc_feature (716)..(716): n is a, c, t, g, unknown, or other
tggagctccccgcggtggcggccgctctagaactagtggatcccccgggctgcaggaattcgcacgagaccattacctagaacatcctaatcgaaaagcgtgcccccctccctccctcagtccctctctctcgctctcggcgacgactgggcgaccgccgccgccgctgcgccgcccttgtccaggtgcccaggtcttcgcaggcgccttcgccaggtcttcgacggtaacgagcaccaaccggattcagggaatataagtaaaatgaggccagttttttgtgggaaccttgactatgatgttcgcatctcagaggttgagcgcctttttgggaagtatggaagggtggaacgagtggatctaaagacagggtttgcatttgtctacatggaagatgaacgcgatgctgaagatgctatcagtagacttgatggaattgattttggcagaaaaggaaggaggatcagggttgagtggacaaaggaggatcgcactgttggccgaaaaagcagctcaaggaggtctccaaccaatacaaaaccgaccaaaaccttgtttgtgatcaactttgacccgatcaacacaagaatccgagatctggagaggcacttcgataaatatggcagggtcgcaaatgtaagaatcaaaaagaactttgcctttatccagtttgagatacaggaggatgctacaagagcattggagggtactaatgn

SEQ ID NO: 15079 - protein, 150 aa, Zea mays
  misc_feature: Ceres CLONE 1377347-F
  misc_feature (4)..(69): Pfam Name: RRM_1 Pfam Description: RNA recognition motif. (a.k.a. RRM, RBD, or RNP domain)
MRPVFCGNLDYDVRISEVERLFGKYGRVERVDLKTGFAFVYMEDERDAEDAISRLDGIDFGRKGRRIRVEWTKEDRTVGRKSSSRRSPTNTKPTKTLFVINFDPINTRIRDLERHFDKYGRVANVRIKKNFAFIQFEIQEDATRALEGTN

SEQ ID NO: 15080 - DNA, 711 bp, Zea mays
  misc_feature: Ceres CLONE 1377348-F
  misc_feature: Encodes the peptide sequence at SEQ ID NO. 15081
  misc_feature (343)..(343): n is a, c, t, g, unknown, or other
  misc_feature (711)..(711): n is a, c, t, g, unknown, or other
gctctagaactagtggatcccccgggctgcaggaattcgcacgagaccattacctagaacatccaatcgaaaagattgggtccaacaccagccgccgccatgtcgaagcgaggcaggggaggttcggcggggaacaagttccgcatgtcgctgggtctgccagtggccgcgacggtgaactgcgcggacaacaccggcgccaagaacctctacatcatctccgtcaagggcatcaagggccgcctcaatcgcctcccgtccgcctgcgttggcgacatggtcatggccaccgtcaagaaggggaagcccgacctcaggaagaaggtgatgcccgccgtcatcntccgccagcgcaaggcgtggcgccgcaaggacggtgtctacatgtacttcgaagataatgctggagtgattgtgaatcccagggggtgaggatgaaaggttccgctatcactgggactatcggcaaggagtgtgctgatctttgggcctaggattgctagcgcagcaaacgccattgtttgagagcttggtgggatatggtcagacttctatatgatcatcttattatccgttgctagactgcaatttgggcttatgttttgtcactccattttggaggaaacaggatttggtatacccaggggatctatataacaatgtatgccctaaaattttctggctaaaaaaaaaaaaaagaagggttatcgn

SEQ ID NO: 15081 - protein, 110 aa, Zea mays
  misc_feature: Ceres CLONE 1377348-F
  misc_feature (19)..(111): Pfam Name: Ribosomal_L14 Pfam Description: Ribosomal protein L14p/L23e
  misc_feature (82)..(82): Xaa is any aa, unknown, or other
MSKRGRGGSAGNKFRMSLGLPVAATVNCADNTGAKNLYIISVKGIKGRLNRLPSACVGDMVMATVKKGKPDLRKKVMPAVIXRQRKAWRRKDGVYMYFEDNAGVIVNPRG

SEQ ID NO: 15082 - DNA, 688 bp, Zea mays
  misc_feature: Ceres CLONE 1377349-F
  misc_feature: Translation starting site: 257
  misc_feature: SWISSPROT Homolog: EC 2.7.1.20 Adenosine kinase
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (25)..(25): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
nttttttttcccccnncccnnnncnttattattattggtgatttnnttgaaannnnntcatactggagctccccgcggtggcggccgctctagaactagtggatcccccgggctgcaggaattcgcacgagaccattacctagaacatcctaatcgaaaaacacgaactcgagacctcgcccgcccaaatacaaaagcctcagatctcagtgaccagcgccgccgcttcgttcgtgtcgaatagagaagagaggaaatggcggcgagcgagggcgtgctcctggggatgggcaaccccctcctcgacatctccgccgttgtcgatgacgccttcctggcaaagtatgacatcaagctgaacaatgccattctcgctgaggagaagcactcgcctatgtatgatgagttggctagcaacagcaatgttgaatatattgctggagggagccacccagaactctatcagggttgcccaatggatgcttcaaactcctggtgcaacaagttacatgggatgcattgggaagggacagtttggtgaggagatgaagaaaatgctcaagctgcaggagttactgctcattactatgaggatgagactgctcctactggcacatgtgctggatgtgttgttgggggcgaaaggtcattgattggaaatctggcggggggcaaactgttaccaatc

SEQ ID NO: 15083 - DNA, 669 bp, Zea mays
  misc_feature: Ceres CLONE 1377354-F
  misc_feature: Encodes the peptide sequence at SEQ ID NO. 15084
  misc_feature (284)..(284): n is a, c, t, g, unknown, or other
  misc_feature (291)..(291): n is a, c, t, g, unknown, or other
  misc_feature (356)..(356): n is a, c, t, g, unknown, or other
  misc_feature (357)..(357): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcgaaaaagcgacagatatcttcgactcctcgttcgtggttccccatcgtcatcgccatggatttctcttaggctcacccgtccgctcggctcgcttccttccccactctctctgatcccgtcgcacttccctcctcgctgcagcccctctactattgcgattaccgtttcctcgctgccctttcctttnttcggancggcagcaatcaccggggcaagcgaaccctcgatttgcgtccccgctctctgctagcgcccctannagaggagcgaagcgatgtctatgtcgaagacgggtcaggccgcggagaaggatgagcagcagcagtcccgagggatagcactgatgcagggcatctgcgtcgtggtgtacccgcaggacgataacacgccctgccccgatcagcaggatctctacttgtgatctgttggagcagcattcaataaggacgctctcaagagtttgaacatcacccatatcttgatcgttgcaaagtcactggatccagtatttccagctgaatttaattancagaagatcgaagtacttgatatcccagacactgatctggtaa

SEQ ID NO: 15084 - protein, 48 aa, Zea mays
  misc_feature: Ceres CLONE 1377354-F
MSMSKTGQAAEKDEQQQSRGIALMQGICVVVYPQDDNTPCPDQQDLYL

SEQ ID NO: 15085 - DNA, 713 bp, Zea mays
  misc_feature: Ceres CLONE 1377364-F
  misc_feature: Encodes the peptide sequence at SEQ ID NO. 15086
  misc_feature (440)..(440): n is a, c, t, g, unknown, or other
  misc_feature (532)..(532): n is a, c, t, g, unknown, or other
  misc_feature (636)..(636): n is a, c, t, g, unknown, or other
ggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggcggggcaggacgccaccgacgccttcgccgcctaccacccgccctcggngcgcccgctcctccgccgcttcttcgttggccgcctctccgactacgccgtctcccccgcgtccgccgactaccgccgcctcctcgcgcagntatcctccgcgggcctcttcgaacgcgtcgccccacccccagggtcagctcgtcctgatgggcgtctcttctacgcgcgctctacctcgtcctcgctgggcagnggctggcgcacctcctcgcgggggctcatcggctcgtctggatcaggccggttggatggccacgactcggccacacg

SEQ ID NO: 15086 - protein, 172 aa, Zea mays
  misc_feature: Ceres CLONE 1377364-F
  misc_feature (22)..(95): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (82)..(82): Xaa is any aa, unknown, or other
  misc_feature (113)..(113): Xaa is any aa, unknown, or other
  misc_feature (147)..(147): Xaa is any aa, unknown, or other
MPPSVDAMPAPGDAAGGGDVRMISSKELRSHASADDLWISISGDVYDVTPWLPHHPGGDLPLLTLAGQDATDAFAAYHPPSXRPLLRRFFVGRLSDYAVSPASADYRRLLAQXSSAGLFERVAPPPGSARPDGRLFYARSTSSSLGXGWRTSSRGLIGSSGSGRLDGHDSAT

SEQ ID NO: 15087 - DNA, 730 bp, Zea mays
  misc_feature: Ceres CLONE 1377366-F
  misc_feature: Encodes the peptide sequence at SEQ ID NO. 15088
tggagctccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttggtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagcagtagagagaaggtggaaaaaacaatgcaagtgggacaaacagacattcaaatatatgggtcttctaagaagagagatgttccttcatctattgctgaagaatcccaaatggctttggtggggactaccacggaccgggttcggggaactccaatggtgagttctattggaaccttggatggcattttggaggggcccaactgggggaacaacatttgccttacaggcggggcaaattcaaaaaattggcctaatttccccgaaggcaaaaaggggttggt

SEQ ID NO: 15088 - protein, 115 aa, Zea mays
  misc_feature: Ceres CLONE 1377366-F
  misc_feature: SWISSPROT Homolog: EC 1.3.1.26 Dihydrodipicolinate reductase
MGLSVAEAAALRGLHLVPVSFSSREKVEKTMQVGQTDIQIYGSSKKRDVPSSIAEESQMALVGTTTDRVRGTPMVSSIGTLDGILEGPNWGNNICLTGGANSKNWPNFPEGKKGL

SEQ ID NO: 15089 - DNA, 718 bp, Zea mays
  misc_feature: Ceres CLONE 1377370-F
  misc_feature: Encodes the peptide sequence at SEQ ID NO. 15090
  misc_feature (412)..(412): n is a, c, t, g, unknown, or other
  misc_feature (445)..(445): n is a, c, t, g, unknown, or other
  misc_feature (513)..(513): n is a, c, t, g, unknown, or other
ctccccgcggtggcggccgctctagaactagtggatcccccgggctgcaggaattcgcacgagaccattacctagaacatcctaatcgaaaaactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacgcgcagcgcgtgggcactggcgcccccgtctacctcgccgccgtcctggagtacctcgccggcgaggttctggagttggcagggaacgcgncgaaagaacacagaagacgcgcatcatcccgcngcacgtgctcctggcgatccgcaacgacgaggagctcgggaagctgctgggcggcgtcaccatcgggnacggggggggcctccccaaaattcactccggggtcctggccaagaaggcgggggaaaagggcggcaggggcgggaaaaaaggaaccaaatcccccaagaagggcgcccagtcccccaaaagggttaaaaaaggagggctccatttgcctgggggtgaaaaagttcccggccaaaactgggggggggaaggccccgcccaaaaact

SEQ ID NO: 15090 - protein, 183 aa, Zea mays
  misc_feature: Ceres CLONE 1377370-F
  misc_feature (29)..(101): Pfam Name: Histone Pfam Description: Core histone H2A/H2B/H3/H4
  misc_feature (82)..(82): Xaa is any aa, unknown, or other
  misc_feature (93)..(93): Xaa is any aa, unknown, or other
MDASGAGSKGKKGAAGRKAGGPRKKSVTRSVKAGLQFPVGRIGRYLKKGRYAQRVGTGAPVYLAAVLEYLAGEVLELAGNAXKEHRRRASSRXTCSWRSATTRSSGSCWAASPSGTGGASPKFTPGSWPRRRGKRAAGAGKKEPNPPRRAPSPPKGLKKEGSICLGVKKFPAKTGGGKAPPKN

SEQ ID NO: 15091 - DNA, 676 bp, Zea mays
  misc_feature: Ceres CLONE 1377371-F
  misc_feature: Encodes the peptide sequence at SEQ ID NO. 15092
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtgggaggcgaagcaggcgctctactcgagggacctcgctcgcaacctgcgcttcgcctcccacttcgacctcttcaaggctgctgcggccgactggcgcgacacgctccttctgcgagggggctccgaacccgcggccgcgggaggagctgccg

SEQ ID NO: 15092 - protein, 176 aa, Zea mays
  misc_feature: Ceres CLONE 1377371-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVGGEAGALLEGPRSQPALRLPLRPLQGCCGRLARHAPSARGLRTRGRGRSC

SEQ ID NO: 15093 - DNA, 675 bp, Zea mays
  misc_feature: Ceres CLONE 1377374-F
  misc_feature: Encodes the peptide sequence at SEQ ID NO. 15094
gctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggcgcccgatgggtgacaggtgaaggcatgctccacgacagggggcgacggcgtcgcaggcgctgacggtggcgacgctggtccccgctgggcggcctgctgctggtgctgtccgggctggcgctgaccgcctccgggggggggctgccgggggccacccggggttcctgatcttcagccccggggtggtccccgccgcgttggtcatcgggaacggccggcatgggggtcccccacgtcgggcgggctggggccccgggggcctggccctcgcttccggggcccccgcaacacgggggcgggaagggggttcaagggcacccccggactaacggggaggggagggccccccgcaaggagtgggggaaggcccgcggggccaccgcggggccccaaaaacccgcgccaggcagggcccag

SEQ ID NO: 15094 - protein, 47 aa, Zea mays
  misc_feature: Ceres CLONE 1377374-F
MADRDRSGIYGGAHATYGQQQQQGGGGARWVTGEGMLHDRGRRRRRR

SEQ ID NO: 15095 - DNA, 824 bp, Zea mays
  misc_feature: Ceres CLONE 1377376-F
  misc_feature (12)..(12): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (20)..(20): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (52)..(52): n is a, c, t, g, unknown, or other
tttttccccctnntnntttntacccctctttttcccaggccaggtnnnnggntcaaagctggagctccccgcggtggcggccgctctagaactagtggatcccccgggctgcaggaattcgcacgagaccattacctagaacatcctaatcgaaaaaaaactgcattacaccacgatacactccactacaccctctcgagcaacaccaggaaccataccaaatcccaagtagagaagagcaagggctgcagctggcaagaagcctttgctcagaaatggaggtcctgtcgcagatgtggtcgctcctgggcctgctcaccatcctgcagaacgccctccccacgcagctgctctccttggtgaagtcgctggggcaggacgctccaagactctccccacgccccctacttcctactttcgaacggggccccaagttccggggggtcgtggggcccgttccaagccccaaagggcgctctctaaccggcccacattccagggtgtaactttccaagggggttcccttcgcgcctttcttcctccggcctcccggccggccaagggctttaagggggtttttcgcttggccgggggcttcccctctccgcgccggggtcccgcgcgggcgccacccccccccgcgggggcttggcgcccaatcccccgccgcggggggggggagggctctctccacaaaagaccagctcggggtgcgcgggaaaacctttaaaacggggccccccgggggcgcgggggggcacccaacaacaggcgcaaagaaggttcccaggaccccgcttccaagagacgggccgcccctcccc

SEQ ID NO: 15096 - DNA, 710 bp, Zea mays
  misc_feature: Ceres CLONE 1377379-F
  misc_feature: Encodes the peptide sequence at SEQ ID NO. 15097
  misc_feature (432)..(432): n is a, c, t, g, unknown, or other
  misc_feature (514)..(514): n is a, c, t, g, unknown, or other
  misc_feature (589)..(589): n is a, c, t, g, unknown, or other
  misc_feature (621)..(621): n is a, c, t, g, unknown, or other
tggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcgcgggntttgtgggggggcggccgccatcgcgctgggcttcatggggggccgggttcgtcacctccgggggcctcggcgtcgctgcgnctgtccggttcctcctggatgtacaagtaccctgacggggcagtacccgtcgggcgccgaccagctggaccacgncaagggtgaggatggcgtccaaggtccgcgancatcaggatgcaggacaggcacgcatcgacaaggggcgaggggtcttgagagaacatcatactcgagcggacgggggggcgaactcttg

SEQ ID NO: 15097 - protein, 118 aa, Zea mays
  misc_feature: Ceres CLONE 1377379-F
  misc_feature (36)..(119): Pfam Name: Oleosin Pfam Description: Oleosin
  misc_feature (108)..(108): Xaa is any aa, unknown, or other
MADHHRGATGGGGGYGDLQRGGGMHGEAQQQQKQGAMMTALKAATAATFGGSMLVLSGLILAGTVIALTVATPVLVIFAGFVGGRPPSRWASWGAGFVTSGGLGVAAXVRFLLDVQVP

SEQ ID NO: 15098 - DNA, 711 bp, Zea mays
  misc_feature: Ceres CLONE 1377380-F
  misc_feature: Translation starting site: 463
  misc_feature (679)..(679): n is a, c, t, g, unknown, or other
tccccgcggtggcggccgctctagaactagtggatcccccgggctgcaggaattcgcacgagaccattacctagaacatcctaatcgaaaaatcaccaccactgggtcttctgaccattagctttatctactccagagcgcagaagaacccgatcgacaccatgacggtgttgctcgttgccctcgctctcctggctctcgctgctgagcgccacctccacgcatacaagcggcggctgcggctgccagcacaccgccgccggttcatctaccgccgccagagtatctttcacctccgtgttacctgccacctccgctgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctgggccagtgcgccgagtttctgaggcatcagtgcagcccgacggcgacgccctactgctcgcctcagtgccagtcgttgcggcagcagtgttgccagcagctcaggcaggtggagccgcagcaccggtaccaggcgatcttncggtttggtctccagaccatcctgcagcagcg

SEQ ID NO: 15099 - DNA, 791 bp, Zea mays
  misc_feature: Ceres CLONE 1377383-F
  misc_feature: Translation starting site: 271
  misc_feature: SWISSPROT Homolog: EC 2.7.1.4 Fructokinase
  misc_feature (9)..(9): n is a, c, t, g, unknown, or other
  misc_feature (10)..(10): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (36)..(36): n is a, c, t, g, unknown, or other
ggggttttnnannttnannnaattgcgattaagatncccccccttttggtcagagctggagctccccgcggtggcggccgctctagaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcgggggcgtccaacaacctggtggtgtcggtcggggagatgctgatcgacttcgtccccgacgtggccggcctgtcgctgaccgagtcgggcggcttcgacaagggcccccggaggtgcgcccgccaacgtcgcctgcgccatcgccaagctcggcggatcctccgccttcgtcggcaaagcccggcgacgacgagtgcggggcacatgtcggtgcaaccatccctgaaacagaaccaacgggcaacgccggaggggtgcccttgttcggacaagcaacgcgccgcgaccgggcgctgggccccccgtgacccccccaaccacgcacgggggagccgggcaggctcctggatccaacacggaaaccccgagacgggggaacaacggctgccttgaccggaggggccgagccttgacccccgggggctcggggggacggggcccgccaaggaggggttccacgctacgggcgccccagccacgaatca

SEQ ID NO: 15100 - DNA, 664 bp, Zea mays
  misc_feature: Ceres CLONE 1377386-F
  misc_feature: Encodes the peptide sequence at SEQ ID NO. 15101
  misc_feature (359)..(359): n is a, c, t, g, unknown, or other
  misc_feature (367)..(367): n is a, c, t, g, unknown, or other
  misc_feature (371)..(371): n is a, c, t, g, unknown, or other
  misc_feature (379)..(379): n is a, c, t, g, unknown, or other
  misc_feature (387)..(387): n is a, c, t, g, unknown, or other
  misc_feature (388)..(388): n is a, c, t, g, unknown, or other
  misc_feature (399)..(399): n is a, c, t, g, unknown, or other
  misc_feature (490)..(490): n is a, c, t, g, unknown, or other
  misc_feature (543)..(543): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaagagcgcgctgtggcatggagcacaaggatgggggcacagcttctgctggtggtctgcccgccggaagcagcttgtgctcgggctcgccgttgctcgacgcgccgatcctccgccgcctctacgccgggcaaatccttgccagatggggcgcgaggatgtgggagttttctgttgcgctgtatatgattcgcatttggcctgactcgcttctctttgcgggcatctacggcgtcgtggagacatcctctctcgtggtgctcgntcccgtgntggngacgctcngtggaagnncacataccttncagttttggcatctggctgctgtcgcaagcatatccttgattgtcgctggaacctcggtgaccaccctgctcatgtatgccaccctgagangccacagcttcccggcattcatgggtctggtcgccgttaccaacgtctcgggnggtctaggtgccctctcagctctcggcggggacatactgatcgagagagaatgggtggtggtgatctcgagcgggcatcctccgtcggtgcggacggggatcaactcggtgggccggcggn

SEQ ID NO: 15101 - protein, 184 aa, Zea mays
  misc_feature: Ceres CLONE 1377386-F
  misc_feature (83)..(83): Xaa is any aa, unknown, or other
  misc_feature (86)..(86): Xaa is any aa, unknown, or other
  misc_feature (87)..(87): Xaa is any aa, unknown, or other
  misc_feature (90)..(90): Xaa is any aa, unknown, or other
  misc_feature (92)..(92): Xaa is any aa, unknown, or other
  misc_feature (93)..(93): Xaa is any aa, unknown, or other
  misc_feature (96)..(96): Xaa is any aa, unknown, or other
  misc_feature (127)..(127): Xaa is any aa, unknown, or other
MEHKDGGTASAGGLPAGSSLCSGSPLLDAPILRRLYAGQILARWGARMWEFSVALYMIRIWPDSLLFAGIYGVVETSSLVVLXPVXXTLXGXXHTXQFWHLAAVASISLIVAGTSVTTLLMYATLRXHSFPAFMGLVAVTNVSGGLGALSALGGDILIEREWVVVISSGHPPSVRTGINSVGRR

SEQ ID NO: 15102 - DNA, 663 bp, Zea mays
  misc_feature: Ceres CLONE 1377389-F
  misc_feature: Encodes the peptide sequence at SEQ ID NO. 15103
  misc_feature (474)..(474): n is a, c, t, g, unknown, or other
  misc_feature (475)..(475): n is a, c, t, g, unknown, or other
  misc_feature (658)..(658): n is a, c, t, g, unknown, or other
  misc_feature (661)..(661): n is a, c, t, g, unknown, or other
aagctggagctccccgcggtggcggccgctctagaactagtggatcccccgggctgcaggaattcgcacgagaccattacctagaacatcctaatcgaaaagtccttgtgcgttccttgtagccatctccgactccgcgcctccgctgcctcccgaaagcattgccagttcctccgcacaacatgacgcgcatccaccgcctccgccccctcttcctcttcgttctcttggcgtcgctgcaatgcggtgcggcgacggcggcggctggatacggaggtggcgcccgaggggttctgctcggcggagccgtccagcaagtgctccggggatcagccgctctactggaaggtcacccatcccaccctcgcgcccgcgcacctccaagatttacctggcttcacacgtagtgttttcaaaagggatcatgctttaataacaccagagagtcatgtattcagtcctttgcctgattgnnatcatacagtaggagcatatttgatcagtccagctattggtgcacacttcattatgtatctagcaaacatgcaagatggttcaaaatcagccctaccacccgaagatgttgaaagggttgtttttgtactacaagggagcatttcattgactgtggggactgggactatccattctctgctgntgnaa

SEQ ID NO: 15103 - protein, 43 aa, Zea mays
  misc_feature: Ceres CLONE 1377389-F
MYLANMQDGSKSALPPEDVERVVFVLQGSISLTVGTGTIHSLL

SEQ ID NO: 15104 - DNA, 741 bp, Zea mays
  misc_feature: Ceres CLONE 1377391-F
  misc_feature: Encodes the peptide sequence at SEQ ID NO. 15105
  misc_feature (333)..(333): n is a, c, t, g, unknown, or other
  misc_feature (433)..(433): n is a, c, t, g, unknown, or other
tccccgcggtggcggccgctctagaactagtggatcccccgggctgcaggaattcgcacgagaccattacctagaacatcctaatcgaaaactcgaaaccctagcgccggcgcctccatttcgttttcctcactctctcctccagctcagggtccggcggcgaagggaaggcaagatgtacaccgcgaggaagaagatccagaaggagaagggtcttgagccctccgagttcgaggactccgttgcccaggctttctttgatctggagaacgggaaccaggagctcaagagcgacctcaaggacctgtacatcaacaatgctatccagatggnatgtaccgggagtaggaagggctgtgtcattcacgtcgcataccgcctgcgcaaggccttcaggaagatccatgtcagactcgtcagggagctggagaanaaaatcagcgggcaggatgtggtatttgttgctacacggaggatggggaggccacccaagaagggttcaggtggtctggcgccctcgaacaggaatctgactgggtggtacgatggcattttggaaggaggtgcctacccacctgaaattgggggaaaagtggcaaaaaccggccgggggggtccaaaatattcagaattttctggagccccgggggggggaaaacctcggaaaaaaagtgggaacctggcgtggggttcaccgggggggtgggggaaaaaaggggcccttttaaaccccaaaagcga

SEQ ID NO: 15105 - protein, 188 aa, Zea mays
  misc_feature: Ceres CLONE 1377391-F
  misc_feature (6)..(178): Pfam Name: Ribosomal_S7e Pfam Description: Ribosomal protein S7e
  misc_feature (53)..(53): Xaa is any aa, unknown, or other
  misc_feature (86)..(86): Xaa is any aa, unknown, or other
MYTARKKIQKEKGLEPSEFEDSVAQAFFDLENGNQELKSDLKDLYINNAIQMXCTGSRKGCVIHVAYRLRKAFRKIHVRLVRELEXKISGQDVVFVATRRMGRPPKKGSGGLAPSNRNLTGWYDGILEGGAYPPEIGGKVAKTGRGGPKYSEFSGAPGGGKPRKKSGNLAWGSPGGWGKKGALLNPKS

SEQ ID NO: 15106 - DNA, 712 bp, Zea mays
  misc_feature: Ceres CLONE 1377394-F
  misc_feature: Encodes the peptide sequence at SEQ ID NO. 15107
  misc_feature (433)..(433): n is a, c, t, g, unknown, or other
  misc_feature (443)..(443): n is a, c, t, g, unknown, or other
  misc_feature (478)..(478): n is a, c, t, g, unknown, or other
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaaggttaaacccatgccgctaatcgacgccgccgcctcggcggtcgcgccgcccccaccccggcgagtggctcaactccgcttcttcagcactcgcagacccggaatcctatccctaactgccaccagctgctccccctcccctccgcccccggtcgctgcggaggtgcctgcgccgccacaggaagcgaagtcgaagccgaggccacggcggtacccgaagcagtaccccggcgagtcggtgggcgttgctgaggagatgcgctttgtcgccatgcgcctgcgtaaccccaagcgcaccaccataaaagacaagtcggggacggaggacgcgnacgccggggncggggtgtcggagggcgaggctgagtaagacgacnggcggcggcgtgaaggaggaaacacgaggagggaggatgaggggcgagctcaaggaaagggaaatgggatgccccacnatgggagggggtccgggggaaaccctgggggaaaaaaaaagtttcctttttccgaaccctgaagggggggggggggcgagaccccccgagggcgccctatttttatttcggggaagaggggttggggggggccccataaatttttaaaagggttgt

SEQ ID NO: 15107 - protein, 37 aa, Zea mays
  misc_feature: Ceres CLONE 1377394-F
  misc_feature (26)..(26): Xaa is any aa, unknown, or other
  misc_feature (29)..(29): Xaa is any aa, unknown, or other
MRFVAMRLRNPKRTTIKDKSGTEDAXAGXGVSEGEAE

SEQ ID NO: 15108 - DNA, 667 bp, Zea mays
  misc_feature: Ceres CLONE 1377396-F
  misc_feature: Encodes the peptide sequence at SEQ ID NO. 15109
  misc_feature (583)..(583): n is a, c, t, g, unknown, or other
  misc_feature (598)..(598): n is a, c, t, g, unknown, or other
aaagctggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagacgccgcccgaggccgccgccatcggcgagaatgagatccgcatcaccactcagggcctcgatcgcaactacgtcacctacgccacctcccctcgtcagtaataacaggtgaaggtaattgtgtttgaagctatgggacaggctataagcaaggcagtggctattgctgagatcataaagaagacgattcctggtctgcatcaagatacaataatcagttctgtcagtattactgatgtatgcgagcccattgaggaanggacgtgtacatcgnagatgactcgtcatgtttcaatgatatcgatttccttgtcacctagggagcataacaagatttcactgg

SEQ ID NO: 15109 - protein, 70 aa, Zea mays
  misc_feature: Ceres CLONE 1377396-F
  misc_feature (43)..(43): Xaa is any aa, unknown, or other
  misc_feature (48)..(48): Xaa is any aa, unknown, or other
MGQAISKAVAIAEIIKKTIPGLHQDTIISSVSITDVCEPIEEXTCTSXMTRHVSMISISLSPREHNKISL

SEQ ID NO: 15110 - DNA, 677 bp, Zea mays
  misc_feature: Ceres CLONE 1377397-F
  misc_feature: Translation starting site: 159
  misc_feature (324)..(324): n is a, c, t, g, unknown, or other
  misc_feature (377)..(377): n is a, c, t, g, unknown, or other
aagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagctaaaatactttgcctccttatgctccttggtctttctgcaagtgctgctacggcgaccattttcccacaatgctcacaagctcctatagcttcccttcttcccccgtacctctcaccaacggtgtcttcggtatgtgaaaaccccatttcttcacccntacaggatccaacagggcaatcgcagctggcatcttaccctttatcacccttngtccctcccaacatcatcagccctattacaggagttaccctttggtgcatttaatgggaccaaacatcaggggaccaacactaccacaacttgggctaaaaaacctgggtggctattctaagaaaaggaagttctttccattcaccaaataagtgggattgaaacctggttctttatttgaaaaaaaaaaaattacattttacccgggtttttggtggcaaacccccagaaatttcttccctttcacccaacggtgaaggagtggaaccccccggggtttttttagggggggaaacaatt

SEQ ID NO: 15111 - DNA, 691 bp, Zea mays
  misc_feature: Ceres CLONE 1377398-F
  misc_feature: Translation starting site: 167
  misc_feature (388)..(388): n is a, c, t, g, unknown, or other
  misc_feature (403)..(403): n is a, c, t, g, unknown, or other
  misc_feature (431)..(431): n is a, c, t, g, unknown, or other
tggagctccccgcggtggcggccgctctagaactagtggatcccccgggctgcaggaattcgcacgagaccattacctagaacatcctaatcgaaaacacacccgcatctgcttcattccacccgccccgcgaggagcttctagaaggggagaccccggcggagccatggcggaggaaaaggagtcgacgtcgatcccgctcagccaggcggcggaggctgtcgaccccgaggacccggccaagtcgccgccgcgacccagctcgcccaccacctccacacgcaagtcccctatatgcaaaaattggaatcgacatatttgggtcttggttttttgacttctctggtattcatatttctgggttggaatatttgtttctttcatgggntggttcaacaatctncttcttggggtggggcgaagggtccgtnaagaatgcatttgtaggactatatattcagatcaaagcaagtcggactggcattttcaccgatccaaatacgactgtttttcaaggagtgccaatatttcgcctcccccgaattggggaatagggtttgggattctaaaccatcaggggggggccttccaaactgaacagggcattgaaaaatggggaaatggggtatggcccaaaattactctaaacctcggggaacatatttttgggggaaccccggggggattaaaa

SEQ ID NO: 15112 - DNA, 715 bp, Zea mays
  misc_feature: Ceres CLONE 1377399-F
  misc_feature (687)..(687): n is a, c, t, g, unknown, or other
cgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctcctcaacaatgttcaaactgccaaccacaacatcctcctccatagcccgacctctcacacattccaacttggtgcggcgtaaacgcgcagcagcacttcgacggcggtcggccacggcctgcccctaggcgttgacatccagatccatctcgctccgatctacattcgagaagtttgtctccgacatcgattccccagtctgaatcgttgtcgacgtcttctttgggtggacggtcgaagtcacgcgcacgcacatcccacacttgttcctccccggcggtgcattcagcaacactgtcttcttctccgtgtcggagcacctcgggccacaggggcggacccgtgaacgacgttctttcggcgtgtcacgatctccggtcgcaagctcgatgctctccccatcgacacgcgagccccttgggggggcccgacctagnatttactgagatttctctcatcagcctg

SEQ ID NO: 15113 - DNA, 675 bp, Zea mays
  misc_feature: Ceres CLONE 1377401-F
  misc_feature: Translation starting site: 565
  misc_feature (336)..(336): n is a, c, t, g, unknown, or other
  misc_feature (389)..(389): n is a, c, t, g, unknown, or other
  misc_feature (395)..(395): n is a, c, t, g, unknown, or other
  misc_feature (429)..(429): n is a, c, t, g, unknown, or other
  misc_feature (559)..(559): n is a, c, t, g, unknown, or other
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgccacggctacatcacgaagctggagagcctctggtccaacctccagctgcactccccgcgacgccttcgcacgcgctggtcatcttccttcgcgactacnacgatcgccggccgcacacccgcagggtcctcgaattcctcctcgggctcccngagggntaccccgggcagggccacgtcttcctctgcgggnaacacgacctcgccttcccggggtcgtcggggcgctgccgccgccgcccgacggttccccgttctcgggcacctgggacgagtacatccccacgaggagcaccgagggtggttccggcgggccgggatcnagggcatgcacgtgcaagggaagcggttggnccggttcctcaaggaaagggggaccccaagaagggggtccccgaaaaggggtccatttacgaggggagccaccttcaaatcctag

SEQ ID NO: 15114 - DNA, 684 bp, Zea mays
  misc_feature: Ceres CLONE 1377403-F
  misc_feature: Encodes the peptide sequence at SEQ ID NO. 15115
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggaagggggcgagtgccggcgccagtgcctgcgccgccacgagggccagccgtgggagacccaggagggcatgaggcggtgccgccgccgcggactggccgtcgacatggagncaagagtacggtcgcggcagcgagaggcgcggcagtggcccgggagaagtgcgagcgcaccaccgcgggggattggtgggagaggcacg

SEQ ID NO: 15115 - protein, 158 aa, Zea mays
  misc_feature: Ceres CLONE 1377403-F
  misc_feature (129)..(129): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGRVPAPVPAPPRGPAVGDPGGHEAVPPPRTGRRHGXKSTVAAARGAAVAREKCERTTAGDWWERH

SEQ ID NO: 15116 - DNA, 645 bp, Zea mays
  misc_feature: Ceres CLONE 1377405-F
  misc_feature (262)..(262): n is a, c, t, g, unknown, or other
  misc_feature (278)..(278): n is a, c, t, g, unknown, or other
ctccccgcggtggcggccgctctagaactagtggatcccccgggctgcaggaattcgcacgagaccattacctagaacatcctaatcgaaaaaggatccattaacacccctacgtacgcctttcctctggaaacccttctctcgcctgcctctcccccgccgcgccgccacttcccctctcccgtcaactccggcttccgcgcgaggtcgagctagcgtttggagttctcgagacctgctgtgatggcgacagagcaagcgncggagaactacacggntggaggaccttcgtgggccctgaacccctacaaccccggaattcctcaaagaacctcgaaaaagttcggcaatgaaacaggccccatcccaagaaatataaatttgggatgaaaacccagcctttcttcctttggacccgtttgagcccaaaagggtgggccttaccgattggggcccccaaatcggtttaaggctcctctggggaaaggccagcccccgggaatcaaggttggggataaattcttaacccccaaaaaggggggaaatggggggggaacattcggggggtgggaacgttttttccccacccccaaaaagggggggaggccccacacattttgggggaaaacccaacacccccccttt

SEQ ID NO: 15117 - DNA, 659 bp, Zea mays
  misc_feature: Ceres CLONE 1377406-F
  misc_feature: Encodes the peptide sequence at SEQ ID NO. 15118
  misc_feature (360)..(360): n is a, c, t, g, unknown, or other
  misc_feature (390)..(390): n is a, c, t, g, unknown, or other
  misc_feature (448)..(448): n is a, c, t, g, unknown, or other
  misc_feature (481)..(481): n is a, c, t, g, unknown, or other
  misc_feature (502)..(502): n is a, c, t, g, unknown, or other
  misc_feature (606)..(606): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaagtagccatatcacaccgcacacagtactcgtcctccttgcagcttgcaccaacacgccaccttaccttgctttgcttgcactcgcacacatttgcgagcgcattgcttgcattgcgcagccgcaggccgcagcacgaagctagccagtaggcggtagatggcgagcagcgcggggaaccgcttcctgaggcagctgagcgcgagcaacggcgacgaagcggtctgcggcggcctgcagatggaccatcaggagtacggcggcncccggcgtggggaggaggggatcccggcgntggtcaaaaaagcgggccgccgccgccgccgccgcgaggggctacggcgccggcagcnggaatggcgtgaagcagccggcctctgccgcgnggaagcgggtgatggtggtgntgaacgagagctcgggagccaacccacgcatgatgtgggcgctcacccacgtcgccgacaagggggacttcctcacgctgctccacgtcctgccgcgctccggnagcggaaggggcgaagaaggctccctcctcggcaactcgntcgggacgctctg

SEQ ID NO: 15118 - protein, 55 aa, Zea mays
  misc_feature: Ceres CLONE 1377406-F
  misc_feature (4)..(4): Xaa is any aa, unknown, or other
  misc_feature (52)..(52): Xaa is any aa, unknown, or other
MVVXNESSGANPRMMWALTHVADKGDFLTLLHVLPRSGSGRGEEGSLLGNSXGTL

SEQ ID NO: 15119 - DNA, 682 bp, Zea mays
  misc_feature: Ceres CLONE 1377409-F
  misc_feature: Encodes the peptide sequence at SEQ ID NO. 15120
  misc_feature (314)..(314): n is a, c, t, g, unknown, or other
tccccgcggtggcggccgctctagaactagtggatcccccgggctgcaggaattcgcacgagaccattacctagaacatcctaatcaaaaaaccctagcctctatctcattccactccgacattcacgtgcagctgtcgggagcaggcaatggcgccggatctaagcgaactcgccgccgccgctccagcccgtggcgcctacctcgccggcgtcggtgtcgcggtcctcctcgctgcctccttcctcccagtagccgagtcgtcctgcgtgcgagataactcattggtgagagacataagccaaatgccgcanagcagctatgggattgaaggattgtcacatataacagttgctggtgccctcaatcatgggatgaaggaggtggaactgtggcttcagacaataagtccaggtcaaaggacgccaatccacaggcattcctgtgaagaagttttcactgtcctcaaagggaagggtacgctcttgatgggatcaagctcactaaagtacccagggcagccacaggaaattcctttctttcagaaaccacattttcaatccctgtaatgatccacaccaggtttgggattctgacgagcacgaagatttgcagggtcttgggatcatatcgaggacgcctgctaagatatttttatatgatggatggagcatgcctcata

SEQ ID NO: 15120 - protein, 139 aa, Zea mays
  misc_feature: Ceres CLONE 1377409-F
  misc_feature (36)..(139): Pfam Name: Auxin_BP Pfam Description: Auxin binding protein
  misc_feature (55)..(55): Xaa is any aa, unknown, or other
MAPDLSELAAAAPARGAYLAGVGVAVLLAASFLPVAESSCVRDNSLVRDISQMPXSSYGIEGLSHITVAGALNHGMKEVELWLQTISPGQRTPIHRHSCEEVFTVLKGKGTLLMGSSSLKYPGQPQEIPFFQKPHFQSL

SEQ ID NO: 15121 - DNA, 706 bp, Zea mays
  misc_feature: Ceres CLONE 1377410-F
  misc_feature: Encodes the peptide sequence at SEQ ID NO. 15122
ctccccgcggtggcggccgctctagaactagtggatcccccgggctgcaggaattcgcacgagaccattacctagaacatcctaatcgaaaaatccaatcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatacggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagcgccagggccgcaccctctacggcttcggcggctaggcctgccgcgccgcgattcgccgtcgctgcggttctggtgttgctgcagttcgcaagttgtttgtgtgggcggaaaaatgctagatactgtagaactgcagtgcggtatgtgcacatgggtgtgtttgtctgaagaaatgttgtcaatgctggcttgctctggactcgacatgctcccatttggttcactgtgcttcgtttgtacaaagcgagcatttcagtcgttttttgc

SEQ ID NO: 15122 - protein, 103 aa, Zea mays; identical to SEQ ID NO: 6459
  misc_feature: Ceres CLONE 1377410-F
  misc_feature (25)..(94): Pfam Name: Histone Pfam Description: Core histone H2A/H2B/H3/H4

SEQ ID NO: 15123 - DNA, 742 bp, Zea mays
  misc_feature: Ceres CLONE 1377412-F
  misc_feature: Encodes the peptide sequence at SEQ ID NO. 15124
  misc_feature (399)..(399): n is a, c, t, g, unknown, or other
  misc_feature (580)..(580): n is a, c, t, g, unknown, or other
  misc_feature (620)..(620): n is a, c, t, g, unknown, or other
  misc_feature (675)..(675): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtgccgcgagcggcaccagcaagctgacgcgggcgaggacggcgacagcggcgtggacgcctacgtctcccgcttcggaaaaggggcgagtgccggcgccagtgcctgcgcccgcacgagggccaagccgtgggaaacccaggagggccatgagggcggtgccgccgccgccgnactggccgtcgactggaacccaggagtacggtcgcggcancgagagccgcgggcagtggcccccgggaggagtgcgagcgccaccaccggggggnaatttggttgggagaggcacgctgctggatgnnnannnngggggggggggggggggggggnnnnnnn

SEQ ID NO: 15124 - protein, 175 aa, Zea mays
  misc_feature: Ceres CLONE 1377412-F
  misc_feature (64)..(64): Xaa is any aa, unknown, or other
  misc_feature (124)..(124): Xaa is any aa, unknown, or other
  misc_feature (137)..(137): Xaa is any aa, unknown, or other
  misc_feature (156)..(156): Xaa is any aa, unknown, or other
  misc_feature (166)..(166): Xaa is any aa, unknown, or other
  misc_feature (167)..(167): Xaa is any aa, unknown, or other
  misc_feature (168)..(168): Xaa is any aa, unknown, or other
  misc_feature (169)..(169): Xaa is any aa, unknown, or other
MGKGSVGASWWAFLLLAGVLLVVAATAGAEDGVVERDRKEDLRWCKQACEWQYGKDTPRKRECXSECRERHQQADAGEDGDSGVDAYVSRFGKGASAGASACARTRAKPWETQEGHEGGAAAAXLAVDWNPGVRSRXREPRAVAPGRSASATTGGXFGWERHAAGXXXXGGGGGG

SEQ ID NO: 15125 - DNA, 637 bp, Zea mays
  misc_feature: Ceres CLONE 1377425-F
  misc_feature: Encodes the peptide sequence at SEQ ID NO. 15126
tggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgccgccgcggggctcgccaaggtgcgtcaggcgtccagagtcgtcgcggtgagcggggcccggcagagccgcagcggcggcgtcgccgtgcgggcgtcgctgttctcgcccaagcccgcggcggccaaggacgcgcggccgaccaaggtgcaggagctgtacgtgtacgagatcaacgagcgggaccgcgagagccccgcgtacctgcgcctcagcgccaagcagacggagaacgcgctgggcgatcttgtccccttcaccaacaaggtgtacaacggcagcctggacaagcggctgggcgtcaccgcgggcatctgcgtgctcatccagcacgtccccgaccgcaacgg

SEQ ID NO: 15126 - protein, 132 aa, Zea mays
  misc_feature: Ceres CLONE 1377425-F
  misc_feature: SWISSPROT Homolog: EC 5.3.99.6 Allene-oxide cyclase
MAAALRCPASVRVSGPAAAGLAKVRQASRVVAVSGARQSRSGGVAVRASLFSPKPAAAKDARPTKVQELYVYEINERDRESPAYLRLSAKQTENALGDLVPFTNKVYNGSLDKRLGVTAGICVLIQHVPDRN

SEQ ID NO: 15127 - DNA, 655 bp, Zea mays
  misc_feature: Ceres CLONE 1377428-F
  misc_feature: Encodes the peptide sequence at SEQ ID NO. 15128
  misc_feature (533)..(533): n is a, c, t, g, unknown, or other
  misc_feature (578)..(578): n is a, c, t, g, unknown, or other
  misc_feature (649)..(649): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgacgccgctcctggtgctcaacctcatcatgtacatcatcgtcatcggcttcgcgagctggaacctgaaccacttcatcaacgggcagaccaactaccccggcgtggccggcaacggcgcgacgttctaacttcctggtgttcccatcctggccgggcgtggtggcgcggccacncatatggggggggggggggggtccccccagggggcaccgcctggncgccacgacagcctggccaccaaacggcccgcgtcgtcggctccatcgcctgaagccatcacggcgctcgncccttc

SEQ ID NO: 15128 - protein, 51 aa, Zea mays
  misc_feature: Ceres CLONE 1377428-F
MAGIGRNMVTPLLVLNLIMYIIVIGFASWNLNHFINGQTNYPGVAGNGATF

SEQ ID NO: 15129 - DNA, 641 bp, Zea mays
  misc_feature: Ceres CLONE 1377443-F
  misc_feature: Encodes the peptide sequence at SEQ ID NO. 15130
  misc_feature (284)..(284): n is a, c, t, g, unknown, or other
  misc_feature (285)..(285): n is a, c, t, g, unknown, or other
  misc_feature (296)..(296): n is a, c, t, g, unknown, or other
  misc_feature (299)..(299): n is a, c, t, g, unknown, or other
  misc_feature (300)..(300): n is a, c, t, g, unknown, or other
  misc_feature (305)..(305): n is a, c, t, g, unknown, or other
  misc_feature (354)..(354): n is a, c, t, g, unknown, or other
  misc_feature (358)..(358): n is a, c, t, g, unknown, or other
tggagctccccgcggtggcggccgctctagaactagtggatcccccgggctgcaggaattcgcacgagaccattacctagaacatcctaatcgaaaagcgctcttcacccatttccccatctccgacctcccccttcctctcccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgnnagcgcgcccgncgnnagcgnagatgagccgcaaaccctagagcgggcgcaggagctcttcgacaggggntccnagggcatcgaggatgaggacttcgtcgacgccgtaaactggctcagccgagcgctcgagatcagggcttcacattattgaaagctccggccggagaggggcaggacatacttcaaaaagggaggggccccggtaatcaaagtcaggagggaagtggtggtttgggaaaagtcccaaaaaattgccaatgggaaaccccggggaaaagaccgttctaaaaagggaagggggaaccctcaaagggtcccgggaacaagggggggggggtgtggggccctaaaaaa

SEQ ID NO: 15130 - protein, 78 aa, Zea mays
  misc_feature: Ceres CLONE 1377443-F
  misc_feature (28)..(28): Xaa is any aa, unknown, or other
  misc_feature (32)..(32): Xaa is any aa, unknown, or other
  misc_feature (33)..(33): Xaa is any aa, unknown, or other
  misc_feature (35)..(35): Xaa is any aa, unknown, or other
  misc_feature (53)..(53): Xaa is any aa, unknown, or other
MASSSENAAVPPEEEPQAPPPPDTEPTXSAPXXSXDEPQTLERAQELFDRGSXGIEDEDFVDAVNWLSRALEIRASHY

SEQ ID NO: 15131 - DNA, 674 bp, Zea mays
  misc_feature: Ceres CLONE 1377461-F
  misc_feature: Encodes the peptide sequence at SEQ ID NO. 15132
  misc_feature (526)..(526): n is a, c, t, g, unknown, or other
  misc_feature (616)..(616): n is a, c, t, g, unknown, or other
aagctggagctccccgcggtggcggccgctctagaactagtggatcccccgggctgcaggaattcgcacgagaccattacctagaacatcctaatcggaaaaacacaaacaagaagcttgcattgttcgtttgctcgatcgttgcagataatggagaaccctgctccgagtatcgtagtgccccccattgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggccggcaggctcaagggctccacgctccttacccgaaggagtggtgacggatggatcagatgaatgggcaatctacggcggnacccggagagtttgtatgggccgagaggtgtcgtcaaaagaaggtaccttgccgataggggatggcgccgggaacactgacgagtcaacnatgcagttttcttctgcccccggggtttggctcatcacagcaaccaaacaagcaggat

SEQ ID NO: 15132 - protein, 118 aa, Zea mays
  misc_feature: Ceres CLONE 1377461-F
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTRRSGDGWIR

SEQ ID NO: 15133 - DNA, 546 bp, Zea mays
  misc_feature: Ceres CLONE 1377466-F
  misc_feature: Encodes the peptide sequence at SEQ ID NO. 15134
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcacaggcgctgacggtggcgacgctgttcccgctgagcgggctgctgctggtgctgtcggggctggcgctgaccggctccgtggtgggggctggccggaggccccgcccggtggttcgggattttttaaccccccggggttgggtcccccccccgggggtggttcaaaaagggaaaaaggggccccaagggggggttcccccccccgggc

SEQ ID NO: 15134 - protein, 115 aa, Zea mays
  misc_feature: Ceres CLONE 1377466-F
MADRDRSGIYGGAHATYGQQQQQGGGGRPMGEQVKGMLHDKGPTASQALTVATLFPLSGLLLVLSGLALTGSVVGAGRRPRPVVRDFLTPRGWVPPPGVVQKGKKGPQGGVPPPG

SEQ ID NO: 15135 - DNA, 636 bp, Zea mays
  misc_feature: Ceres CLONE 1377474-F
tggagctccccgcggtggcggccgctctagaactagtggatcccccgggctgcaggaattcgcacgagaccattacctagaacatcctaatcgaaaagactcagacggtcatggtggctcagattcagactcctccggtgcggtcggcgagctagatcccccggaggagcggccctactagcgcacatcccgctggctacagcttgagcgtggcagaactgactcgtacgcggtcgcatcgtgaccccaatcagattcgcctgccagcatcctaacggtatttgctagcgccgcctcggtgacaccaggtgtgagccacacggtgattcaagaggaccggaatggtctcgtgggtacctacgcgcgtgctccactgcggctcgcgatcggtagacctagagatgatgcaggcaaagggaaagatatcttaattgtgcgtctgaatccctctaagtgctctgatccatggaaatgctgattggcttcgagctgccactggccgacattctggtcttttcccagtcaacagtgcctataacgccattgcctagacagaattagttaaacgccgtttggaaaaggtcttttcacaggccatggtttgcttctggaaattctgggacacaatcccaccaa

SEQ ID NO: 15136 - DNA, 662 bp, Zea mays
  misc_feature: Ceres CLONE 1377487-F
  misc_feature: Encodes the peptide sequence at SEQ ID NO. 15137
  misc_feature (427)..(427): n is a, c, t, g, unknown, or other
  misc_feature (428)..(428): n is a, c, t, g, unknown, or other
  misc_feature (561)..(561): n is a, c, t, g, unknown, or other
  misc_feature (604)..(604): n is a, c, t, g, unknown, or other
  misc_feature (605)..(605): n is a, c, t, g, unknown, or other
  misc_feature (628)..(628): n is a, c, t, g, unknown, or other
aaactggagctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgattcacggnnttttttgtgggcgccggccgccatcgcgctgggcttcattggggccccggtttcgtcacctccggggggcctcggcgttcgctgcggctgtccgtgtttctcctgagatgtacaagttacctggacgggcaangcacccgtccgggcggccgaccagctggaccacgccaagggcnnaggctgggcgtccaaggcccgcngacatcaaggatgcagcacagcaccgctcgaccg

SEQ ID NO: 15137 - protein, 157 aa, Zea mays
  misc_feature: Ceres CLONE 1377487-F
  misc_feature (36)..(118): Pfam Name: Oleosin Pfam Description: Oleosin
  misc_feature (80)..(80): Xaa is any aa, unknown, or other
  misc_feature (124)..(124): Xaa is any aa, unknown, or other
  misc_feature (139)..(139): Xaa is any aa, unknown, or other
MADHHRGATGGGGGYGDLQRGGGMHGEAQQQQKQGAMMTALKAATAATFGGSMLVLSGLILAGTVIALTVATPVLVIHGXFCGRRPPSRWASLGPRFRHLRGASAFAAAVRVSPEMYKLPGRAXHPSGRPTSWTTPRAXAGRPRPADIKDAAQHRST

SEQ ID NO: 15138 - DNA, 622 bp, Zea mays
  misc_feature: Ceres CLONE 1377489-F
  misc_feature: Encodes the peptide sequence at SEQ ID NO. 15139
  misc_feature (542)..(542): n is a, c, t, g, unknown, or other
  misc_feature (586)..(586): n is a, c, t, g, unknown, or other
aaagctggagctccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcaaggatatatagataatatacaaacaaaggttcctccagagcccagagcaggagggaagtcaccggccgtcggcggggaggagatgtcggacggcgcgggctcccggacgggcgtcgctggcgcgctgggcctctcggtcacctcgtcggtgggcatcgtcatctggcacaagtacctcatcagcactctaggcttcttcttcgcgacgacgctgacgagctggcacctcatggtgaccttcttcacgctgtacgttgcgcagcggctgcgcttcttcaagcaaagncgatcgagggggggacggtcatcttctttcgggctggtcaaggnattttccattggcctcctcaactcttgcctcggtta

SEQ ID NO: 15139 - protein, 94 aa, Zea mays
  misc_feature: Ceres CLONE 1377489-F
  misc_feature (68)..(68): Xaa is any aa, unknown, or other
  misc_feature (83)..(83): Xaa is any aa, unknown, or other
MSDGAGSRTGVAGALGLSVTSSVGIVIWHKYLISTLGFFFATTLTSWHLMVTFFTLYVAQRLRFFKQXRSRGGRSSSFGLVKXFSIGLLNSCLG

SEQ ID NO: 15140 - DNA, 659 bp, Zea mays
  misc_feature: Ceres CLONE 1377494-F
  misc_feature: Encodes the peptide sequence at SEQ ID NO. 15141
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaaaggtgcgctggggnnncnnnnnccacggggggggaggaggaggcagcgcctgc

SEQ ID NO: 15141 - protein, 45 aa, Zea mays
  misc_feature: Ceres CLONE 1377494-F
MAAVEVQVPTAAPVEEAAQLAAASAVETPNEETAAPAVENRGRRR

SEQ ID NO: 15142 - DNA, 656 bp, Zea mays
  misc_feature: Ceres CLONE 1377496-F
  misc_feature: Encodes the peptide sequence at SEQ ID NO. 15143
tggagctccccgcggtggcggccgctctagaactagtggatcccccgggctgcaggaattcgcacgagaccattacctagaacatcctaatcgaaaactatcttcctatggtcgtcgtcgtcgtcgacgttggagacgtcctcgagtccccctcctctcccctgccccccggtcccgtcgaataggagcagtgcactcgcgatggaccgtgtctcagctcgtgctcctcgggctccacttactcctcttctgctccgacggcggtacgctcttggcgcctctcccgtcgacgggccccggacccgacggggacgcccacgcgtttcagcccggcgctgaatcctcctctgccggcgatggttccgcacatgtggaggcagaggtggacggaactggatccggcaacatcgttctctgtgagttatgcgcgtcctgctcgtacaggagagctgcggtgatcatgatgcggatgctggaaacgtccgttgctgagatcctggtggagttggaacattgtcgtctgctgggtctccatgcgtgctctgagtatacgtgcacgcattcttctgatggtggcgatgggaacattaatgagcgatgatgagatgttccccaggattgctgatggtcacgcactccttggcattactcactcg

SEQ ID NO: 15143 - protein, 199 aa, Zea mays
  misc_feature: Ceres CLONE 1377496-F
GAPRGGGRSRTSGSPGLQEFARDHYLEHPNRKLSSYGRRRRRRWRRPRVPLLSPAPRSRRIGAVHSRWTVSQLVLLGLHLLLFCSDGGTLLAPLPSTGPGPDGDAHAFQPGAESSSAGDGSAHVEAEVDGTGSGNIVLCELCASCSYRRAAVIMMRMLETSVAEILVELEHCRLLGLHACSEYTCTHSSDGGDGNINER

SEQ ID NO: 15144 - DNA, 649 bp, Zea mays
  misc_feature: Ceres CLONE 1377503-F
  misc_feature (218)..(218): n is a, c, t, g, unknown, or other
aaagctggagctccccgcggtggcggccgctctagaactagtggatcccccgggctgcaggaattcgcacgagaccattacctagaacatcctaatcgaaaaagtatgtagtcattatctgtgtctctccactgagattcaacacggtatcagctctttgctctccaccgagagtctaccgacgacagcagtgtccatgcatcctctcttgcgtgcgnctgacagaggaaacgctattctaagacagtccatgaagactgtccttattaatgctacaaaggcccaaacatgtcatgggattggttcatgcccaaaaaccgaaatcaatggaaagactattatttctggcacctggcaaatccgcccaaaagggccccttgtttttcctccccaagttaaaaaaaaccttttttaatcgggccacgcacttgaaaataccgggtgccccaaattttctttggggaggggggacccaaaggggttccaaatataaatttggggccccaaaaacacgggggttttttgtgggggggaaataaacccaccccccccccctcttttaaaaaaaaaaagaaaaccccccccccccccccccgagggtgtttgttttggggaaactttttggaaaaaaacacccacaaaaaaaaaa

SEQ ID NO: 15145 - DNA, 663 bp, Zea mays
  misc_feature: Ceres CLONE 1377505-F
  misc_feature: Encodes the peptide sequence at SEQ ID NO. 15146
  misc_feature (513)..(513): n is a, c, t, g, unknown, or other
  misc_feature (634)..(634): n is a, c, t, g, unknown, or other
  misc_feature (663)..(663): n is a, c, t, g, unknown, or other
tggagctcaccgcggtggcggccgctctagaactagtggatcccccgggctgcaggaattcgcacgagaccattacctagaacatcctaatcgaaaaatcacagctagttagcatacagacgaataatctcttcttcacctcactaacaccagataacaactctttctctcctgcaataatggacgctcgctcctcctcctcccagccgcatctgaacgcggcggcggcggtcctgtcagaggagatgctgctgctggcgactgcatccgcgaccacatcggcgacggcgagatgcaaggaggtgacgtgcgctgtgaacgtcgagtctctcgaacacgatgtccagcccgatgtccccctccgcggagatgatgacacgggggagatctcgatcatgactcgcgcatcttctacagcgagactgcaggtcacatgcaactgcctcgagagaatgatcggtcagcacaacccagtgtgatccatgagcagcgccgtgaacatccactgccagntcgtcgactccgacgacgtgatcatcggccacaacgatgactgtaccaatatcaactgagcgcagtacacatatggcagggagatcgctcatttgatgcttgaccacatgcgcaagattantaagaactgcatcggccaccagagattcn

SEQ ID NO: 15146 - protein, 99 aa, Zea mays
  misc_feature: Ceres CLONE 1377505-F
MDARSSSSQPHLNAAAAVLSEEMLLLATASATTSATARCKEVTCAVNVESLEHDVQPDVPLRGDDDTGEISIMTRASSTARLQVTCNCLERMIGQHNPV

SEQ ID NO: 15147 - DNA, 650 bp, Zea mays
  misc_feature: Ceres CLONE 1377506-F
  misc_feature: Encodes the peptide sequence at SEQ ID NO. 15148
tggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagcaatgggaccgccctagtgctcttcctctccccggtgcctacgttcatccgcatctggaagaaggggtcggtggagcagtactcgccgatcccgtacgtggcgacgctgctgaactgcatgatgtgggtgttgtacgggctgccgctggtgcacccgcacagcatgctggtgatcaccatcaacggcaccggcatgctcatccagctgacctacgtggcgctcttcctcgtctactccgcgggggcggcgcgccgcaaggtgtccctcctgct

SEQ ID NO: 15148 - protein, 51 aa, Zea mays
  misc_feature: Ceres CLONE 1377506-F
MMWVLYGLPLVHPHSMLVITINGTGMLIQLTYVALFLVYSAGAARRKVSLL

SEQ ID NO: 15149 - DNA, 679 bp, Zea mays
  misc_feature: Ceres CLONE 1377507-F
  misc_feature: Encodes the peptide sequence at SEQ ID NO. 15150
  misc_feature (397)..(397): n is a, c, t, g, unknown, or other
  misc_feature (422)..(422): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaaaacaaagcaaacttgagttgtttggaggcggagggagcagagaaatcccccaaccaaaccaaaccctcgccgtgccgccgcctccgactcctgctccgtccgagcctaccaccacagggcaagggcttcatccagccgcgtgcgagcctgaccgcccagttagacgatgagccgcagcctcggtatcccggtgaagctgctgcatgaggcggcgggccacgtcgtcacggtcgagctcaagaccggcgaggtctaccgcggctccatggtcgagtgcgaggaccactggaactgncagctcgaaaaatcaccttcacggnaaagaacggcagggggcccacctggaacactctttctcgggggaaaaaggggccggtctggattaaccccaattgttaaaaaacccccaagtgttagggccttgagggccgattagggaaaaagctccactttttgggtgnccaaagcccggggggccccacggggaaaaaagttttttggggccggggggggggccttttttaaaaaaggggccccccctcggggagggaaaaaatcgccccccgtggggaaaaaa

SEQ ID NO: 15150 - protein, 89 aa, Zea mays
  misc_feature: Ceres CLONE 1377507-F
  misc_feature (43)..(43): Xaa is any aa, unknown, or other
  misc_feature (52)..(52): Xaa is any aa, unknown, or other
MSRSLGIPVKLLHEAAGHVVTVELKTGEVYRGSMVECEDHWNXQLEKSPSRXRTAGGPPGTLFLGGKRGRSGLTPIVKKPPSVRALRAD

SEQ ID NO: 15151 - DNA, 659 bp, Zea mays
  misc_feature: Ceres CLONE 1377509-F
  misc_feature: Encodes the peptide sequence at SEQ ID NO. 15152
  misc_feature (405)..(405): n is a, c, t, g, unknown, or other
  misc_feature (443)..(443): n is a, c, t, g, unknown, or other
  misc_feature (576)..(576): n is a, c, t, g, unknown, or other
  misc_feature (577)..(577): n is a, c, t, g, unknown, or other
  misc_feature (590)..(590): n is a, c, t, g, unknown, or other
tggagctccccgcggtggcggccgctctagaactagtggatcccccgggctgcaggaattcgcacgagaccattacctagaacatcctaatcgaaaaccccccccccccatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggttcaagcagcttttgcgaatggaggtgccactcaagttcgctcctttgccaaggatgcagctccagctgaccgtcctcctgttggtggcgatgatctcctgaagggcatattctttgaggtaaagaagaagtttgagacagctctcggcgtccttangaaggaaagatcactattgatccagatgacccagcggncagttctcaatatgctcaagtcatgaagactgtaagggaaaaggcggatcttctttctggatctcaaaggattaaatataccattgagaccttcaccaagggcatccctgatgcacggacttacttgaatacnntctcacagctcanaataaagagtggccttatagatcatatcgaaatcgaacctttgatgatggaagctcttgagaagatgaa

SEQ ID NO: 15152 - protein, 89 aa, Zea mays
  misc_feature: Ceres CLONE 1377509-F
  misc_feature (69)..(69): Xaa is any aa, unknown, or other
  misc_feature (82)..(82): Xaa is any aa, unknown, or other
MAMAARLVSRSRQLHSVQAAFANGGATQVRSFAKDAAPADRPPVGGDDLLKGIFFEVKKKFETALGVLXKERSLLIQMTQRXVLNMLKS

SEQ ID NO: 15153 - DNA, 649 bp, Zea mays
  misc_feature: Ceres CLONE 1377510-F
tggagctccccgcggtggcggccgctctagaactagtggatcccccgggctgcaggaattcgcacgagaccattacctagaacatcctaatcgaaaaatcaaccatattattgagaccaacaagcaacatagaatgtggaatccaatagcaacaatagaacaacaatgacgaccaagatattttccctccttatgctccatgctctttctgcatgtgttgctaatgcgaccattttccctcaacgctcacaagctcctatagctgcccttcttcacccatacctcccatcaatgatagattcagtatgtgaaaacccagctcttcaaccctataggctccaacaagcaaatgcagcaagcaacttacctttatcaccctcgttgtttcaacaatcgccatccctatctttggtgcagtcattggtacaaaccatcggggcacaacagctgcagcaactcttgctacttgtgatcaaccaagtagctctggcaaacctttctccctactctcagcaacaacagtttcttccattcaaccaactgcctacactgaacccttttgcttatttgcagcatcaacaactattaccattcagccagctagctactgcctactctcagctacgacaacttcttccatttaaccaat

SEQ ID NO: 15154 - DNA, 632 bp, Zea mays
  misc_feature: Ceres CLONE 1377512-F
  misc_feature: Encodes the peptide sequence at SEQ ID NO. 15155
  misc_feature (297)..(297): n is a, c, t, g, unknown, or other
  misc_feature (298)..(298): n is a, c, t, g, unknown, or other
  misc_feature (343)..(343): n is a, c, t, g, unknown, or other
  misc_feature (396)..(396): n is a, c, t, g, unknown, or other
  misc_feature (397)..(397): n is a, c, t, g, unknown, or other
  misc_feature (406)..(406): n is a, c, t, g, unknown, or other
  misc_feature (407)..(407): n is a, c, t, g, unknown, or other
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccgnngcggaggacggagtggtcgaacgggacccgcaggaggacctgcgntggtgcaaagcagcgtgcgagtggcagtacggaaagggacacccccgcggaannaggaatgcnnaaagcgagtggccgcgagcggcacccagcaagctgaccgcgggcgaggaacgcgaacaggcgcggtggacgcctacgtctccccctccgggaagggggcgagtgcccggccccaggtgcttggcccgccaccaggggccagcccgggggaaaccccangaaggcattgaagggggggccccccccccggaattggcccttcaaattggaaaaaaaaaaacgggcc

SEQ ID NO: 15155 - protein, 139 aa, Zea mays
  misc_feature: Ceres CLONE 1377512-F
  misc_feature (28)..(28): Xaa is any aa, unknown, or other
  misc_feature (61)..(61): Xaa is any aa, unknown, or other
  misc_feature (65)..(65): Xaa is any aa, unknown, or other
  misc_feature (117)..(117): Xaa is any aa, unknown, or other
MGKGSVGASWWAFLLLAGVLLVVAATAXAEDGVVERDPQEDLRWCKAACEWQYGKGHPRGXRNAXSEWPRAAPSKLTAGEEREQARWTPTSPPPGRGRVPGPRCLARHQGPARGKPXEGIEGGAPPPELALQIGKKKTG

SEQ ID NO: 15156 - DNA, 693 bp, Zea mays
  misc_feature: Ceres CLONE 1377514-R
  misc_feature: Translation starting site: 344
  misc_feature (623)..(623): n is a, c, t, g, unknown, or other
cgattgggtaccgggccccccctcgaggtcgacggtatcgataagcttttttttttttttttttggttttttttttttttttttttttttttttttttttttacatctatcggtctatttattcttttaaacccaaacttttttttgaccttgcatatattaatgggcataccacacatgaaaatgtgtggcgtcttactgcattattacatatttttattagaaaaaaatggatacaggagatttcccaaatatcatgaatcaaaaatatggcggaatggcaaccgatacgccacaggggttggtgcggtagctgggcagctggcactggtagaatccacccatggccgggatgttctgggccatcctcatggccatggggtttaaaccctgggctgccagcaactgctgctgctgctgcataagaactggctcctacacgctgctgctggcggcaaccgcacgctcaaactttatcatcatctggggctgctgcgcgaccgactgcacgaccatcatccccataagatgctggcagcactgttcccagaccggctgggacatggcgctcggctgcccacacccggcgtattagggcgccaccgacagcgggctgcactgcngctggctcatgtactccgcggaagggaacacgccgccggcgcccattatagtcctcaggccggttccaac

SEQ ID NO: 15157 - DNA, 648 bp, Zea mays
  misc_feature: Ceres CLONE 1377514-F
  misc_feature: Encodes the peptide sequence at SEQ ID NO. 15158
tggagctccccgcggtggcggccgctctagaactagtggatcccccgggctgcaggaattcgcacgagaccattacctagaacatcctaatcgaaaatcctcccccctcaacaaccgcgagatcttcagctaccgctctctccggtcgcgtttgcatccgcattcctcagatccatattccagccccagccccggttccagatccatgtagctctctatcaagcatccgtggcatggagcagcgcgaggctcggcaagatagaagatgatgcggaagacgcgaaacaagatcatcgtatggacgctgtgcctgcctgcagtgacgattctggtgagtggcacgattgcgctgttgctcacggcgcctacgaggaaggccaagataaagaaatcgcacgagaacatctgtaacaaggggtgggagtgctcgaggagaaagtactgatgcaacgacaccatcaccgacttcttcaaggtgaaccagatcgagaacctcttcgccaatggcaacacccccgtcgtgcacgacgtcggtctctggcactaccaggacttcatcatcgccgcggacctcttcgagccccaggtgttctgcaccaccggcgacatgcagatgctgatgatgcagctctgcgacttcctcggaca

SEQ ID NO: 15158 - protein, 59 aa, Zea mays
  misc_feature: Ceres CLONE 1377514-F
MMRKTRNKIIVWTLCLPAVTILVSGTIALLLTAPTRKAKIKKSHENICNKGWECSRRKY

SEQ ID NO: 15159 - DNA, 649 bp, Zea mays
  misc_feature: Ceres CLONE 1377515-F
  misc_feature: Encodes the peptide sequence at SEQ ID NO. 15160
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtacctactagcgcgagtgccactgtgccgcagctgcctgctcgccattactgcaagctgtgttcaatcaaagcttaattaggctccctctacatctgatccagctaagtagctagccagcactacagaagggcgtgccaagaatcaggagagagatagcaggggggctagctagctgagctcgtgcgacgaagaatggccggaattggcaggaacatgatggcgccgctcctggtgctcaacctcatcatgtacatcatcgtcatcggcttcgcgagctggaacctgaaccacttcatcaacgggcagaccaactaccccggcgtgaccggtaacggtgcgacgttctacttcctggtgttcaccatcctggccggcgtggtgggcgcggcgtccaagctggcgagcgtgcaccacgtgcgcgcctgtcgccacgacagcctgtccaccaacgccgcgtcgtcgctcatcgcctgagccatcacggcgctcgccttcgggctgcc

SEQ ID NO: 15160 - protein, 93 aa, Zea mays
  misc_feature: Ceres CLONE 1377515-F
  misc_feature (14)..(94): Pfam Name: AWPM-19 Pfam Description: AWPM-19-like family
MAGIGRNMMAPLLVLNLIMYIIVIGFASWNLNHFINGQTNYPGVTGNGATFYFLVFTILAGVVGAASKLASVHHVRACRHDSLSTNAASSLIA

SEQ ID NO: 15161 - DNA, 655 bp, Zea mays
  misc_feature: Ceres CLONE 1377517-F
  misc_feature: Encodes the peptide sequence at SEQ ID NO. 15162
aaagctggagctccccgcggtggcggccgctctagaactagtggatcccccgggctgcaggaattcgcacgagaccattacctagaacatcctaatcgaaaaatcgcacatattatttagaccaactagcaacatagaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactattaccattcagccagctagctactgcctactctcagcaacaacaacttcttccatttaacccattgggcgcactgaaccccgctgctt

SEQ ID NO: 15162 - protein, 165 aa, Zea mays
  misc_feature: Ceres CLONE 1377517-F
MAAKIFCLLMLLGISASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQQQLLPFSQLATAYSQQQQLLPFNPLGALNPAA

SEQ ID NO: 15163 - DNA, 666 bp, Zea mays
  misc_feature: Ceres CLONE 1377521-F
  misc_feature: Encodes the peptide sequence at SEQ ID NO. 15164
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaagtaagggcgaggaatggcaagcctttcatgtgctcgggcggacgctgttgtccgttccggcgctctgcccgccaagctgttgctgtgccccagctgctgcttccctacgggggctccagtcccggacggagaggtgcaggtgcttgcctgccgccagtatctccaccgcttgccgagggagtcaggatctcccgtcgccagggcccggcgcccgtcgcatcctccggctcttccgcctccaccaacaagccgcgacaccgcggcccttgtaagctggacaacggccgaactcgaccccccccgtccgggtgttccttacccgggggccgcccttgagcccgccg

SEQ ID NO: 15164 - protein, 110 aa, Zea mays
  misc_feature: Ceres CLONE 1377521-F
MASLSCARADAVVRSGALPAKLLLCPSCCFPTGAPVPDGEVQVLACRQYLHRLPRESGSPVARARRPSHPPALPPPPTSRDTAALVSWTTAELDPPRPGVPYPGAALEPA

SEQ ID NO: 15165 - DNA, 481 bp, Zea mays
  misc_feature: Ceres CLONE 1377531-F
  misc_feature (278)..(278): n is a, c, t, g, unknown, or other
aagctggagctccccgcggtggcggccgctctagaactagtggatcccccgggctgcaggaattcgcacgagaccattacctagaacatcctaatcgaaaaatctcccataatattttcagcattcaaaaacacaccacgcgaagcgcactagcaacgacctaacaccaatggctaccaagatattagccctccttgcgcttcttgcccttttagggagcgcaacagatgacgtgcaattaattccacagtgagtcacttgctccctagggggccggnaatttccaccggtccctccagccgtaatttcaagggaattcaagaaaccgcccgggaaggcctaagggtaacaaaaaacttttgggggccaagcgcctttaaaaaaaaacagtgtgggcccaattggtcaaaaaaaaaatcccccggggggccccttttttttcccccccaaaaaaaccccttttttttgaaaaaaaaaaaaa

SEQ ID NO: 15166 - DNA, 645 bp, Zea mays
  misc_feature: Ceres CLONE 1377535-F
tggagctccccgcggtggcggccgctctagaactagtggatcccccgggctgcaggaattcgcacgagaccattacctagaacatcctaatcgaaaaagatcctccataccctggactggagtgtctgctgctcgtggccgtagatgagaggcaatggccccagaggtgcgtgcgggccaaactcccgcgtggagaccatctcccggatggggcagggatggatcgatatgttcggaccctgatcctaccggcggtcgcactcctttaagatcggaatctgctactggcacctgtcgacggacaagagccgctccatcgttgtgcgcctctatccggagaccgccagttcgtccaaggaccagtctcctctctcgcggttcctgctccgagtctcctaggccgaaccgacgcgagtctcctgcgtctcacgtgagcacgagcatcttctgcgtaccagtgatgaaattgtatgacaagacgatgcaatggcccatgagcgttacacgatggatggtgagatctaggactgtggtgaccacgaacagtgcttcaggatcctcatcaatgtgatggactagtgcatgagcagaagatcggaagaagagcgacctggactgcatgtaagaaggatgggcgactcataa

SEQ ID NO: 15167 - DNA, 652 bp, Zea mays
  misc_feature: Ceres CLONE 1377538-F
  misc_feature: Encodes the peptide sequence at SEQ ID NO. 15168
  misc_feature (647)..(647): n is a, c, t, g, unknown, or other
tggagctccccgcggtggcggccgctctagaactagtggatcccccgggctgcaggaattcgcacgagaccattacctagaacatcctaatccaaaaaaacggtaaaggcacaacgaataagagagatcaactactcatgcaagcactgcggtatttaatttagattcttaggaacaaaaacaccaagcaccaactttgtacatattaatggacgccatgcacatggtgatcgatcggactatatagaaagacaggcgcttactagagaaggtgtgtggagtccaagctacacacgggatgctactaactagctgcaggtaagggcgaggaatggcaagcctttcatgtgctcggtcgaacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgacgccatcctcagctcgtcggtctccaccagcagccgcgacagcgcggacttgtagctgtccagcgccgcgtccacctcggcgtccgcggctcctagccgagccgccctgagtcgccgncgcgt

SEQ ID NO: 15168 - protein, 97 aa, Zea mays
  misc_feature: Ceres CLONE 1377538-F
MASLSCARSNGVVRSGALPAKLLLCASCCFPTAAPVADGEVQVLACRQHLHRLPRRQDLRRQRPRRRHPQLVGLHQQPRQRGLVAVQRRVHLGVRGS

SEQ ID NO: 15169 - DNA, 794 bp, Zea mays
  misc_feature: Ceres CLONE 1377539-F
ccgagctgggagctcacgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgcccccgtggtggtgctggggcgccccccccgccgttgtgcttggtgtgggtctcggccgcgggcgcggtggtctctcgcctctgcctctccttggtggcggcccgtcgcacgcggcgcccgacggcggcggaggggccacggcggcgcgcacggagcgatagcggggggggagtgaggactacccccgggctgactttgccgcgatcccctccccgcatccttgtgtcccagcaccattgtgtaggaatttttgtttcgccactttcatcccgctgcctggctgctgatgtattatgcgcgttcttggagtgcgccccccccaccgctggttgggcgctctcgccgccgggtggcgtgcgcccgccctcgtctccctttcgctcgccgtctccccgtccggcggccccttgcgcgttccgttcctcatcctccccccgcccccgcgccggcacccccgccccaccgcgcccgccggccccggtctccgcggcttccgccccgcgcccgatctcgcgcctccccgtgcggccaacctgtcttccatctacacaggatagccg

SEQ ID NO: 15170 - DNA, 782 bp, Zea mays
  misc_feature: Ceres CLONE 1377542-F
  misc_feature (1)..(1): n is a, c, t, g, unknown, or other
ncccgctgtagctcaccgcggtggcggccgctcttgcactagtggatcccccgggctgcaggatttcgcacgagaccattacctagaacatcctaatcgaaaatagcccagcaccgcagaggcgcagagacaggcgtcttcgtactcgcctatctccgcgactcaaagcttcttccatttcctaccgccgccgctgcagctccaccccattccgtcgacaccgtgagggagtggatctcgatacacatcgcgccaagccggtatccaggtcggaaacgcgcgctgggagctctattgtcttgagcatgcccttcgggcggatggtcggatgcccgggcgactcacccccctgcgtggtggttgtagttttttgacagacacaaaccccgcccgaaacggccccgcgcgcccggacaaaagcgcgcggcgcttcccccactccctcgacccccaccaccaccccgccgtcaccgagcttactaccgcgccgttgcgtcgcggcaccccgcgccctcccctcttttttagaagcccgggaggaaggacccccccccccccccccaactgcgggcccgcatcgccaccaccaacacgcagcccatcagcccccgcaccccccccccttcacacccccccgaccccccacccacgcgactctcccccattttttgcgcgcgcaatcccttccgcccgcccggcgcggcaagatgtaccgcaacgcggcccgctcgctcccaactctccgctcctcccccccaccgttcttctcctcctcccccccg

SEQ ID NO: 15171 - DNA, 760 bp, Zea mays
  misc_feature: Ceres CLONE 1377543-F
cccgctggagctccccgcggtggcggccgcttctacaactagtggatcccccgggctgcaggtattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagccgcagcagggaggaggcgcccgcccgatgggtgagcaggtgaatggcatgatcctcgacaaggcgacgacggagaagcaacgcgctgacgcacgtagaccctgcccccgccgaaacgagcagaccgcatgccgctcgccccccctgcccgctcgtatcaacacccgtgaccgccacatccccaccgccccacctccagtgactccaccgcagttaaactcgacgacccgccatatacccccccgcccgcggcgggcccccccccccctcccccggccggggcccgcgagtcgatgttgagtgacacccaccgcgcacaccacccatccaccccccactcctccatccccacacccccagaatcaccccccccctccagcccaccaacccgacacgcgggcgcgtatggcgaacgcgacacagctagcgcggtgtcatatacagcaccgccccccactcccacgcaccttcctcacgtagtactgaaaatgccg

SEQ ID NO: 15172 - DNA, 696 bp, Zea mays
  misc_feature: Ceres CLONE 1377545-F
  misc_feature: Encodes the peptide sequence at SEQ ID NO. 15173
ccaagctggagctcaccgcggtggcggccgctctatacactagtggatcccccgggctgcaggaattcgcacgagaccattacctagaacatcctaatcgaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgctgctgcagaccttgtcacggctatggccaggcccagggcaagggcaacgcctccgcttctcgaccaggagcggaccgcggcgggaatgctccaactctgacccgaccccccccccaccccacccgctaccttgctcccagcctcgcaacacctcgaccccccgttctctactctctgcctccgtatagcattcatcattgccccccccccctcccccccctgcacaccacaagcccctgttgcacccccatcgccccatacctccccctccccaactaccccccgtcttttcttcctccccgctcccccattccctcttctccctcctccccccttcccccctttcccctcttccccccccccctcatcctataatcctccttcccaccccccg

SEQ ID NO: 15173 - protein, 70 aa, Zea mays
  misc_feature: Ceres CLONE 1377545-F
MAMGAASILLMMVSLEALLLAAAAGGGTIRLPSDVGGAAADLVTAMARPRARATPPLLDQERTAAGMLQL

SEQ ID NO: 15174 - DNA, 680 bp, Zea mays
  misc_feature: Ceres CLONE 1377547-F
  misc_feature: Encodes the peptide sequence at SEQ ID NO. 15175
  misc_feature (326)..(326): n is a, c, t, g, unknown, or other
aaagctggagctcaccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttcccagatgatggtggcggcagctctgctggccttggccctggncgtgtcgattcgcgaggcaagaacatcaagaccccgacgacggagaaaaggacgacccggtggtggaaccccaaaccttccggcccttcaacccgctctggggggggcgggtccccggggtcgggggcccccccgggggaagattccctgaagaaactttccccggttcagaagggcccccccacgccatccccttccccgggtcttctttccccggagggggtgcacttcccccctttcggcgggggtccccccgcctttctcggcgttcccccgggtccccgcggtcccccaccgccttttgcgggcccaacccacacacacaccctccccatccccccccgtgcgtctttg

SEQ ID NO: 15175 - protein, 68 aa, Zea mays
  misc_feature: Ceres CLONE 1377547-F
  misc_feature (19)..(19): Xaa is any aa, unknown, or other
MARSSQMMVAAALLALALXVSIREARTSRPRRRRKGRPGGGTPNLPALQPALGGAGPRGRGPPRGKIP

SEQ ID NO: 15176 - DNA, 676 bp, Zea mays
  misc_feature: Ceres CLONE 1377548-F
  misc_feature: Translation starting site: 216
  misc_feature (227)..(227): n is a, c, t, g, unknown, or other
  misc_feature (230)..(230): n is a, c, t, g, unknown, or other
  misc_feature (232)..(232): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (498)..(498): n is a, c, t, g, unknown, or other
  misc_feature (499)..(499): n is a, c, t, g, unknown, or other
  misc_feature (502)..(502): n is a, c, t, g, unknown, or other
  misc_feature (506)..(506): n is a, c, t, g, unknown, or other
  misc_feature (510)..(510): n is a, c, t, g, unknown, or other
  misc_feature (516)..(516): n is a, c, t, g, unknown, or other
  misc_feature (517)..(517): n is a, c, t, g, unknown, or other
  misc_feature (646)..(646): n is a, c, t, g, unknown, or other
cccagctggagctccacgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggnagngngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnccncccncccnccccgnngcgggcgcgggggcggccgcgccccccccggcccgggggcggccggggggcccggcgcggcggcgcgggcccgcgcggggggcgggccgcccgccgcggccccccccggcgccggccggggcgggcgcngcggccgcggggggggggccccgcgccccc

SEQ ID NO: 15177 - DNA, 682 bp, Zea mays
  misc_feature: Ceres CLONE 1377551-F
  misc_feature: Encodes the peptide sequence at SEQ ID NO. 15178
  misc_feature (207)..(207): n is a, c, t, g, unknown, or other
ccccgctggagctcaccgcggtggcggccgctctatcactagtggatcccccgggctgcaggaattcgcacgagaccattacctagaacatcctaatcgaaaaaaaacaagaccaccgcaccatggaatcgctgacgcttcgcgcttcgacggccgcctcgccgctgcagcgacgccggctgctccccggacggcagcgcgcgacgnacgtccgcgccacggcctccgccggcgagccggacctctccgtgcgcgcgaacgggctgcagatgccccacccgttcgtgatcgggtcggggccaccgcgcaccacctaccctgccctgtggcgcgcctacggggaggcctggggggccgccatctctcagccccgcgcccccgggggggggaaaacccggcctcgcggaccccccccctcccgcgtcatccgccccaccccccatgggccgcgccccccccccccaccccggccccgccccgacccctaccccccgccgctcgccccccccccgcccgcacaggggttgccccctaccccgtcgccccccccctccaccacattccccctcccgcctgggcgcgtcccccccccccccgccccccccccccccgccgccccctcatatattataggacgacacgcgccccggatcggatggcccgcccccaccccccccccccg

SEQ ID NO: 15178 - protein, 186 aa, Zea mays
  misc_feature: Ceres CLONE 1377551-F
  misc_feature (29)..(29): Xaa is any aa, unknown, or other
MESLTLRASTAASPLQRRRLLPGRQRATXVRATASAGEPDLSVRANGLQMPHPFVIGSGPPRTTYPALWRAYGEAWGAAISQPRAPGGGKTRPRGPPPSRVIRPTPHGPRPPPPPRPRPDPYPPPLAPPPPAQGLPPTPSPPPSTTFPLPPGRVPPPPAPPPPAAPSYIIGRHAPRIGWPAPTPPP

SEQ ID NO: 15179 - DNA, 608 bp, Zea mays
  misc_feature: Ceres CLONE 1377552-F
  misc_feature: Translation starting site: 192
  misc_feature: SWISSPROT Homolog: EC 2.3.1.1 Amino-acid N-acetyltransferase
  misc_feature (15)..(15): n is a, c, t, g, unknown, or other
cccgctgtagtcccngcgtgcggcgctctagactagtgacccccgggctgcaggaattcgcacgagaccattacctagaacatcctaatcgaaaaattccactgtttctctctcgaaatcggcgtctctctcccgtccggcacttcctccgatcgactagcctgcgggggccgggccggcgaccagcggccatgcgggggcacccaggggtcttcccgccgggaggcggggtacgggtgccctgccgcgcgctccgcccggcgccgggtaatagggagtctcgtattagagtccgccgggacagacggcccccccggccgccgccgcgccgagtcctcgaccttccgtcccgggccgctcgcaggggccccgcgcgcccggcggacgccggggagcgggggccgccgggtcgtcccgccgcgccgccgccgccgccgccgcgcggcgggggccccccccccccgcctccctctcacgacaccccaaccgctccgtgcccccccgcccccgcatcgagagcacggggggcacgcacccccactcggggcgccgcccgcccgagccgcccccccctcgggccctgggcggggggggggccaccccctgcg

SEQ ID NO: 15180 - DNA, 672 bp, Zea mays
  misc_feature: Ceres CLONE 1377553-F
  misc_feature (21)..(21): n is a, c, t, g, unknown, or other
ccccgctggagctcaccgcgntggcggccgctctatcactagtggatcccccgggctgcaggaattcgcacgagaccattacctagaacatcctaatcgaaaaactgccgcatgagaagatagcagtatagcaccgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcacgtgcgcatgcaactattgctgcttccagcgtggtgcttactttgggcctggattgtgtgcctgcctgcttccccccccacctatctaacacaccctcacgtcccctgactcccccccccctccccccacctcatcggtccggactgtctccccccacgcacctccctcgtgaccgcatcgcctgccgacccctcacgggccgatcctcccggcatcggttcactcccctcacccgatcctgctctccctccccctcatggcctatgccgcccccccccccccacccccctccgcctcccgcccccaccctcccccccgcccccagtcccgcccc

SEQ ID NO: 15181 - DNA, 650 bp, Zea mays
  misc_feature: Ceres CLONE 1377556-F
  misc_feature (20)..(20): n is a, c, t, g, unknown, or other
  misc_feature (23)..(23): n is a, c, t, g, unknown, or other
cccgctggagctcaccgcgntgncggccgctctagtactagtggatcccccgggctgcaggaattcgcacgagaccattacctagaacatcctaatcgaaaaattttcatttccccacctctctaaaaccctcgctcttgcccgctgttttacacctaaaagaaaggtcctcgccgtcgagccgccggctcccatctcccgcgccgtcgccgacgaggacacaccagacgcctcgctgatggccttggctcgcctcggacggtctcttgccggacgcctcccccgctctatctaccgtccaccggcgcccgcagaccacgactgcctcccgctcccgacccttcgctgcgacccgcacacgtttttgctcaccacccccccccccgggtgacgttccatcgccccgtgtctcgccccccccccccgctctagggccccttggtagtccgccatgcagccgcccgccccccgcgcggggggccccccccccccccccacgcccgctggccccccgcctcccacccccccggccgcctgcttgtccccccccccccctttctcttccaccaccaccgctcccgtctcctctcccctcccctccccccccgcctgacttcgcgccctgcgcgccccgccgtcgtatgcccgcg

SEQ ID NO: 15182 - DNA, 729 bp, Zea mays
  misc_feature: Ceres CLONE 1377557-F
  misc_feature: SWISSPROT Homolog: EC 1.10.99.1 Plastoquinol--plastocyanin reductase
  misc_feature (21)..(21): n is a, c, t, g, unknown, or other
ccccgctggtagctcacgcgntggcggccgctctagtactagtggatcccccgggctgcaggaattcgcacgagaccattacctagaacatcctaatcgaaaaaaagctttcgaggactacatccatcaatggcgtcctctcccatttcccctgctactcagcttggttcgagcagaagtgctactatgttggcgatgatgtcgcgcgggatgcctgtgaagccagtgaggacgagtcaccagatgctgaggaaggacaacaccgccccgcagaccccgcgcccaccctccgccctagtggtggtggttacggccgcacacgccgaagccccccttttccccctttctctcccccccccctcccttttcttccccttctccccccccaccgcggcgcggccttccgctccctcctcccctttggggtcaggcggcgctgcgcctgatctggtcaccccgccgcgcctccccccgcccgcgctccccccccccccatgccgtagctccttccgtggcccccccccgccccacccctcaccacccaactacgttgactacagggaactgcactccggcccctccctctgcgcgctgtcgcgcttccccgtatctcaattgattacagaacccttgtccccctgttcccgcccgctctccgccccccctcacgcccccaccccctccaccctaagaactccgaggcacgcggccccatcggtgctccatccg

SEQ ID NO: 15183 - DNA, 654 bp, Zea mays
  misc_feature: Ceres CLONE 1377559-F
  misc_feature: Encodes the peptide sequence at SEQ ID NO. 15184
cccgctggagctcaccgcggtggcggccgctctagaactagtggatcccccgggctgcaggaattcgcacgagaccattacctagaacatcctaatcgaaaaacaaagcttgcgtttttgatctaatcgacaatggcgttcccaaaggttttcttcgatataagcataaacggccaggcagcgggaaggatcgtgatggagttgtatacggataagactccgaagacggctgagaatttcagagctctgtgcactggagagaagggagtggggtgtaagggaaaaccccttcacttcaagggatcctccttccaccgagagatccccaatttcatgtgacaggcaggtgatttcttttttttttcccccccccgcaggcgagtccatctaccccgatattttcgccgaccccacctttgcgaggaggcccgccgccccccgctacctttcaaaggagttatgccggagctagcactcaggcccccccccctcctcctcttggagggtaagtaacgaattgaactgtgacaccaaaaacacgggctgctccatctcccacgaaggtatgccccgcccccccccccctccccccccactacccccaccaccctcattgtacgttcgtggtcgcgcacgcatttcccccgcattgcg

SEQ ID NO: 15184 - protein, 68 aa, Zea mays
  misc_feature: Ceres CLONE 1377559-F
  misc_feature (5)..(69): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
MAFPKVFFDISINGQAAGRIVMELYTDKTPKTAENFRALCTGEKGVGCKGKPLHFKGSSFHREIPNFM

SEQ ID NO: 15185 - DNA, 699 bp, Zea mays
  misc_feature: Ceres CLONE 1377564-F
  misc_feature: Encodes the peptide sequence at SEQ ID NO. 15186
ccagctggagctcaccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcgccgacgcgcgcatgatctcctccaaggagctccgctctcacgcgtccgccgacgacctctggatctccatctccgggcacgtgtacgacgtcacgccctggctcccccaccatccgggcggctacctcacggttctccctctgccggaccaagacgccccccaccccgttcgccgcctaccaccggacctcggggccccagatcccccccccgctccttcccgggccgtcgtctcgcactaggggcgccccccccccggtcggacgaacacagcccgccttcccggccgcaggtatcaccccgcgggcgcctcttcggaaccgaggcggagccccacccccccaggcagcccgactcggtcccaacacgcacagaacctcatacaacgggcgagcactcatgatggaccgtcgtccggcccggtcgtctatccggctccgcggccc

SEQ ID NO: 15186 - protein, 97 aa, Zea mays
  misc_feature: Ceres CLONE 1377564-F
  misc_feature: SWISSPROT Homolog: EC 1.7.1.1 Nitrate reductase (NADH)
MPPSVDAMPAPGDAAGGADARMISSKELRSHASADDLWISISGHVYDVTPWLPHHPGGYLTVLPLPDQDAPHPVRRLPPDLGAPDPPPAPSRAVVSH

SEQ ID NO: 15187 - DNA, 698 bp, Zea mays
  misc_feature: Ceres CLONE 1377567-F
ccagctggagctcaccgcggtggcggccgctctagtactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgtttcccccccccccacccaccagacccgccccccgggacccccggcccccgagctgcttctggggacgctgaccccccggccgtggatgactccgccgcaccgaccccgaacccccggcacggtccgttctgagatcccgtctcccggccccacccacgacccccccgactaccccccctccgcggcccgcgccgcccctcgcccacgcccccgccccccctcttcccccgccatgtatcccactcatcatgcccaacccccccgcctcgcctctacaacccatctaatgtcctcaatcacaccttccctctgcgtcccccccccccca

SEQ ID NO: 15188 - DNA, 651 bp, Zea mays
  misc_feature: Ceres CLONE 1377568-F
  misc_feature: Encodes the peptide sequence at SEQ ID NO. 15189
aaagctggagctccccgcggtggcggccgctctataactagtggatcccccgggctgcaggaattcgcacgagaccattacctagaacatcctaatcgaaaaaccccacccacctccgcttctctccaagtgaggaaccccaagccctcgccatggcgtcgcggatcctggcccgatccaaggcccttcccctcgtcgccgccctcacccctgccgctgccaaagcagcaacgcctatcgccggagcccgcgcgctctcgtccctgccccgctacccgtctgccccgtcgccccatgggctcggcaaggttctgggatatgaaccaacatctcacctcagtggaccacaagttttacctcgttggttttcctctctagcatccaatggatctcaggtgcagaagtcacagatctctgagacatacaagtcaggtggtgaaatgaaacagtctgagacacggaaatcaagtgaggaagccacaccaaaagttgtggcgttcagtccgctagaagcagctatcgctaaacctagaagtagtcccctgacaagtgagagttctaaagtaaggcgatcagagatagctaacccccaaagtttgacccctttttataatggaatcccaaccccgggttttttgggcccccaaaaaa

SEQ ID NO: 15189 - protein, 166 aa, Zea mays
  misc_feature: Ceres CLONE 1377568-F
MASRILARSKALPLVAALTPAAAKAATPIAGARALSSLPRYPSAPSPHGLGKVLGYEPTSHLSGPQVLPRWFSSLASNGSQVQKSQISETYKSGGEMKQSETRKSSEEATPKVVAFSPLEAAIAKPRSSPLTSESSKVRRSEIANPQSLTPFYNGIPTPGFLGPQK

SEQ ID NO: 15190 - DNA, 739 bp, Zea mays
  misc_feature: Ceres CLONE 1377570-F
cctgctgaagctcaccgcggtggcggccgctctataactagtggatcccccgggctgcaggaattcgcacgagaccattacctagaacatcctaatcgaaaaactcctcatcgccacaagtgaagtcaccgacgcacgcacggatgcagcgcgctcctactctcccgcgaccgccaccggggaggggcaatagaatatagcgaggacagccaatgcaggccgccgtcaacaccaccactgccggcgctaccccgcaccccacacagtactcgttcctccggccatcccctcccttgccgggtctacttacacgtttctccccgcccgaaccatacggtcgacccccccccccccccccagtgggaagcagcccccagcagcagacccaacaagtcgccaccacccaccagccccactccgtcgctgcgcaaacggccgcgaccccccacaccaccgctaactccccccctgggggcccccgcccttcccccccaccccccccgtccagtgtgggggaggggcccgcacccctcctctcgcacacccccaccccttcctcgggcccccccctctctacaggtatccacccaccacattagcaacactctcctcccaccccccgctgtcccgcccgcaagcccatctgcaggcctcactcgcccagaccacctccccctcacccccctccgccgcgtcctcgccacccacccctctgccacgccccccatgctgtctctcc

SEQ ID NO: 15191 - DNA, 716 bp, Zea mays
  misc_feature: Ceres CLONE 1377572-F
cctagctggagctcaccgcggtggcggccgctctatgcactagtggatcccccgggctgcaggaattcgcacgagaccattacctagaacatcctaatcgaaaaagattaccaccacctccacctcgtcgtctcccaccaccgccgagcgcgagccctagcccgatctagccggcggcaggcaccagatcccgccgcccgcggtgtcccgggacgcgccccgccgaatccgccgctcctcgtactgcaacacgcccgggacacggggcatttgatccgagccgcgcgcctacacgatgtccaagtcggaaggcccggaccttgctcctgggccccgcaggggaccccccccaccgccgccccaaccccccccccccccgggccctcacacatatccggggcccctctgcgggccacccccggccctcccgcgcttcctccatgtatggtcgccgttgccgccgtgtgggggtgccgccgcccccccgccgtccccccgtttgttttgcgccccccccccctccccccccccctccgctgcgtgtgtgttcgtggggccggcctcctcccttcccggagtgtcctgtctccgcgctcccgctcactccctccccccccccgccgcgcgccccctccccaccccgcgccccccctcccctatcgcctcctccccgcgctttccgcctctcccccccccctgcccctcccactcccccg

SEQ ID NO: 15192 - DNA, 671 bp, Zea mays
  misc_feature: Ceres CLONE 1377577-F
  misc_feature: Encodes the peptide sequence at SEQ ID NO. 15193
  misc_feature (263)..(263): n is a, c, t, g, unknown, or other
  misc_feature (266)..(266): n is a, c, t, g, unknown, or other
  misc_feature (269)..(269): n is a, c, t, g, unknown, or other
  misc_feature (324)..(324): n is a, c, t, g, unknown, or other
caagctggagctcaccgcggtggcggccgctctataactagtggatcccccgggctgcaggaattcgcacgagaccattacctagaacatcctaatcgaaaaactcctaagcgccgtcgcgatctgctgcggtggccgctgccgtcgccgtccatccccaccgcctcgaccacgccaccgacgccgcctctcgctccccctcgccgcgccgcccgaacgccacgatgcgtcacctcctcctctcccgcttcctccgccgcggnggnggnagcggcatccccaacggccactaccaccacctccccctcctccgcgccatcgccntctccaactatataggctcctcgaagccatagctccaagcgacctacctctatcgcctgtgttgtctctactgtcgcgacgcctatcattgctccttcccttgcccccaccctgcgctgcacaaaagcggcgcgcaattccggtacccgtggttaacgaagtaggtgcccgccccactctctctatatctgtcatggctgacgtccacctccacttaccgactccggccgcgaatcactccccccccccctaacgggcccccttccgaccgtccaatacaagtatctcccttcttcctcgatcccgccccgacccccgactgcccctcaaacccgacccaagcacca

SEQ ID NO: 15193 - protein, 43 aa, Zea mays
  misc_feature: Ceres CLONE 1377577-F
  misc_feature (34)..(34): Xaa is any aa, unknown, or other
MRHLLLSRFLRRGGGSGIPNGHYHHLPLLRAIAXSNYIGSSKP

SEQ ID NO: 15194 - DNA, 745 bp, Zea mays
  misc_feature: Ceres CLONE 1377578-F
  misc_feature: Encodes the peptide sequence at SEQ ID NO. 15195
  misc_feature (45)..(45): n is a, c, t, g, unknown, or other
cccggctggagctcacccgcggtggcggccgctctacactagtgnatcccccgggctgcaggttattcgcacgagaccattacctagaacatcctaatcgaaaaacacattccgcgcacaccccggcagccgcaaacgccttcgccgtcgcgtcccgctcctccgcccgcccgacgcgacccctaggacctggagagagaggtcgccatggctgccgcagtggtcgacgacgctggtatggacccccccccccctcgcctcccgcccgccagacgaatgccttttggcgcccgtaccccatcacgccccctccccacccctccgtgccctaccgaccactccatgcgccccaattgacttctgattaatttttgctcccccgccgcaaccccgcggcgtccccaccccccccccacacacacgacccgaataccccccaccccacactcctcaaatatggctgacccgcggcgtctattatgggcgccttatcccccgacgctcctcccccttgccgccagaggggaggcccccccccccccccccacctgcaactcccctctttctgccgcctcctaagagagtggcaccacaacaaccccaccccctccccctctcccccccctctctctgcctctctcccgccgccccccgccctcgcggctgttgtttctattcccccccccgccccccccttcttcccgcactcactcagcccccccgctatccgtccgtcccatccccg

SEQ ID NO: 15195 - protein, 40 aa, Zea mays
  misc_feature: Ceres CLONE 1377578-F
MADPRRLLWAPYPPTLLPLAARGEAPPPPPTCNSPLSAAS

SEQ ID NO: 15196 - DNA, 696 bp, Zea mays
  misc_feature: Ceres CLONE 1377579-F
  misc_feature: Encodes the peptide sequence at SEQ ID NO. 15197
  misc_feature (32)..(32): n is a, c, t, g, unknown, or other
cccagctggagctcaccgcggtggcggccgcnctacaactagtggatcccccgggctgcaggtattcgcacgagaccattacctagaacatcctaatcgaaaaatcacccatattattgataccaactagcaacatacatagtgaagtacactagcaacatcttagcaccaatggcagccaagatttttgccatccttgccctccttgctctttcagcaagcgttgctaccgcgactattattccacaatgctcacaacaatacctctctccggctgacagccgccgagcatttccattaccccaatttatatatacccccttccagcccttccaaaagggccatcggccaaacaagcaccccctccccgcccccccgtcttctttcccccccaccctcccccccaacgtggcgctgacttcccgaaccctccccattcctcgcatcttatgctaactcccccgccctcccccccgcaccccctcgggggccccccgcccccacccccccccacgccctcccccgtgacggttcgccggcccccggaggtcggcagcgtctcgcgcccgtccacctgtctcccccccttttgttgtccccctccgccctccccccatacccctcccccgcaccccgcacagccccacgcgcctcctgtacttcccgagcctgctccctcgccctccacctcatccc

SEQ ID NO: 15197 - protein, 82 aa, Zea mays
  misc_feature: Ceres CLONE 1377579-F
MLTPPPSPPHPLGGPPPPPPPTPSPVTVRRPPEVGSVSRPSTCLPPFCCPPPPSPHTPPPHPAQPHAPPVLPEPAPSPSTSS

SEQ ID NO: 15198 - DNA, 715 bp, Zea mays
  misc_feature: Ceres CLONE 1377581-F
  misc_feature (323)..(323): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaaagtgtgtgggtgtccaagctacacacgggatgctactaactaactgcnagcaagggcgaggaatggcaagcttttcatgtgctcgggcggacggggttgtccgtttcgggggttttccccgcaaagttggtgttgggggccaattgttggtttcccaaaggggtttccattccgaaaagaaaaagggcaagggtttttctctccccccaaattccccccctttggggggggggaaggagttttcctttaaaaacccccgggggggggccacttctaatttgtgggggccccccccaaaaaccccaaaaagggggttttttttattttcccccgccccccccccccgtgggggggggggtttaaaaaaggggccccctaaaaaaccgccgcccacacccccaaatattttttgggggggggggggtggtccccccccccgc

SEQ ID NO: 15199 - DNA, 642 bp, Zea mays
  misc_feature: Ceres CLONE 1377589-F
  misc_feature: Encodes the peptide sequence at SEQ ID NO. 15200
  misc_feature (384)..(384): n is a, c, t, g, unknown, or other
  misc_feature (431)..(431): n is a, c, t, g, unknown, or other
  misc_feature (461)..(461): n is a, c, t, g, unknown, or other
  misc_feature (489)..(489): n is a, c, t, g, unknown, or other
  misc_feature (592)..(592): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaactctgttgcatttcccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggaatcgaagaagagtgataatgccttgatgtatgtcaaaattgatgatcagaaacttgccattggaaccctctctgttgacaagaacccacacatacnatttgatctgattttcgataaagagtttgagctgtcgcacacatcanaaactaccagcgttttcttcactggctacnaggttgagcagccattcgaggaagatgnaatggatcttgattctgaagatgaagacgaggagctgaatggtccagtagtcaaggaaaatgcaaagctgatgagaagaacagaaaagtcaagaaaaggcagntgctgcacctttcaaatcagtccggatccnagaagagcaagatgacgaca

SEQ ID NO: 15200 - protein, 148 aa, Zea mays
  misc_feature: Ceres CLONE 1377589-F
  misc_feature (65)..(65): Xaa is any aa, unknown, or other
  misc_feature (81)..(81): Xaa is any aa, unknown, or other
  misc_feature (91)..(91): Xaa is any aa, unknown, or other
  misc_feature (100)..(100): Xaa is any aa, unknown, or other
  misc_feature (134)..(134): Xaa is any aa, unknown, or other
MEFWGLEVKPGSTVKCEPGYGFVLHLSQAALGESKKSDNALMYVKIDDQKLAIGTLSVDKNPHIXFDLIFDKEFELSHTSXTTSVFFTGYXVEQPFEEDXMDLDSEDEDEELNGPVVKENAKLMRRTEKSRKGXCCTFQISPDPRRAR

SEQ ID NO: 15201 - DNA, 656 bp, Zea mays
  misc_feature: Ceres CLONE 1377591-F
  misc_feature: Encodes the peptide sequence at SEQ ID NO. 15202
  misc_feature (448)..(448): n is a, c, t, g, unknown, or other
  misc_feature (465)..(465): n is a, c, t, g, unknown, or other
aaagctggagctccccgcggtggcggccgctctagaactagtggatcccccgggctgcaggaattcgcacgagaccattacctagaacatcctaatcgaaaactcccaggccaggcaccgctcccaaaacctcacgagcaagcgcgcgcggccacgaacaccatacgcgctgctcgctccctgtcccggccgtcgccgcgcgaggcggagaaaagagagtgcggatcgccgatccatgaaggaggcactcgcgctcgtgggcagcgcaaggcggctgtccgcgccggaggaggatgagctgctgggcctcctcgcgggcttccccgacgaagacggcggcggcggcggcggctccgaccgcgagctctccttctccgacctcgtcgaggccggcgccaggcaggcaatcgcggacgcggacctcggcgccgccaaggcgccgtgcggngatcgcccttgggcggncgtggcgctgccgtcgtcgcatgaggccgcgggcgctgcggcatccaagcagccggcggcgaggcagagggcggcgcggcggagcggcggcagcaggggcagctgcggcggaagcggcgacggcgtgctgctcaacttctacgtgccggggcttctcaccaggagcatgaccgcgccgaagcccagccgcg

SEQ ID NO: 15202 - protein, 140 aa, Zea mays
  misc_feature: Ceres CLONE 1377591-F
  misc_feature (77)..(77): Xaa is any aa, unknown, or other
MKEALALVGSARRLSAPEEDELLGLLAGFPDEDGGGGGGSDRELSFSDLVEAGARQAIADADLGAAKAPCGDRPWAXVALPSSHEAAGAAASKQPAARQRAARRSGGSRGSCGGSGDGVLLNFYVPGLLTRSMTAPKPSR

SEQ ID NO: 15203 - DNA, 718 bp, Zea mays
  misc_feature: Ceres CLONE 1377591-R
  misc_feature (492)..(492): n is a, c, t, g, unknown, or other
cgattgggtaccgggccccccctcgaggtcgacggtatcgataagcttttttttttttttttttggacgggattcctcacgctcccaaattaaatgaattccgaacattgatttttttaaacccactggtccatacccttaatatgtttttctacctgatgacctatttgacattcctctgaattatcataatcacctggtccctatggatcatgacgaactacctgtaatctctatctagtgctaggaaggttttttttactgcctccagtgatgctatatgcacatccttactgatgggaatgtcaaaagcatggcttttcccacgtgctcgcatcagactggactagatctgaccctcacttatctacgctgcaatgactctgatgccacctggtccatgagagatgaaaatcgacaagaacttgaacgaggtccctatctcattcatggggtccaagtactgggaaaccagaaccatgcccatgacanacctttgaacaagtccccgtcacattctcagagaaagcttgaaccctgtcactgagcccctccactatagcctggcgctgtcttgcgatacccagactcgctataacttgtgattctgcatcaccttccgctctcttgatctgcagtatcttctctgcctcagctttctcgctggcagccaacctcagcctatcagctgcattgatctcattcatagctctcttcc

SEQ ID NO: 15204 - DNA, 806 bp, Zea mays
  misc_feature: Ceres CLONE 1377601-F
  misc_feature (43)..(43): n is a, c, t, g, unknown, or other
tggtgggtggccccccccccccccccccccgcccaaaaaaccncccccccccccacagctggagctccacgcggtggcggccgctttacaatagtggatcccccgggctgcaggtattcgcacgagaccattacctagaacatcctaatcgaaatcttcctcttcctcttcctcttcgtcgcaccaccaccaccaccaccctccctctcctcgcctcccaaaaaaggcgcggcaccaaaaggcgcgagagagaggcacggggaccgcccgcctcgctcgcctgcgcaccggattcgtcgctgcggcggtggttgcagcggcggcggcctggcggggagatgtcttcgcgctcggggtccacgggcggagggagcaccgggggcgccaccaccgcgggggggaggcggggcggtgccgctggccggggctgctcaggcggggagggggccacgcgagcgcaccggcgtcggagcggcccggaggtgggactgggggcctcttcagccagggccaaaaaaggggggagggattttcacctttccttaaagccccgaaatggcgaagcgcggtcccctgaacggtccccggtccttccttcctttcttccggcccttcgggccctggtttggaaggggggataaatgggggcaaacgggcggcccggaaatttttaccccccaagggaagaaattcttctgtggaacaaaacattctttggagggggcgggggccccaggcccgcaatctgggacaaggggggaaagaaccggggctctgggtgggcaacctccccaaaggaagggggg

SEQ ID NO: 15205 - DNA, 551 bp, Zea mays
  misc_feature: Ceres CLONE 1377608-F
aaagctggagctccccgcggtggcggccgctctacaactagtggatcccccgggctgcaggaattcgcacgagaccattacctagaacatcctaatcgaaaaatcgccccccttcggccttccccactgtactctccaatctcgccgccaagcctcaccgcaccatggcgaccttcaccgcggcctcctccctctccctcctcttctcccacccgcactcccactcccggcaaacatcccgccagggggcccaacggccaggtcccaccttcccctgaatccggggggcaaccgggggggtttgcctctttccaaaaaaaggccaaaaaccccccccagggggaaaatcccaaggagggggggttcaagagccgcccggtttttttggggaaaacctttccccgggccccgggggaccaaaaaggcttcccgggaagggggctcccccccccctggggggccctccccagggccaaaaaaaggggggggggcccccccccgggggcttttggggggggttttttttccccccggggggggggggggggggg

SEQ ID NO: 15206 - DNA, 728 bp, Zea mays
  misc_feature: Ceres CLONE 1377617-F
  misc_feature: Encodes the peptide sequence at SEQ ID NO. 15207
  misc_feature (11)..(11): n is a, c, t, g, unknown, or other
  misc_feature (12)..(12): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
tttgggggggnnccccnnncgggcgactcgtcagaaaaataaaaaacaaaccccaaactggagctccaccgcggtggcggccgctcttgaactagtggatcccccgggctgcaggaattcgcacgagaccattacctagaacatcctaatcgaaaaactcttcgcttcgactcccactcccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcgggttttctgacgaggcgccgacgccatcgcccggtgcagcttccgggaagggaaagaaggtagcggaagaggaggacgacaagaaggttgcagggaacgccgcagccggtcgccaaagctcaggcggtggtgatggccaccaatcccgaaggtaccgtaaagaacacggatggtctaccaccccaagctgaaggggccagcaagggagcgatgcctgaaggcccaaagccagggaaccacgggg

SEQ ID NO: 15207 - protein, 125 aa, Zea mays
  misc_feature: Ceres CLONE 1377617-F
MSPPLDLDYIGLSPAAAAAAAHDDLKGTELRLGLPGSGSPDRRVVAATATTLDLLPAKGAKRGFSDEAPTPSPGAASGKGKKVAEEEDDKKVAGNAAAGRQSSGGGDGHQSRRYRKEHGWSTTPS

SEQ ID NO: 15208 - DNA, 675 bp, Zea mays
  misc_feature: Ceres CLONE 1377618-F
  misc_feature: Translation starting site: 123
  misc_feature: SWISSPROT Homolog: EC 1.11.1.15 Peroxiredoxin
  misc_feature (364)..(364): n is a, c, t, g, unknown, or other
aaagctggagctccccgcggtggcggccgctctagaactagtggatcccccgggctgcaggaattcgcacgagaccattacctagaacatcctaatcgaaaactcatccactccgggcggccatggcctgctccttctccgccgccatcaccgtctcttccgcccctaccccggccgccagacccctcgctgctgccacgcagtccgtctgcatcgctcgctccgcggtcgccaccactgccaggccgctccgcctcgccgcctcaaggtccgcgcgggctaccagactcgttgcccgcgccagcgtagtcgatgacttgccgctggtcgggaacaaggcgcagacttcgaagccgaggctgtngtcgacccaggagtcatcaacgtgaagctctctgattacattgggaaagagtacgtcattctggtcctctaccccttggatttcaccttcgtctgcccgaccgaaaatactgcctttaagtgccggataaccaggatttggaaaagtgaacactggaggtcttggtgttcccttgaaaggggggttcccccccttgaatgggggcaaacaaaaagaaacccggggggcctccgaaattttaaaacccccttgggtcggggggggccaaaaaaatttcaaaggccttttggggttttatcccccccccaggt

SEQ ID NO: 15209 - DNA, 675 bp, Zea mays
  misc_feature: Ceres CLONE 1377620-F
  misc_feature: Translation starting site: 201
  misc_feature (311)..(311): n is a, c, t, g, unknown, or other
  misc_feature (328)..(328): n is a, c, t, g, unknown, or other
  misc_feature (369)..(369): n is a, c, t, g, unknown, or other
  misc_feature (377)..(377): n is a, c, t, g, unknown, or other
  misc_feature (415)..(415): n is a, c, t, g, unknown, or other
  misc_feature (485)..(485): n is a, c, t, g, unknown, or other
  misc_feature (486)..(486): n is a, c, t, g, unknown, or other
  misc_feature (584)..(584): n is a, c, t, g, unknown, or other
  misc_feature (617)..(617): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggncagggctccggcatggncttcagcaagctgaccggcggcggcccgacgaccccgcggnctgatcgncgcggcggtggcgcacgcgttcgcgctggtcgtggcgntgtctgtgggcgcgaacatctccggcgggcacgtgaaccctggcgtgactttcggggccttcgtgggggnnaacatcaccctggtccggggggctcctggactgggtggggcaactgctggggctccaccggggggggggtttcggtccccctttctcaaagggggggnaaaggccccggggaacccttcgggtttaaaggnnggtttccctttgtggaaaagccctttgggctcgaaaaacccggaaacccctttcggg

SEQ ID NO: 15210 - DNA, 654 bp, Zea mays
  misc_feature: Ceres CLONE 1377621-R
caattgggtaccgggccccccctcgaggtcgacggtatcgataagcttttttttttttttttttggagggggaaaaaaagacagatctccatgcacctaagaggcaaaacccgctccatgctttccctgatctctacacatactagcagtatgcatacatgccatgaggtatctaggtgcagtttctaaggctaaacaaccatccctagcatacaagctactacagatgtttaatcctacacaacgactaatacttccatattccaagagacattacacgcagaagacgatggccaaaccaccggtctcaaaaaggttgaactctccagccagccttcgaagcttcttcttatttgttgctgattgacgtctttttttgtaccggtggtcactgatcgatgggcgacgcaggtgacttcactgatcgatcagcgacgtaggtgactccactgctagctgctccgataactctgcgagagaattgaggttgcaacttgatcaccggcttccacaaagtagcatgtcccgtgctttcgtggtgccatcagggacatcgaccaacgaacgactcgattaccaaggtggccccggcctccccgtcatggcctccgggggggaaagttttgaatggataagtaattctgggaggcgggg

SEQ ID NO: 15211 - DNA, 680 bp, Zea mays
  misc_feature: Ceres CLONE 1377630-F
  misc_feature: Encodes the peptide sequence at SEQ ID NO. 15212
  misc_feature (436)..(436): n is a, c, t, g, unknown, or other
  misc_feature (440)..(440): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtaccctgagcagccgcagtgcagcccgctgggcgcggcgccctactacgccgggtgtgggcagccgagcgccatgttcccagcgctccggaaacaagtgctgccagcancaanatgaggatgatggacgtgaaatccgtcgcgcaacaattggaaaatgatgattcaacttgagagggcccctttccccccaaaaaacccttgaccaacccatttttatgcaaaaacaaaaaaaattgttggaaacccagggtcttcaacccctgggccattattaatggcgaaaaaaattgccccccatgggggggacttctacaagaaaccaagtgtcccagtttcccccccccacaccct

SEQ ID NO: 15212 - protein, 90 aa, Zea mays
  misc_feature: Ceres CLONE 1377630-F
MKMVIVLVVCLALSAASASAMQMPCPCAGLQGLYGAGAGLTTMMGAGGLYPYAEYPEQPQCSPLGAAPYYAGCGQPSAMFPALRKQVLPA

SEQ ID NO: 15213 - DNA, 665 bp, Zea mays
  misc_feature: Ceres CLONE 1377637-F
  misc_feature: Encodes the peptide sequence at SEQ ID NO. 15214
aaagctggagctccccgcggtggcggccgctctagaactagtggatcccccgggctgcaggaattcgcacgagaccattacctagaacatcctaatcgaaaaatcataaaaaaaagacaccctgcgtcatttaccgaccaccgtccatccatggatgcagccgagggccgaggggcagagtgggccgaggggcgtggcaggcggtgagcacgccggtggtcgggacggtacggatctcgtgatccatggccttcgcgggatggcgctgctccctgcttatgacacctcccgttcaccggcagcgaatcggggcttggcatttcccatcaagcattaagcagtgaagcaccccccctcgtttccaccggcagtccggcagcgagcagacagtaacagaatcaggcggtgtcttggaaataacttcagtgccatggcctggtctcatggaacatctccattatttccagtttacaagcttgagcagatcctgatgcgaggaccctccatctgtgatactctcgcacgctgctctcttcaaagaaagtgccctcgctctgatcgtatcatcagcgagcagctggttgactttgtccctgatctcctccttggtgaagacgccccgctcgttggcacggatcctcaagcccgtgccccacacgtcgcag

SEQ ID NO: 15214 - protein, 78 aa, Zea mays
  misc_feature: Ceres CLONE 1377637-F
MAWSHGTSPLFPVYKLEQILMRGPSICDTLARCSLQRKCPRSDRIISEQLVDFVPDLLLGEDAPLVGTDPQARAPHVA

SEQ ID NO: 15215 - DNA, 671 bp, Zea mays
  misc_feature: Ceres CLONE 1377640-F
  misc_feature: Encodes the peptide sequence at SEQ ID NO. 15216
  misc_feature (329)..(329): n is a, c, t, g, unknown, or other
  misc_feature (391)..(391): n is a, c, t, g, unknown, or other
  misc_feature (403)..(403): n is a, c, t, g, unknown, or other
  misc_feature (430)..(430): n is a, c, t, g, unknown, or other
  misc_feature (431)..(431): n is a, c, t, g, unknown, or other
  misc_feature (433)..(433): n is a, c, t, g, unknown, or other
  misc_feature (464)..(464): n is a, c, t, g, unknown, or other
  misc_feature (465)..(465): n is a, c, t, g, unknown, or other
  misc_feature (467)..(467): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggncgtgtcgaccgccgaggcgaggaaacatcagaccacgacgacggaaaagaaggacgacgcgntggtgcagccgnagaccttcccgcctttcgacgctcggnngnggggcgtccccggtgtcggcggcctcccggnngnagaattcctggaagcagaattcccgggttcaaatgccccggaggggaagaacccaacccgggttcactttgcccggaagggaaaattcccctttttgggggggggtcccccggtttaagggtttttggggggatggccgggggccccccccgcggtttccccccccagaaacccaaaaaagcctggggcccccaaagggggggg

SEQ ID NO: 15216 - protein, 103 aa, Zea mays
  misc_feature: Ceres CLONE 1377640-F
  misc_feature (19)..(19): Xaa is any aa, unknown, or other
  misc_feature (40)..(40): Xaa is any aa, unknown, or other
  misc_feature (44)..(44): Xaa is any aa, unknown, or other
  misc_feature (53)..(53): Xaa is any aa, unknown, or other
  misc_feature (54)..(54): Xaa is any aa, unknown, or other
  misc_feature (64)..(64): Xaa is any aa, unknown, or other
  misc_feature (65)..(65): Xaa is any aa, unknown, or other
MARSSKMMVAAALLALALXVSTAEARKHQTTTTEKKDDAXVQPXTFPPFDARXXGVPGVGGLPXXEFLEAEFPGSNAPEGKNPTRVHFARKGKFPFLGGGPPV

SEQ ID NO: 15217 - DNA, 658 bp, Zea mays
  misc_feature: Ceres CLONE 1377641-F
  misc_feature: Encodes the peptide sequence at SEQ ID NO. 15218
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattccntggtttgcatcaagatacaataatcagttctgtcagtattactgatgtatgggagcccattgaggaaggacttgtaccattgaagatgactcgtcatggttcaatgatatcgatttccttgtcccctaggagcataccaaga

SEQ ID NO: 15218 - protein, 87 aa, Zea mays
  misc_feature: Ceres CLONE 1377641-F
  misc_feature (18)..(86): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPWFASRYNNQFCQYY

SEQ ID NO: 15219 - DNA, 665 bp, Zea mays
  misc_feature: Ceres CLONE 1377644-F
  misc_feature: Encodes the peptide sequence at SEQ ID NO. 15220
  misc_feature (537)..(537): n is a, c, t, g, unknown, or other
  misc_feature (551)..(551): n is a, c, t, g, unknown, or other
  misc_feature (593)..(593): n is a, c, t, g, unknown, or other
  misc_feature (594)..(594): n is a, c, t, g, unknown, or other
tggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaaaaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctaccttcctgggtgtcccatcctggcccggcggtggtggggcgcgncgtccaagcttagncggcgtgcaccacgtgcgcgcctggcgccacgacagcctggnncaccaacgccgcgtcgtcgctcatcgcctgggccatcacggcgctcgcccttcgggctgcccctgcaggaa

SEQ ID NO: 15220 - protein, 109 aa, Zea mays
  misc_feature: Ceres CLONE 1377644-F
  misc_feature (14)..(82): Pfam Name: AWPM-19 Pfam Description: AWPM-19-like family
  misc_feature (67)..(67): Xaa is any aa, unknown, or other
  misc_feature (71)..(71): Xaa is any aa, unknown, or other
  misc_feature (86)..(86): Xaa is any aa, unknown, or other
MAGIGRNMVAPLLVLNLIMYIIVIGFASWNLNHFINGQTNYPGVAGNGATFYLPGCPILARRWWGAXSKLXRRAPRARLAPRQPGXPTPRRRSSPGPSRRSPFGLPLQE

SEQ ID NO: 15221 - DNA, 667 bp, Zea mays
  misc_feature: Ceres CLONE 1377659-F
  misc_feature: Translation starting site: 575
tggagctcaccgcggtggcggccgctctagaactagtggatcccccgggctgcaggaattcgcacgagaccattacctagaacatcctaatcgaaaaattgatctccaaataaacctcgtctcgtcttctctccgctaccaccaccactgatcgttttacagaaaccggaacgaaccaaacgcctttccgccccgggccgccgctacccaagcccagcaaccaccactcgttgtcgtcgactactacgcgctgagcaggcgtcctgtgtttttttttttggtcctcgtcgtcgtccggactccggacaggacaggacatgggcacgaagacctcggatcgcgacagaatcaggggcccgtggagccccgaggaggaccaggcgctaacagggaatggtggagcgacacgcggcacccaaatgaacgacgatagggcgcggagtcccgggacggacgggtaagacctgacgtctgccggtgcggaaacagatagtgccaagggtggagcctcccccccttcaaggggaacgaggagggagacatagtaccggaccaagcccggctcggaaaccggatgggcccccatccctgggactggttccacggtcggaccgaccaaagaccgtcaaaaaaacactggggaaatggttcccccaaagggcaaaaa

SEQ ID NO: 15222 - DNA, 622 bp, Zea mays
  misc_feature: Ceres CLONE 1377677-F
  misc_feature (346)..(346): n is a, c, t, g, unknown, or other
  misc_feature (354)..(354): n is a, c, t, g, unknown, or other
  misc_feature (359)..(359): n is a, c, t, g, unknown, or other
  misc_feature (396)..(396): n is a, c, t, g, unknown, or other
  misc_feature (455)..(455): n is a, c, t, g, unknown, or other
  misc_feature (501)..(501): n is a, c, t, g, unknown, or other
  misc_feature (504)..(504): n is a, c, t, g, unknown, or other
  misc_feature (537)..(537): n is a, c, t, g, unknown, or other
  misc_feature (540)..(540): n is a, c, t, g, unknown, or other
  misc_feature (546)..(546): n is a, c, t, g, unknown, or other
  misc_feature (551)..(551): n is a, c, t, g, unknown, or other
  misc_feature (568)..(568): n is a, c, t, g, unknown, or other
  misc_feature (596)..(596): n is a, c, t, g, unknown, or other
  misc_feature (605)..(605): n is a, c, t, g, unknown, or other
aaagtggagctccccgcggtggcggccgctctagaatagtggatcccccgggctgcaggaattcgcacgagaccattacctataacatcctaatcgaagacgaaacacccagaccagctcatcatcacattcgcatacatcttcttctagcacgcaaagatcgagctattagctagctctgccaccagagacaaggaggactaccccttcgccggccggcctaaggaggagtacgtacagaacttgggacatgggaacccgtcgtgggcgacctcatggcgaccgagctgaggcttggcctggccgggcaccgtcgacgactgcgccagccccaactggtgaaggncacgcccncctcnacgccaggggaagaggcgcgcccccgcccatgcgctngaggaagccgcggcgcagaagccagcagcgtgacgcgagacgcccccgcagcagcccgntttgtgggttggccgcccgtgagtcgtaccggagagctgcttccanagncagcagcagcaggcgcgcgccaaacagaggcgncgncggcgncgcgncgcccggtgcacggctncgtcagcagcgcacaacacagagtgcgnaggcgcccnccttgtcgtcggtccct

SEQ ID NO: 15223 - DNA, 646 bp, Zea mays
  misc_feature: Ceres CLONE 1377697-F
  misc_feature: Encodes the peptide sequence at SEQ ID NO. 15224
  misc_feature (418)..(418): n is a, c, t, g, unknown, or other
caaagctggagctccccgcggtggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagagggctcatgcccccaagcattggatgctggacaagcttggcggagcttttgctcccaagccatcttctggacctcacaagtctagggagtggcctgcactgatcctcatcatcaggaacagggctcagtatgctcttacataccgtgaggtcatttccatcctgatgcaacgccatgtactttgtgatggcanggtcaggacagacaagacctaccctgctgggttcatggatgtcatttccatccccaaggaccatgagaactacaggctgctgtacgataccaagggccgcttccgccttcacccaatcagggatgaggatgctaagttcagctttgcaaagttagggctgttcagtttgggcagaaggcatcccttactgaacacggatgacgggcgcacaatccgttaccttgaacc

SEQ ID NO: 15224 - protein, 150 aa, Zea mays
  misc_feature: Ceres CLONE 1377697-F
  misc_feature (3)..(40): Pfam Name: RS4NT Pfam Description: RS4NT (NUC023) domain
  misc_feature (94)..(150): Pfam Name: Ribosomal_S4e Pfam Description: Ribosomal family S4e
  misc_feature (75)..(75): Xaa is any aa, unknown, or other
MARGLKKHLKRAHAPKHWMLDKLGGAFAPKPSSGPHKSREWPALILIIRNRAQYALTYREVISILMQRHVLCDGXVRTDKTYPAGFMDVISIPKDHENYRLLYDTKGRFRLHPIRDEDAKFSFAKLGLFSLGRRHPLLNTDDGRTIRYLE

SEQ ID NO: 15225 - DNA, 660 bp, Zea mays
  misc_feature: Ceres CLONE 1377706-F
  misc_feature: Encodes the peptide sequence at SEQ ID NO. 15226
  misc_feature (388)..(388): n is a, c, t, g, unknown, or other
  misc_feature (488)..(488): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaaaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcggnggcggacctcaagtgcctgtgcggctacaagaactcgccgtggatgggcgtctacaacatcgaccccaagcgcgccatggagcttccggccaagtgcggnctcgccacgccgcccaactgctagcagtgtgctagccaagccaagccaagcaggaaggcccccggcattgctagctgtacgtgtctgtgtgtgcatctgcagcagggtgcaggcaggggcccgtacgtacgngtctctttctctctctcatcttgtcaccgtacctatctag

SEQ ID NO: 15226 - protein, 115 aa, Zea mays
  misc_feature: Ceres CLONE 1377706-F
  misc_feature (41)..(115): Pfam Name: Tryp_alpha_amyl Pfam Description: Protease inhibitor/seed storage/LTP family
  misc_feature (75)..(75): Xaa is any aa, unknown, or other
MAATSSKSSSSSSSAQRAAAALLVAAAVAVSVLVVGAAAVCDMSNEQFMSCQPAAAKTTDPPAAPSQACCDALAXADLKCLCGYKNSPWMGVYNIDPKRAMELPAKCGLATPPNC

SEQ ID NO: 15227 - DNA, 660 bp, Zea mays
  misc_feature: Ceres CLONE 1377708-F
  misc_feature: Encodes the peptide sequence at SEQ ID NO. 15228
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaaccattcccttcgtgcttgtttgctctagggtttttgccacgccgccgccgctctgccccttccaccccaccgatataccaagatgacggcgcaggctgcggaggagctcgccgcccagatcgagcagcagaagctcgaggagcagaagaccgaggcagaagaggttgtggtggaggaggatgacgaggatgatgaggatgacgatgatgatgacaaggatgatgatgaactggatggacaagaaggggatgggagtggcaagtcgaagcaaagcaggagtgagaagaagagccgcaaggccatgctgaagcttggcatgaagcccatcactggtgtcagccgggtcactgtgaagaaaagcaagaatatgctttttgtcatctcgaagccagatgtgttcaagagcccaaactcggacacctatgtcatattcggcgaggcgaagatcgaggacctcagctcccagctgcagacccaagctgcagagcagttcaaggctcctgacctgagccaaatgatcccgaagcctgagacatctggnctgggcctggagggacaacgag

SEQ ID NO: 15228 - protein, 160 aa, Zea mays
  misc_feature: Ceres CLONE 1377708-F
  misc_feature (65)..(124): Pfam Name: NAC Pfam Description: NAC domain
MTAQAAEELAAQIEQQKLEEQKTEAEEVVVEEDDEDDEDDDDDDKDDDELDGQEGDGSGKSKQSRSEKKSRKAMLKLGMKPITGVSRVTVKKSKNMLFVISKPDVFKSPNSDTYVIFGEAKIEDLSSQLQTQAAEQFKAPDLSQMIPKPETSGLGLEGQR

SEQ ID NO: 15229 - DNA, 855 bp, Zea mays
  misc_feature: Ceres CLONE 1377710-F
  misc_feature: Encodes the peptide sequence at SEQ ID NO. 15230
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (26)..(26): n is a, c, t, g, unknown, or other
  misc_feature (44)..(44): n is a, c, t, g, unknown, or other
  misc_feature (45)..(45): n is a, c, t, g, unknown, or other
  misc_feature (54)..(54): n is a, c, t, g, unknown, or other
  misc_feature (432)..(432): n is a, c, t, g, unknown, or other
  misc_feature (648)..(648): n is a, c, t, g, unknown, or other
gattaaagggggnnnnnnnnnttannctcccaccccacacaacnngggtggcgntcaaactgggactcaccgcggtggcggccgctctattaactagtggatcccccgggctgcaggatattcgcacgagaccattacctagaacatcctaatcgaaaaacatcgacccagccatctcctcaccctcgttcaccacacagtccgccactcctttagtagcttgtgatttgtacgtccacgagatcactggtcgggtggcggacgacgacacatggggaagggtagtgtgggtgcatcatggtggggcgttcctcctgctcgacggcgtgctgctggtcgtagcagacacggccggggcggaggacggagtggtcgaacgggaaccgcaagggaagacctgcggtggtgccaaggagggggtggtgagtgganaatacggaaaagggacccccccgcgggaaaaagggaaatgccgaaaagcgaagtcgccggcgaaggggggcaccagccaaagctgaaccccgggggggaaggaacgggtggaaacgggcgggcggtgggaaacggcctaaccgttcctccacccctctccccgggcaaggggggccaaagtgggccgggcggcccaaaggtgccctgggggacccncccacacgaacgggcccaggcccggtggggggaatacccccaaaaaaaccggcattggaaggggcggggggccacccccggccggggagaaagtgggggccggtccgaaccctgggaaaccaaagagagcaacgggccgcgggggcaaccacataatggcgcccgccccccaagtggcggggggaaaaaggcggccgcagccggccc

SEQ ID NO: 15230 - protein, 194 aa, Zea mays
  misc_feature: Ceres CLONE 1377710-F
  misc_feature (54)..(54): Xaa is any aa, unknown, or other
  misc_feature (126)..(126): Xaa is any aa, unknown, or other
MGKGSVGASWWGVPPARRRAAGRSRHGRGGGRSGRTGTAREDLRWCQGGGGEWXIRKRDPPAGKREMPKSEVAGEGGHQPKLNPGGEGTGGNGRAVGNGLTVPPPLSPGKGGQSGPGGPKVPWGTXPHERAQARWGEYPQKNRHWKGRGATPGRGESGGRSEPWETKESNGPRGQPHNGARPPSGGGKKAAAAG

SEQ ID NO: 15231 - DNA, 663 bp, Zea mays
  misc_feature: Ceres CLONE 1377711-F
  misc_feature: Encodes the peptide sequence at SEQ ID NO. 15232
  misc_feature (428)..(428): n is a, c, t, g, unknown, or other
  misc_feature (429)..(429): n is a, c, t, g, unknown, or other
  misc_feature (553)..(553): n is a, c, t, g, unknown, or other
  misc_feature (554)..(554): n is a, c, t, g, unknown, or other
  misc_feature (565)..(565): n is a, c, t, g, unknown, or other
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaaacacatccatcctcgctagctcgctcgctctccttgcaactccagtgctgctcactgccactgccagcagatcgagctgctccgtctcacaaaccctcttgctttgctgctgcacctgcaagtctgcaaccgcgcacacagagatgtcgacgacggtgagccgtgcgtccctcgaccagaagctcgccctcgccaagcgttgctcccgagaggcgaccctcgccggagccaaggcggcagcggtggcgactatcgcctccgcgatccccaccctggccagcgtgcggatgctgccatgggccaaggccaacatcaaccccaccggnncagcgctcatcgtctccacggtggctgggatggcctacttcatcgccgccgacaagaagatcctgtcgctggcaaggcgcactcgttcgagcaagcccctgagcacctcaagaacacctccttnncaggcaccggncgtccccacccgggcttcttcaggncgtgagaccagacctcccgtcagagctagctacctacctcttttttcagtttgccaatgcaagcacccaatgc

SEQ ID NO: 15232 - protein, 139 aa, Zea mays
  misc_feature: Ceres CLONE 1377711-F
  misc_feature (12)..(90): Pfam Name: ENOD93 Pfam Description: Early nodulin 93 ENOD93 protein
  misc_feature (62)..(62): Xaa is any aa, unknown, or other
  misc_feature (103)..(103): Xaa is any aa, unknown, or other
  misc_feature (107)..(107): Xaa is any aa, unknown, or other
MSTTVSRASLDQKLALAKRCSREATLAGAKAAAVATIASAIPTLASVRMLPWAKANINPTGXALIVSTVAGMAYFIAADKKILSLARRTRSSKPLSTSRTPPXQAPXVPTRASSGRETRPPVRASYLPLFSVCQCKHPM

SEQ ID NO: 15233 - DNA, 654 bp, Zea mays
  misc_feature: Ceres CLONE 1377717-F
  misc_feature: Encodes the peptide sequence at SEQ ID NO. 15234
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaactctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaacagcactggggataaactttgcccgtgatggaatggtcgaaaaagactggttgtctctagttgcagttcatagtgatgcatggctcctgtctgttgcattctactttggagctcgttttggatttgacaagatgcccagagaaggctcttttcacatgataacaacctgcccactgtttatgaangtgtgacgggggttgctaagaaaca

SEQ ID NO: 15234 - protein, 142 aa, Zea mays
  misc_feature: Ceres CLONE 1377717-F
  misc_feature (141)..(141): Xaa is any aa, unknown, or other
MDGDGGGAGALHHHTRSPEDVFRDFRARRAGIVKALTTDVEKFYQQCDPEKENLCLYGLPNETWEVTLPAEEVPPELPETALGINFARDGMVEKDWLSLVAVHSDAWLLSVAFYFGARFGFDKMPREGSFHMITTCPLFMXV

SEQ ID NO: 15235 - DNA, 700 bp, Zea mays
  misc_feature: Ceres CLONE 1377720-F
  misc_feature (323)..(323): n is a, c, t, g, unknown, or other
  misc_feature (324)..(324): n is a, c, t, g, unknown, or other
  misc_feature (337)..(337): n is a, c, t, g, unknown, or other
  misc_feature (492)..(492): n is a, c, t, g, unknown, or other
tggagctccccgcggtggcggccgctctagaatagtggatcccccgggctgcaggaattcgcacgagaccattacctagaacatcctaatcgaaaaattttttcgtctattgcctgttcatcccgcccatgcctcctcgttcttcctctccaccgccgctcgcacggatccctctcctcgctgtgggtcgcaagtaggtgccgtctctgggtgcgcatggctcggatagagtccactagcgccaccatcggcttccatgcgagcaaacctccctcctcttttagtcccccgcctggtcagcacgtccgtgcctcctcgtgttnnctctccaacgcgntcacactgatccctcttcctgctgcccgtccgcggaaggcgatggctctgggtgggcatgcctccgaagaaatccaccaaggttgccatcgggtaaagggccccaaaattcaagggctggggggccttttgggacaaaccctttcccccttttgnaaaaaaagggcctgggaaaaaaaatttccccggaacccttgtggccggggtattagggtttgttccccccccgcggggggaaaaacaaaaaaaaaaccccccccggtgttggaaagcgcttttaacacaaaaaaaaaaagtggtggggggccacccgcgggggggggggggggaaaaaaaacaaaaaaaaaaggtgggggccctcctt

SEQ ID NO: 15236 - DNA, 662 bp, Zea mays
  misc_feature: Ceres CLONE 1377726-F
  misc_feature: Encodes the peptide sequence at SEQ ID NO. 15237
  misc_feature (524)..(524): n is a, c, t, g, unknown, or other
  misc_feature (580)..(580): n is a, c, t, g, unknown, or other
  misc_feature (592)..(592): n is a, c, t, g, unknown, or other
  misc_feature (593)..(593): n is a, c, t, g, unknown, or other
  misc_feature (633)..(633): n is a, c, t, g, unknown, or other
aaagctggagctccccgcggtggcggccgctctagaactagtggatcccccgggctgcaggaattcgcacgagaccattacctagaacatcctaatcgaaaaatcaaatcgccaccgaaaattccccccaaaaaacaataagcaattgttcatcatcgtcagagtaaacacagcagaaccctagcgcgccgttcctccgacgactcacatcccacccactcacccaccccatggcggccaagctctccaccagcgccgacgtcccggcctcggtgcggctctccgcagcagcgcaggcggctgcgatccagccctcctccccgcgcttcttcttctcctcgctggccgggaccaacccggcctccccgcatcgccgcatcgccattgccgtcgatctctccgacgagtccgccttcgccgtcaagtgggccgtgcagaactacctccgccccggggacgccgtcgtgctgctccacgtgcgccccacctccgttctctacggcgccgactgggggtccatcccngtctccgtcgctgacgaggccgacgctgccgaggacgcccgccgcgcccgcgaggncggcccctccgnnagagagctgcaaaagaaagcggaggaggatacgacgcttncacctctaccaggggcaggacctcgcgcg

SEQ ID NO: 15237 - protein, 144 aa, Zea mays
  misc_feature: Ceres CLONE 1377726-F
  misc_feature (117)..(117): Xaa is any aa, unknown, or other
  misc_feature (121)..(121): Xaa is any aa, unknown, or other
  misc_feature (135)..(135): Xaa is any aa, unknown, or other
MAAKLSTSADVPASVRLSAAAQAAAIQPSSPRFFFSSLAGTNPASPHRRIAIAVDLSDESAFAVKWAVQNYLRPGDAVVLLHVRPTSVLYGADWGSIPVSVADEADAAEDARRAREXGPSXRELQKKAEEDTTLXPLPGAGPRA

SEQ ID NO: 15238 - DNA, 662 bp, Zea mays
  misc_feature: Ceres CLONE 1377727-F
  misc_feature: Encodes the peptide sequence at SEQ ID NO. 15239
  misc_feature (347)..(347): n is a, c, t, g, unknown, or other
  misc_feature (445)..(445): n is a, c, t, g, unknown, or other
  misc_feature (452)..(452): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcgaaaactttccctttctggccgcattccctcgtcctccggcagccgtcgccagcttccgatggtccggaaggagacggccatgaggctgcccccgcagcaccagggcctggaggtcaagatccccagcttcttccgctgccccatctcgctggacgtcatgcgctcgcccgttagcctctgcaccggcgtcacctacgaccgcgcctccatccagcagtggctcgactccggcaacaccacgtggccggncaccatcctcccgctcccctccacccgactcgtccccaacctcactctccgcagcctcatcgcccactggggcgcctccgccccgctctggtcccccnacgccgncggcggcgccggagtcgccgactcctcttcggcacgtacttcttctcccgcgagcctcgtcccgcaggtggcttcgtccgggcgtggacccctcgccggccctccgcgagctgggagcctatctctccgacgacgacgtcgacgacttcaaaaagaacgcgcttgtgggcgccgnccgcgccgccgagaacgtcgcgtcagttcctcgga

SEQ ID NO: 15239 - protein, 168 aa, Zea mays
  misc_feature: Ceres CLONE 1377727-F
  misc_feature (20)..(94): Pfam Name: U-box Pfam Description: U-box domain
  misc_feature (64)..(64): Xaa is any aa, unknown, or other
  misc_feature (97)..(97): Xaa is any aa, unknown, or other
  misc_feature (99)..(99): Xaa is any aa, unknown, or other
MVRKETAMRLPPQHQGLEVKIPSFFRCPISLDVMRSPVSLCTGVTYDRASIQQWLDSGNTTWPXTILPLPSTRLVPNLTLRSLIAHWGASAPLWSPXAXGGAGVADSSSARTSSPASLVPQVASSGRGPLAGPPRAGSLSLRRRRRRLQKERACGRRPRRRERRVSSS

SEQ ID NO: 15240 - DNA, 711 bp, Zea mays
  misc_feature: Ceres CLONE 1377730-F
  misc_feature: Encodes the peptide sequence at SEQ ID NO. 15241
  misc_feature (171)..(171): n is a, c, t, g, unknown, or other
  misc_feature (312)..(312): n is a, c, t, g, unknown, or other
  misc_feature (313)..(313): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (403)..(403): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (481)..(481): n is a, c, t, g, unknown, or other
ggccgctctaaaactagtggatcccccgggctgcaggaattcgcacgagaccattacctagaacatcctaatcgaaaaaaacaactagaaattccccagcccggttccttttcgtgcggtttgatctcgtcggaggcccggccgcaggggcgccatcagccatcgaattcnatggcggccaacttcgggaacaagatccgcaacgccaagctggttcttcttggagatgtaggcgctggcaaatctagcttggttcttcgttttgccaagggacagggggggtgaattccaggaatcattcttttttagcannctttcttttcccagaccctacccttttttttctcccctcccccggggaaaagaaaagggggaaannntnnnnnnnnnnnnnnttccttanctttcaacaaaaaaaaaaaaaaaaannntccccccccccggccctttggtgggtcaattacatccacaaaatcccggnactcccttccaccccctgggacaaacacacccgcgtcaaagaacattaccacccccccccggaaatcgcacaataactacactaggcccccttcgtacgccaaccaccgccgcatttcgccgcacggccccgccacccggataccccccacctcaaacaacgaccccatacacccgcacccaccacctctctcctcttcgcccggacccactcccacccgccctcgcacg

SEQ ID NO: 15241 - protein, 37 aa, Zea mays
  misc_feature: Ceres CLONE 1377730-F
MAANFGNKIRNAKLVLLGDVGAGKSSLVLRFAKGQGG

SEQ ID NO: 15242 - DNA, 664 bp, Zea mays
  misc_feature: Ceres CLONE 1377733-F
  misc_feature: Encodes the peptide sequence at SEQ ID NO. 15243
  misc_feature (436)..(436): n is a, c, t, g, unknown, or other
  misc_feature (468)..(468): n is a, c, t, g, unknown, or other
  misc_feature (526)..(526): n is a, c, t, g, unknown, or other
aagctggagctccccgcggtggcggccgctctagaactagtggatcccccgggctgcaggaattcgcacgagaccattacctagaacatcctaatcgaaaaggttctccatccggtcagaccaatcaacaaagtgacgcgagcacgagcatccatcgtttccccttcttccccatcgcgtgccctcgccgcagccatcttccatggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcagggaagatgaangaccccgacctccgaggaggactaagggaggnctttcgcgtcttcaaaaagaacagaatggtttcatctcggctgctgacctccgcatgnaatgaacaaccccggaaaaaactgactgaccaagagcccaaaaaatgatcccggaagcccatttgtaacggaaaggccaaaaaaataaaaaggaatccccaagggcattagtgccaaagggggaacccgcccccgata

SEQ ID NO: 15243 - protein, 123 aa, Zea mays
  misc_feature: Ceres CLONE 1377733-F
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
  misc_feature (78)..(78): Xaa is any aa, unknown, or other
  misc_feature (89)..(89): Xaa is any aa, unknown, or other
  misc_feature (108)..(108): Xaa is any aa, unknown, or other
MADQLTDEQIAEFKEAFSLFDKDGDGCITTKELGTVMRSLGQNPTEAELQDMINEVDADGNGTIDFPEFLNLMAGKMXDPDLRGGLREXFRVFKKNRMVSSRLLTSAXNEQPRKKLTDQEPKK

SEQ ID NO: 15244 - DNA, 653 bp, Zea mays
  misc_feature: Ceres CLONE 1377734-F
  misc_feature: Encodes the peptide sequence at SEQ ID NO. 15245
aagctggagctccccgcggtggcggccgctctagaactagtggatcccccgggctgcaggaattcgcacgagaccattacctagaacatcctaatcggaaaatcaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctcagcaacaacaatttcttccattcaaccaactgtctacactgaaccctgctgcttatttgcagcaacaactattacccatttagcagctagctactgcctactctcaacaacaacacttcttccatttaaccagttgct

SEQ ID NO: 15245 - protein, 142 aa, Zea mays
  misc_feature: Ceres CLONE 1377734-F
METKIFSLLMLLALSTCVANATIFPQCSQAPIASLFPPYLPSIIASVCENPALQPYRLQQAIAASNIPLSPLLCQQSPALSLVQSLVQTIRAQQLQQLVLPVINQVALANLSPYSQQQQFLPFNQLSTLNPAAYLQQQLLPI

SEQ ID NO: 15246 - DNA, 659 bp, Zea mays
  misc_feature: Ceres CLONE 1377735-F
  misc_feature: Encodes the peptide sequence at SEQ ID NO. 15247
  misc_feature (352)..(352): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (360)..(360): n is a, c, t, g, unknown, or other
  misc_feature (368)..(368): n is a, c, t, g, unknown, or other
  misc_feature (371)..(371): n is a, c, t, g, unknown, or other
  misc_feature (391)..(391): n is a, c, t, g, unknown, or other
  misc_feature (395)..(395): n is a, c, t, g, unknown, or other
aaagctggagctccccgcggtggcggccgctctataactagtggatcccccgggctgcaggaattcgcacgagaccattacctagaacatcctaatcgaaaactcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccgggcggncgnnnacnagctctcnggnggaggagcgcaacctgctgnccgncccctacaagaacgtcatcggcgcccgcagggcctcggggcggatcatctcctccatcgagcagaaggaggaaggccgcggggaacgaggcgcacgccgcatccatccgcgcctaccgctccaatatcgaggccgagcttgcccggatctgggaaggaatccttcggctcctcaactcccacctcgtcccatccgccggcggggcccaatcccagggtcttctaactaaggatgagggggggccaccccctggcaccttgctgg

SEQ ID NO: 15247 - protein, 133 aa, Zea mays
  misc_feature: Ceres CLONE 1377735-F
  misc_feature (44)..(44): Xaa is any aa, unknown, or other
  misc_feature (45)..(45): Xaa is any aa, unknown, or other
  misc_feature (49)..(49): Xaa is any aa, unknown, or other
  misc_feature (50)..(50): Xaa is any aa, unknown, or other
  misc_feature (57)..(57): Xaa is any aa, unknown, or other
  misc_feature (58)..(58): Xaa is any aa, unknown, or other
MSPSEPTREESVYMAKLAEQAERYEEMVEFMERVARYAGGAGRXXTSSXXEERNLLXXPYKNVIGARRASGRIISSIEQKEEGRGERGARRIHPRLPLQYRGRACPDLGRNPSAPQLPPRPIRRRGPIPGSSN

SEQ ID NO: 15248 - DNA, 688 bp, Zea mays
  misc_feature: Ceres CLONE 1377736-F
  misc_feature: Encodes the peptide sequence at SEQ ID NO. 15249
  misc_feature (292)..(292): n is a, c, t, g, unknown, or other
  misc_feature (301)..(301): n is a, c, t, g, unknown, or other
  misc_feature (324)..(324): n is a, c, t, g, unknown, or other
  misc_feature (353)..(353): n is a, c, t, g, unknown, or other
  misc_feature (363)..(363): n is a, c, t, g, unknown, or other
  misc_feature (365)..(365): n is a, c, t, g, unknown, or other
  misc_feature (380)..(380): n is a, c, t, g, unknown, or other
aaagctggagctccccgcggtggcggccgctctagaactagtggatcccccgggctgcaggaattcgcacgagacctttacctagaacatcctaatcgaaaaatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaagtctggtggactccggcgtcaagtccatccccgtcatcttcccacacccgncggaagccntgagcgacataatttctccggcngcctctgcgtcgtcgccacccctccggcngcgcatcccngntggtggacctctcgntgacgcggcgcgaagacctaatcaagccagtgaagcaccgcggccggaacgggggccttctttgggtgggggcccccggcgtggcaaaggaattgaaggggcgaattgctcccgggggggggcccattaaaagaagcccccgggggagggaaaaaaaggggtttttatcccgggaactggggtcgaaaacgggggttttccccccaaattttcaacttttaaaagcgcgtgggaaaaaatgggaaaacttttttttgggggaggggcccccccacccccccccccgggaggagattctcggaccacaa

SEQ ID NO: 15249 - protein, 52 aa, Zea mays
  misc_feature: Ceres CLONE 1377736-F
MAPTTATKDDSGYGDERRRELQAFDDTKLGVKVWWTPASSPSPSSSHTRRKP

SEQ ID NO: 15250 - DNA, 661 bp, Zea mays
  misc_feature: Ceres CLONE 1377737-F
  misc_feature (258)..(258): n is a, c, t, g, unknown, or other
aaagctggagctccaccgcggtggcggccgctctataactagtggatcccccgggctgcaggaattcgcacgagaccattacctagaacatcctaatcgaaaaatacctcctcaaggcacgttcaccacagtcctctctttccccggcaccaccaccaccacccaagctaacaggactggaccgagtgttgaacaacactgcagtgagcgacggcaggcatggtgagccgtgaaaatttgcacctggtgctggacccngcgtctctgggcgcgccttgggccgacccgccggcgcagaaaatcccgcgcagctcctccgcgcgttggaagagtacctctcctccgccccgggaacttcaaaacgaaggcgacaacaatttctgatgcacaattcaaggtgcggcggggcccccccccccaaacccaaaagggaagggggcccctaacccccccccggagaaaccccccggccggaaaccccccccccgggccaaccgggggaaactggccgaatttttgggcccccccgcacccgggccccggggccccggggggcccccccccccccctccaaagacttttagagggggtgtccccccccctcaaaaaaaaaaccccccggggggggggggtcctcccccccccccctttttttttttcc

SEQ ID NO: 15251 - DNA, 693 bp, Zea mays
  misc_feature: Ceres CLONE 1377745-F
  misc_feature: Encodes the peptide sequence at SEQ ID NO. 15252
tcagaactagtggatcccccgggctgcaggaattcgcacgagaccattacctagaacatcctaatcgaaaaagagacatatctagtaatccgatcgtcgtagcaagcaagaaagaccttttttttatttccccttggtcaggagcgactgaagagtgttgttgtcgtcgccgtcgcagggcccggatgctcatcgattgggtacggggaagcggaggagctggggcccttcctggtgcagaagggcaagccggagctcagatggaacaactactcctggaacacagaggccaaccttatgttcctggagtccccggtgggcgtcgggttctcctacacaaacacgagctccgacctgctgcagctcggtgacaagatcaccgctgacgacgcttacaaattcctgctcaactggttcaagaggttcccgcagtacaagtcacacgatttctacatcgccggcgagagctacgccgggcactacgtcccgcagctgtcggagaagatcttcgacggcaacagggcgggggccaaggagagccacgtcaacttgaggggcctgatggtcgggaacgcgctcatggacgacgagacggaccagacgggcatgatcgactacgcctggggacacgccgtcatctccgaccgggtgtacggcgacgtcaaggccaggtgcgacttcggcatggcgaac

SEQ ID NO: 15252 - protein, 132 aa, Zea mays
  misc_feature: Ceres CLONE 1377745-F
  misc_feature (1)..(132): Pfam Name: Peptidase_S10 Pfam Description: Serine carboxypeptidase
  misc_feature: SWISSPROT Homolog: EC 3.4.16.6 Carboxypeptidase D
MFLESPVGVGFSYTNTSSDLLQLGDKITADDAYKFLLNWFKRFPQYKSHDFYIAGESYAGHYVPQLSEKIFDGNRAGAKESHVNLRGLMVGNALMDDETDQTGMIDYAWGHAVISDRVYGDVKARCDFGMAN

SEQ ID NO: 15253 - DNA, 731 bp, Zea mays
  misc_feature: Ceres CLONE 1377749-F
caagctggagctccccgcggtggcggccgctctataactagtggatcccccgggctgcaggaattcgcacgagaccattacctagaacatcctaatcgaaaaatcacacatattattgtgagcaactagcaacatataaagcacaatagtgtaccatcaatgtcagccatgaatattttgcctccttatgctccttgggctttctgcaagtgctgctaactctaccattttcccacaatgctcaccagatcctataacttcccttcttccctcgtacctctcatgagcggtgtcttcgatatgtgaaaacccaattcttcatgcctacaggatccaacagacaattgcagctggcatcttacctttatcacccttgttcctccaacaatcatcagccctattacagtcgttaccctttggtgcatttattgacacaaaacgtcatggtacaacaactagcacaacttgtgctagcaaaacttgctgactactctcagcaacatcagcttcttccattcaaccaagtacgctgctttgaactttgcttcttattatcaaaacaagtgactaccttctccccagctatctgcctgctaaacccagaaatttcttccattcaacccaattgaccgaattgaaatcctacctgcttatttacaagaagaaacctcctactactcctttaacccaccttagttgggggggggtgcccgtccctacccttcattgac

SEQ ID NO: 15254 - DNA, 775 bp, Zea mays
  misc_feature: Ceres CLONE 1377751-F
  misc_feature: Pfam Name: Seryl_tRNA_N Pfam Description: Seryl-tRNA synthetase N-terminal domain
  misc_feature: SWISSPROT Homolog: EC 6.1.1.11 Serine--tRNA ligase
  misc_feature (228)..(228): n is a, c, t, g, unknown, or other
  misc_feature (238)..(238): n is a, c, t, g, unknown, or other
  misc_feature (265)..(265): n is a, c, t, g, unknown, or other
  misc_feature (269)..(269): n is a, c, t, g, unknown, or other
  misc_feature (303)..(303): n is a, c, t, g, unknown, or other
  misc_feature (305)..(305): n is a, c, t, g, unknown, or other
  misc_feature (398)..(398): n is a, c, t, g, unknown, or other
  misc_feature (671)..(671): n is a, c, t, g, unknown, or other
tcaccgcggtggcggccgctctagaactagtggatcccccgggctgcaggaattcgcacgagaccattacctagaacatcctaatcgaaaaaaacgaaaggactgccctaacctcgtgcagtcgtgcccgcttgtttcccttgctcgccttcacccctcgccgccgccgccgccgtcgccgtcgcaagcgacgatgctcgacatcaacttgtcccgcaccgacaaggncggcaacccnagaccttattcgcgagtcccagcgcancggntccgctccgtcgagctcgtcgacgaggtcatcgncntccaacaaggatggcgcgaaaggaaattcaagttgaaaaaaaccggcaggagtccacccttcccacaaaaaaatggggaattctaagccccgnggaaaaaaagaaagggaaaaccttcggggaaaacaaaaaaaaaataaaaaaaggggggccccaaaaaaatgggggggggggaggagaaaaacccccctcccccggggggcaaaaagggggaaccccggggggggagccccgcccccccccccccccgaaaaaaaaaaaaaaaatccccctcttgtggaaaaaaaagaagggattttttttacaccccccccccccccggcgggggttatttttcccacaaaaaaagggggggggggggggggnggggtttttaataaaaaaaagggcgccccccccccccaaaaaaaaaatttttttttttttaaaaaaaaaaaaaaaaaaacacccccttttcttttttaaaaaaa

SEQ ID NO: 15255 - DNA, 752 bp, Zea mays
  misc_feature: Ceres CLONE 1377752-F
  misc_feature: Encodes the peptide sequence at SEQ ID NO. 15256
  misc_feature (752)..(752): n is a, c, t, g, unknown, or other
ggagctcaccgcggtggcggccgctctagaactagtggatcccccgggctgcaggaattcgcacgagaccattacctagaacatcctaatcgaaaaaattgaaaacagggccttggtcgagttaaaaaaaacgcgagtgaaacacactgacaccgcaaacacgccaaccggcctaccgacttcttctcttgtctcgtcctcctcccgactatggtcgccgtcggcgaggtagaccccagccccaacccgccgccaactacagcctccggcctctccaagaccaagacgcgggaggccgaccgccgccgacgccgccgcatgaaggccaagaagaacaagtccgtcactgaggctgatgcccaggacgctgacgggggagcttccagctccgacgccaaggagaacgccgatcccaaccccgagccacaggttgaggtggagatagagtacgtgccggagaaggccgagcttgacgaccctctcctggatgatttcaaggccatcttcgagaagttcaccttcaaggacgctgctgcagcggcgcccgagaatgataataaagacgagggtgccgctgatggcacaaaaaaaggggcactggatgatgaagaccaacaccaaaatgatgagcaggatggtaaaacagaaaaagggacggaggccctattccaataagaaaaaaaaaacttgggaaccccaggaagaaaaattgcataacctcaaacagaaaatggcaaacagaacctggacgn

SEQ ID NO: 15256 - protein, 154 aa, Zea mays
  misc_feature: Ceres CLONE 1377752-F
MVAVGEVDPSPNPPPTTASGLSKTKTREADRRRRRRMKAKKNKSVTEADAQDADGGASSSDAKENADPNPEPQVEVEIEYVPEKAELDDPLLDDFKAIFEKFTFKDAAAAAPENDNKDEGAADGTKKGALDDEDQHQNDEQDGKTEKGTEALFQ

SEQ ID NO: 15257 - DNA, 722 bp, Zea mays
  misc_feature: Ceres CLONE 1377758-F
  misc_feature: Translation starting site: 226
  misc_feature (659)..(659): n is a, c, t, g, unknown, or other
cgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatggttttgagaagccctctgcaattcagcagagaggaattgttcccttctgcaagggtcttgatgtcattcagcaagcacaatctggtacaggaaagacaggcaaccttctggttctgggatcttgcagcagctggactatggcctggttgaatgccaggccctggtccttgctcccacccgtgagcttgcacagcaaattgagaaagcatgcgagcgcttgggattacctttggtgttaagtccatgcatgtgtggnaagaaacacccgtccgtgaggaccaaagaatctttggaggggtgtggcattgttgttgttgaa

SEQ ID NO: 15258 - DNA, 726 bp, Zea mays
  misc_feature: Ceres CLONE 1377763-F
  misc_feature (222)..(222): n is a, c, t, g, unknown, or other
ctggagctcaccgcggtggcggccgctctagaactagtggatcccccgggctgcaggaattcgcacgagaccattacctagaacatcctaatcgaaaaatctcatgtattattgctaccaactaggaaaatattaggcacgatagtgtaccaccgatggcagccaaaatatattgcttcctaatgctctgtggcgatctcgtctgtgccagtgacggggcanattttagcacaatgctccccacgtcatataattgcccctgttcctccacatctatagatacatgggacccacagaacatgaaagcccctgcggttgctcctacagcgtcatctcctcctccactagaggcatattattagttataacgcgtgtgcccctccaacatctcctccctattaaccaagttacccttattgcatgtgcggcgccgaaacatacatctccctgaagtacgaccatcttgcgctgacccaaccatggtgcacactcccggcctgatggtgttagtcctttcactctcctgatgtgatatgaaatctgttgcttactctgtatatgaggtactgaccatcctcttaggtgctgccagacccgcaccattttcattctttcgaccagctaagcaccttctactctgctgcttaccccggacaacaccacttaccacctttcagccagctaactgaggcgagactctgctagcatctatgggcaagtaatagt

SEQ ID NO: 15259 - DNA, 789 bp, Zea mays
  misc_feature: Ceres CLONE 1377765-F
  misc_feature: Encodes the peptide sequence at SEQ ID NO. 15260
  misc_feature (21)..(21): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (789)..(789): n is a, c, t, g, unknown, or other
ccacgccccccccctcctccnaatcccnccccccnnnnnnnaaaactgggactccccgcggtggcggccgctctagaactagtggatcccccgggctgcaggaattcgcacgagaccattacctagaacatcctaatcgaaaaccatttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaaggctgatggcaccagtcagattgctgctggggctaccacccaaaccaataactaccacagggccgacggtcagaacaccgggaaacttccttacggaccggccttcgaccaaggcccacggctgctcctggagggggctcttccctgggaaacccggttggcggcaactgatggcgctcaccaagctatcccccccccctggcgccgaatgctctttccgcaacggggacaggcggtggcattttcctgtggaccccaaccctccccggcccgggggggcccgaaagacgcgccttagactccggggccaaaccggggggccggaacccccacacaaaggcggccccgggaccccagcctcccggttccggtn

SEQ ID NO: 15260 - protein, 149 aa, Zea mays
  misc_feature: Ceres CLONE 1377765-F
MSRGGSAGGGQSSLGYLFGSGEPPKPAVAPAVSAPPAAAGAPPAEKPPAAKADGTSQIAAGATTQTNNYHRADGQNTGKLPYGPAFDQGPRLLLEGALPWETRLAATDGAHQAIPPPWRRMLFPQRGQAVAFSCGPQPSPARGGPKDAP

SEQ ID NO: 15261 - DNA, 702 bp, Zea mays
  misc_feature: Ceres CLONE 1377767-F
  misc_feature: Encodes the peptide sequence at SEQ ID NO. 15262
tccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacaacagtttcttccattcaaccaactagctgcattgaactctgcttcttatttgcaacaaaaaccaactacccattccagccaggttatttgggtggcctaaccccccaaaaatttctctccattttacccactgaaaaggtttgaaatcccccggctttattaaagggaggaaaaaattataacctttttcccccccttaacttggggggagacccc

SEQ ID NO: 15262 - protein, 146 aa, Zea mays
  misc_feature: Ceres CLONE 1377767-F
MAAKIFCLLMLLGLSASAATATIFPQCSQAPIASLLPPYLSPAVSSVCENPILQPYRIQQAIAAGILPLSPLFLQQSSALLQQLPLVHLLAQNIRAQQLQQLVLANLAAYSQQQQFLPFNQLAALNSASYLQQKPTTHSSQVIWVA

SEQ ID NO: 15263 - DNA, 704 bp, Zea mays
  misc_feature: Ceres CLONE 1377768-F
ccccgcggtggcggccgctctagaactagtggatcccccgggctgcaggaattcgcacgagaccattacctagaacatcctaatcgaaaaaccgatattattcctcatcatcctcacacctcccgattgattctctcacccaactaaatggatggacacgctactgagacataattctccccttgcgttcttgtcctttacgcgacgcgcgctctgaaaacactatgcacagatgatgacgtgaatcataggtcgattaattcaccgccccacaaagcaagtgcctatacgccctgccacgcgacacgtgtgtcttgctccaagcgacgaacagcaatgggggtcagcctctcacatccgccttctggctttctcggatacccctccttggttcatgtatcacaccaaaaaatcccgaggtatctcgaaaaatagatcctactaacagtgagccaccgagccatggtgaaccctgactgctacttggcaacaggaggtgtttgaatccaaaacatatcgttgtagtgaacgaaccggcaaaacccttgttcccaggactgtccgatctaatgttctgcgttatggaaatgtacatggtcaaccctgcagcctaactatcatagcaacgactgctttcatctatgcggctaacgtggaccagtgcccctacatacctgacacttggaaatgatgccacggagtgg

SEQ ID NO: 15264 - DNA, 767 bp, Zea mays
  misc_feature: Ceres CLONE 1377807-F
  misc_feature: Encodes the peptide sequence at SEQ ID NO. 15265
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
tttttttttnttccnnnnnntgcgccctacggttnnnncaggggggtggtcagaagctggggctccccgcggtggcggccgctctagaactagtggatcccccgggctgcaggaattcgcacgagaccattacctagaacatcctaatcgaaaaaactacgagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttcccccaggccctcgcgcgtcgccaccctcgccagcgacggcgcccgctcccgcgcgctccgtgctggccacacggactcaatccttgaggtgctgggacgggacgatagtgtgaacgcacaggaccccggcccaatgggagaatgggcttgtccctccacgacctaccggctaggcaggggattcgcatccgaagacactgcgcgccccactggctcccttgaaggagaaagacggacgagcttggcagccccccccttaacgtccctagagaaagatcctttgggtcccaagggggatcggaaactagccggagggggccatggctagacaagcccccctttgaggcgcgggggtattcccagggcttggcaaccgacaaacccccccctccccctccacggaaggactttttctattgggggagacttttttac

SEQ ID NO: 15265 - protein, 133 aa, Zea mays
  misc_feature: Ceres CLONE 1377807-F
MESLLASRSIRSSFSAVASTRGAASPRPSRVATLASDGARSRALRAGHTDSILEVLGRDDSVNAQDPGPMGEWACPSTTYRLGRGFASEDTARPTGSLEGERRTSLAAPPLTSLEKDPLGPKGDRKLAGGGHG

SEQ ID NO: 15266 - DNA, 766 bp, Zea mays
  misc_feature: Ceres CLONE 1377811-F
  misc_feature: Encodes the peptide sequence at SEQ ID NO. 15267
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttaatcgcccttggtgtttccaacaatcgccaggccttatcttttgggggggagccattggttaccaaaccatccagcggcacaaaaagcttggagccaactccggggctaccctctggatcaaaccaaaggtgagttcctggaaaaaaccttttcctccccaactcctcaaggagaaaaaaaattttctttccctttcaaacccaaattgggcttaaccttggaacccccgggtggctttaatttggcccgcaacccaacctattttaccctttttaaccccagttaaggctaccgggccaaacctccccaaccaacgaacaaaaccttctttccccttttaaaccacaaattgggcccccccacttgaacacccccccttcgttttaatc

SEQ ID NO: 15267 - protein, 112 aa, Zea mays
  misc_feature: Ceres CLONE 1377811-F
MATKIFSLLMLLALSTCVANATIFPQCSQAPIASLLPPYLPSIIASICENPALQPYRLQQAIAASNIPLIALGVSNNRQALSFGGEPLVTKPSSGTKSLEPTPGLPSGSNQR

SEQ ID NO: 15268 - DNA, 684 bp, Zea mays
  misc_feature: Ceres CLONE 1377813-F
  misc_feature: Encodes the peptide sequence at SEQ ID NO. 15269
aagctggagctcaccgcggtggcggccgctctagaactagtggatcccccgggctgcaggaattcgcacgagaccattacctagaacatcctaatcgaaaaacttcttatgaatggtcgctctctccctatgccctttcgcatcgctctcgagagtaggacactctcccgagtaccggtttaagcttcaagagtttccctcctcctcttacttcgtcccgcttgatggggcgcggcatctatccaggttctgggcctgcctatatatatacgctcggcgaccgtcgcccttccatactccctagtcatgctccgtctccaccatcgagattgatcgagctcgcccgcaggcgggatgaatacaatgccttcgctctcctcaggtaggcgggtgaccgctgctcccgttcccggctgccgatttgacgcactgtttcaagtcagttgaagataggcctacagacacatgcggaccgctgtcagggcactcgagaagctgtgcaactgagagtacttcgtcccggactcagtcgctgaaatattcattgatgacttcatggagatgacaacacgaggcggggtgatccgtgatgatgatgttggatgagtgtctggagaagtcatcaccgttgaagctctagcaacctagcataatatgtttaggaccatccattcggtaaaataa

SEQ ID NO: 15269 - protein, 30 aa, Zea mays
  misc_feature: Ceres CLONE 1377813-F
MNTMPSLSSGRRVTAAPVPGCRFDALFQVS

SEQ ID NO: 15270 - DNA, 885 bp, Zea mays
  misc_feature: Ceres CLONE 1377829-F
  misc_feature: Pfam Name: Lipase3_N Pfam Description: Lipase 3 N-terminal region
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (885)..(885): n is a, c, t, g, unknown, or other
tccccccccccccccctcccgccccccaccattaccnnnnnnntnncaaagctggagctccccgcggtggcggccgctctagaactagtggatcccccgggctgcaggaattcgcacgagaccattacctagaacatcctaatcgaaaaaaaacaactcgaccaaacccaagtccagacccgcagctcccgtcagccgccggaggcggagggaaccgagccggcgaccggcagaccgcagagaagaggccagaagccgaccgcaggcagccgccaccgcaccaaaacccgaggtctcgaggcaatcgagcgcgcgcgggtcgggggctgcggccatgtcggtgagttgcggcctcaagtggttggtgtgccttggctgcacccggtgggcggtgaaagcggctcacctacttcggcccctacaaacagcgagaagtggccgccggggctccgcggacgaagttccaagcccggtccccgcgcctcctgccggggccgtggatccgcgaactaacgaccgaaggagcttctccccgcccccaaggttccgcgcccccccgggaatccagggcgtactgttcggacctccggaacccccaaggggcgatccctctcaagccggcgttaaccctcacaagggaagggcccggcaaacgctgaggcccccggccggtacctcctggctaaaggggcgtccgcgaggggggacacgggggaggaatcctccccccgcccggtggccgcgggcgcccgaagcctcggagggaggcaacgcactaacctcacagggggggcctcactgtggtataacaagcggttccgcggacaggacgaatggtctcaaaggcgcgggttcgtccgtgccccgcgcggacgcattcaccan

SEQ ID NO: 15271 - DNA, 651 bp, Zea mays
  misc_feature: Ceres CLONE 1377839-F
  misc_feature: Translation starting site: 179
cgctctagaactagtggatcccccgggctgcaggaattcgcacgagaccattacctagaacgtcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgaacgtggcgacgctgttccccgctggcgggctgctgctggtgctgtcggggctggcgctgacggcctccgtggtggggctggccgtgccacgccggtgttcctgatcttcagccccgtgctggtcccccgcgcgctgctcatcgggacggccgtcatggggttccttcacgtcggcgcgctggggctcgggggcctggcctcgttcaggggctccgccacacggggggggaggggttcccggcgccccccgactacggggggggaggccccccaaggattggggaggcccgggcccacccggcccaaaaaaccgcaagggaggccc

SEQ ID NO: 15272 - DNA, 665 bp, Zea mays
  misc_feature: Ceres CLONE 1377847-F
  misc_feature: Encodes the peptide sequence at SEQ ID NO. 15273
gctctagaactagtggatcccccgggctgcaggaattcgcacgagaccattacctagaacatcctaatccaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttacccaaagaggttgggcgatggatcggatgatgggccaatctaccgcgggaaccgaagaagttgctatgggcgagagggggccccaaaagaaaggacccttgcccaatagggacggggccgggaaaccctggcaggttcaaaattggggggttttttgggcccgggggttggggtttctcccgggaacccaaaaaagggggggccggggtttgttttgtt

SEQ ID NO: 15273 - protein, 181 aa, Zea mays
  misc_feature: Ceres CLONE 1377847-F
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTQRGWAMDRMMGQSTAGTEEVAMGERGPQKKGPLPNRDGAGKPWQVQNWGVFWARGLGFLPGTQKRGGRGLFC

SEQ ID NO: 15274 - DNA, 672 bp, Zea mays
  misc_feature: Ceres CLONE 1377849-F
  misc_feature: Encodes the peptide sequence at SEQ ID NO. 15275
aagctggagctccccgcggtggcggccgctctagaactagtggatcccccgggctgcaggaattcgcacgagaccattacctagaacatcctaatcgaaaaaaacgaaaggactgccctaacctcgtgcagtcgtgcccgcttgtttcccttgctcgccttcacccctcgccgccgccgccgccgtcgccgtcgcaagcgacgatgctcgacatcaacttgttccgcaccgacaagggcggcaacccagaccttattcgcgagtcccagcgcagtcggttcgcctccgtcgagctcgtcgacgaggtcatcgccctcgacaaggcatggcgcgaaaggcagttcgagctggacaagatccggcaggagctcaacgctaccagcaagaagatcggcaagctcaaagccagcaagcaagaagaaggagcgaagaggctcatggagagcaccgacgaaattaaagaaaggttgggcagccaaaaaagttgaggtgcagaaggccaaaagccccctccaagccaaaggccacaacgattggcaaaattcgggcattaagtccgggccacatccaacgacaaaccagggaaaaaaaaaaaaattgtcccggcatttttggagaagaaaaaagaggtaagggtttaatttggaaaaaaacccccggggacccttttgc

SEQ ID NO: 15275 - protein, 94 aa, Zea mays
  misc_feature: Ceres CLONE 1377849-F
  misc_feature (1)..(94): Pfam Name: Seryl_tRNA_N Pfam Description: Seryl-tRNA synthetase N-terminal domain
  misc_feature: SWISSPROT Homolog: EC 6.1.1.11 Serine--tRNA ligase
MLDINLFRTDKGGNPDLIRESQRSRFASVELVDEVIALDKAWRERQFELDKIRQELNATSKKIGKLKASKQEEGAKRLMESTDEIKERLGSQKS

SEQ ID NO: 15276 - DNA, 672 bp, Zea mays
  misc_feature: Ceres CLONE 1377850-F
  misc_feature: Encodes the peptide sequence at SEQ ID NO. 15277
  misc_feature (247)..(247): n is a, c, t, g, unknown, or other
  misc_feature (447)..(447): n is a, c, t, g, unknown, or other
  misc_feature (513)..(513): n is a, c, t, g, unknown, or other
aaagctggagctccccgcggtggcggccgctctagaactagtggatcccccgggctgcaggaattcgcacgagaccattacctagaacatcctaatcgaaaatttttctactcccgcgcccctccgcgagctccctacccctcgcgctcacgccggcgacaagtttccgccagagttaggtagatcaggtgctgcgccggcagccgtggaagggatggaggacctcgcgagttcgcgtggcggcggnggatgcggtggtcttgatgcgcagatcgaacagctcatggagtgccgcccgctcccagagacggaggttaaaacactgtgtgagaaggccaaggagatattaatggaggaaagcaatgttcagccagttaaaagccctgtgacgatttgtggtgatattcatggccaattccatgatcttttagaacttttccggatggnttgggaagtgtcagatacaaattatttgtttatgggtgattatgtggatcgtggctattactctgntgagacagtaacgctttttagtgcacttaaggtgcgggtaccggcacgcattaccattcttcgtggaaacatgaagtaggcagatcccacagtgtatggctccatggatgatgctacgaaaatatgcagggcaatgtctggaagatcttcctgatcttt

SEQ ID NO: 15277 - protein, 125 aa, Zea mays
  misc_feature: Ceres CLONE 1377850-F
  misc_feature: SWISSPROT Homolog: EC 3.1.3.16 Phosphoprotein phosphatase
  misc_feature (78)..(78): Xaa is any aa, unknown, or other
  misc_feature (100)..(100): Xaa is any aa, unknown, or other
MEDLASSRGGGGCGGLDAQIEQLMECRPLPETEVKTLCEKAKEILMEESNVQPVKSPVTICGDIHGQFHDLLELFRMXWEVSDTNYLFMGDYVDRGYYSXETVTLFSALKVRVPARITILRGNMK

SEQ ID NO: 15278 - DNA, 690 bp, Zea mays
  misc_feature: Ceres CLONE 1377852-F
  misc_feature (455)..(455): n is a, c, t, g, unknown, or other
  misc_feature (457)..(457): n is a, c, t, g, unknown, or other
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcgaaaattccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttgttccccggtccctcctcctgtccccgcgtagatccgtccgtccgagggagcacaccgtccccaccccccatgtttacccacagttcctctgacggccgccgtgctccgatgaggctgagcgtgctccgtatcggcngntcccactccttctccgncgccttcctcaactggtctacgtcttcccatgaaaggatcgcccctctccaagtggtgaaccttccccggttccccctctcttttctccctgaaaaagctttcaaaacactccaagggcccccgggttttcccaatttttcccccaaaccaaaccccccaaaaaagatattacccccaaaaaaaaaaaaatccctgtttcccgccacccccgcgaa

SEQ ID NO: 15279 - DNA, 777 bp, Zea mays
  misc_feature: Ceres CLONE 1377853-F
cccgctggagctccccgcggtggcggccgctctagaactagtggatcccccgggctgcaggaattcgcacgagaccattacctagaacatcctaatcgaaaagatggtctcgtactcttgtcacgttccttcctgactgcccccacttctcctccggcggcgcggcggcggcttacctcccaacagccccgaccatggaagccgacctcgctttcccgtatgagatcccccggaccgcccccttcctccccgaccgcgcctaccccagggccccgcccccgctccccaccccacgctgaacgatgctcgccccccccccccccgcccccccccccccccacttcccccccccccgggcccccgccacccccccccacccccccccggcccccccccccccccacaccccccccccccccccccccccccccccccgccgcccccccgccccccccccccccccccccccccccccccaacccccccccccccccccccccccccgcccccccccccccccccccacccccccccgcccgcccccccccccccccccccccccccccccccccccgcctcccccctctctcccgtcccccccctcccctccccccttcctacccccacccccctcgcccccccacccgtccctccccctcgcccccgctcccccccctcacccagcccccccccccccccacccccccccgccgccccccccccccacgccttcaccgcccccataccactgccgcccccgccgtcccccccccctcg

SEQ ID NO: 15280 - DNA, 684 bp, Zea mays
  misc_feature: Ceres CLONE 1377855-F
  misc_feature: Encodes the peptide sequence at SEQ ID NO. 15281
  misc_feature (323)..(323): n is a, c, t, g, unknown, or other
  misc_feature (501)..(501): n is a, c, t, g, unknown, or other
  misc_feature (502)..(502): n is a, c, t, g, unknown, or other
  misc_feature (531)..(531): n is a, c, t, g, unknown, or other
  misc_feature (548)..(548): n is a, c, t, g, unknown, or other
  misc_feature (549)..(549): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaaacgctctccgccgccacttctcctccggcatcgacgaggcgaagccccagcgcccgagtccctctccctgctcccacgacccatggcggcggatatggcgtacgcgccgccgatgaaggcgggcaaggccgggttcgaggctggcatgatggatccgcagcacaggatccgcatcacgctctcctccaagagcgtcaagaacctcgagaaagtctgcggngatctggtgaagggcgccaagggtaaggagctcaaggtcaagggccccgtgcggatgcctaccaaggtgctccacatcaccaccaggaagtctccctgtggagaaggtaccaacacctgggatcgctttgagatgaggattcacaagagggtgatcgatctcgtcagtacaccagacnngtgtcagcagatcacctcgatcactattngaacaggtgtcgagggnntgagtgactatcagtgacgcttaatatggtagccttatcatttcaaaaggcttctagtgaaacagatattttccattcctagggagaactggtgtaacagagggatccnagtatttcatatcaaaggtaaaaagg

SEQ ID NO: 15281 - protein, 126 aa, Zea mays
  misc_feature: Ceres CLONE 1377855-F
  misc_feature (28)..(120): Pfam Name: Ribosomal_S10 Pfam Description: Ribosomal protein S10p/S20e
  misc_feature (106)..(106): Xaa is any aa, unknown, or other
  misc_feature (116)..(116): Xaa is any aa, unknown, or other
  misc_feature (122)..(122): Xaa is any aa, unknown, or other
MAADMAYAPPMKAGKAGFEAGMMDPQHRIRITLSSKSVKNLEKVCGDLVKGAKGKELKVKGPVRMPTKVLHITTRKSPCGEGTNTWDRFEMRIHKRVIDLVSTPDXCQQITSITIXTGVEGXSDYQ

SEQ ID NO: 15282 - DNA, 654 bp, Zea mays
  misc_feature: Ceres CLONE 1377859-F
  misc_feature (638)..(638): n is a, c, t, g, unknown, or other
aaagctggagctccccgcggtggcggccgctctagaactagtggatcccccgggctgcaggaattcgcacgagaccattacctagaacatcctaatcgaaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctccctcaagtcagagctccctctgggcgntcccatggtcgccccc

SEQ ID NO: 15283 - DNA, 659 bp, Zea mays
  misc_feature: Ceres CLONE 1377862-F
  misc_feature: Encodes the peptide sequence at SEQ ID NO. 15284
  misc_feature (318)..(318): n is a, c, t, g, unknown, or other
  misc_feature (330)..(330): n is a, c, t, g, unknown, or other
  misc_feature (367)..(367): n is a, c, t, g, unknown, or other
  misc_feature (370)..(370): n is a, c, t, g, unknown, or other
  misc_feature (373)..(373): n is a, c, t, g, unknown, or other
  misc_feature (399)..(399): n is a, c, t, g, unknown, or other
  misc_feature (430)..(430): n is a, c, t, g, unknown, or other
  misc_feature (433)..(433): n is a, c, t, g, unknown, or other
  misc_feature (436)..(436): n is a, c, t, g, unknown, or other
cagagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggncttggccctggncgtgtcgaccgccgaggcgaggaaacatcagaccacnacnacngaaaagagggacgacgcgtggtgcanccgcagacttccccgccttcgaccgctcggnggnggngcgtccccggcgtttcgggggcctcccggcggcagcattcctggcagcagcattccccggtttcagcatggccgggaagcggcaagaagctaccccgggtcagctggcccgggaaggggagatgcccctttttcggggggggttccccggggttcaaggggtttcgggggattggcccgggttccccccccggcgggttcccgcccccgaggaccccaaaaag

SEQ ID NO: 15284 - protein, 52 aa, Zea mays
  misc_feature: Ceres CLONE 1377862-F
MAGKRQEATPGQLAREGEMPLFRGGFPGVQGVSGDWPGFPPRRVPAPEDPKK

SEQ ID NO: 15285 - DNA, 673 bp, Zea mays
  misc_feature: Ceres CLONE 1377864-F
  misc_feature: Encodes the peptide sequence at SEQ ID NO. 15286
  misc_feature (387)..(387): n is a, c, t, g, unknown, or other
  misc_feature (404)..(404): n is a, c, t, g, unknown, or other
  misc_feature (425)..(425): n is a, c, t, g, unknown, or other
  misc_feature (491)..(491): n is a, c, t, g, unknown, or other
  misc_feature (545)..(545): n is a, c, t, g, unknown, or other
  misc_feature (646)..(646): n is a, c, t, g, unknown, or other
  misc_feature (647)..(647): n is a, c, t, g, unknown, or other
  misc_feature (649)..(649): n is a, c, t, g, unknown, or other
caaagctggagctccccgcggtggcggccgctctagaactagtggatcccccgggctgcaggaattcgcacgagaccattacctagaacatcctaatcgaaaaaaacctaaacctctcacccggcgccgccgccgccgccgccaccgccgccgccccgaggccccatcccagcgaaaccgacttccgcctcggattgaagcaatgtcgtcggacgacgaggtcagggaggagaaggagctcgacctctcctccaacgatgtcgtcaccaagtacaagactgccgccgaaatcctgaaacacgctctgaagctggttgtgtctgagtgcaagccaaaaagcaagattgttgacccttgtgagaagggtgactctttcataagagagcnaactgggaatgtctacnagaaatgcaagagaaagattngaaggggcattgctttccccacctgtgtttcggtgaacaacacagtctggcacttctccccgcttnacacaggatgatggcagtcttgaagaaaatgacatggtaaaaattgacatgggnggccataatgatggctttattggctgggggggacctacccatgtaattgccaaagggcctgtcacaggagagcacctgatggtctggctgctgccaccagnnanaaaagtgccattgagcttgtcaac

SEQ ID NO: 15286 - protein, 99 aa, Zea mays
  misc_feature: Ceres CLONE 1377864-F
  misc_feature: SWISSPROT Homolog: EC 3.4.11.18 Methionyl aminopeptidase
  misc_feature (62)..(62): Xaa is any aa, unknown, or other
  misc_feature (68)..(68): Xaa is any aa, unknown, or other
  misc_feature (75)..(75): Xaa is any aa, unknown, or other
  misc_feature (97)..(97): Xaa is any aa, unknown, or other
MSSDDEVREEKELDLSSNDVVTKYKTAAEILKHALKLVVSECKPKSKIVDPCEKGDSFIREXTGNVYXKCKRKIXRGIAFPTCVSVNNTVWHFSPLXTG

SEQ ID NO: 15287 - DNA, 639 bp, Zea mays
  misc_feature: Ceres CLONE 1377866-F
gagggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctccctggtgctcaacctcatcatgtacatcatcgtcatcggcttcgggagctggaacctgaaccacttcatcaacgggcagaccaactacccccgggggggccggcaacggcggcaacgttctacttccctggtgttccccatcctggccggcgatgatgggcgcccgcctccaagcttagcggggggtgcaccaccgtgcgcgcctgggggccacaaaggcttggccaccaaacgcccgggtcgtcgcttcatcccccggggccattacgggggctcccctttccggctttgccctgcaagggaaatccccctcccg

SEQ ID NO: 15288 - DNA, 674 bp, Zea mays
  misc_feature: Ceres CLONE 1377867-F
  misc_feature: Encodes the peptide sequence at SEQ ID NO. 15289
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (658)..(658): n is a, c, t, g, unknown, or other
  misc_feature (659)..(659): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaacccttggcttcgttccatccggcttctcggcggcggcggagaggagggggatggcgcaccggctgctgcgggacgcgcaggcggacgggtgggagcggtcggacttccccatcatctgcgagtcatgcctcggcgacaacccctacgtccggatgttaagagctgaatatgacaaagaatgcaaaattggtgcacgtccttttactgtattccggtgccgtcctgggcgagatgcaggtaccagaagactgagatctgccagacatgttgcaagctaaaaaaggctgccaggtcctgctgctggatcctgatatgggctgcttgtccggccccgaatcccgactccctaccaatccaaggaggcatccaggggggatgccaccccaaaattttgcaaaaacctgaagggggccaagttgcataactagatcccccagggaggcccccagggactttggggtccgggccccccttcaaaggaacacctggtgctttttgggggggcaaggggcctccggggagggccctacggcgnnnnnnnnnnnnnnnnnnnccnncnnnnnnncnnnccn

SEQ ID NO: 15289 - protein, 75 aa, Zea mays
  misc_feature: Ceres CLONE 1377867-F
MAHRLLRDAQADGWERSDFPIICESCLGDNPYVRMLRAEYDKECKIGARPFTVFRCRPGRDAGTRRLRSARHVAS

SEQ ID NO: 15290 - DNA, 618 bp, Zea mays
  misc_feature: Ceres CLONE 1377872-F
  misc_feature: Encodes the peptide sequence at SEQ ID NO. 15291
  misc_feature (397)..(397): n is a, c, t, g, unknown, or other
  misc_feature (398)..(398): n is a, c, t, g, unknown, or other
  misc_feature (412)..(412): n is a, c, t, g, unknown, or other
  misc_feature (414)..(414): n is a, c, t, g, unknown, or other
agagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatcgcagcagtgggtgtattnntggtgaggaatgtngnccattacgggtggttcttaccaggtggacaaaaggggttgggctgaatacgttttggagaacctttcaaggttctgggaacacccccctaattggggggaaaaacctcctttaacttggccaaggggaaattttgaaaccgggaaaattgaaaagggccctgaaggccccgccccccttttaaagggccatttaaaacctgggg

SEQ ID NO: 15291 - protein, 129 aa, Zea mays
  misc_feature: Ceres CLONE 1377872-F
  misc_feature (87)..(87): Xaa is any aa, unknown, or other
  misc_feature (92)..(92): Xaa is any aa, unknown, or other
MATAFSLRAAAPATAPRAVSRSTSAARVVPVASALAGRGRLVARAAVTAKADVPSSTSDGHEVLLFEALREALMEEMELDRSSGCIXGEECXPLRVVLTRWTKGVGLNTFWRTFQGSGNTPLIGGKNLL

SEQ ID NO: 15292 - DNA, 614 bp, Zea mays
  misc_feature: Ceres CLONE 1377873-F
  misc_feature: Translation starting site: 195
agagctggagctccccgcggtggcggccgctctagaactagtggatcccccgggctgcaggaattcgcacgagaccattacctagaacatcctaatcaaaaaacacactcgactctcctctctcgcatccgcagcctttcgagctctactccaccccctcgatctcgaagcgcagcagcagcagtcaggcggccatggacgcgagcgcagccggagccggcgggaaggcgaagaagggcgcggccgggcgcaaggccggcgggccgaggaagaagtcggtgacgaggtccgtcaaggccgggctgcagtttcccgtcggccgcatcgggcggtacctgaagaagggccggtacgcgcagcgcgtcggcacgggcgcccccgggctacctggccgccgtcctcgagtacctggccgccgaggtgctggagctggccggcaacgctggcaaggacaacaagaagacccgcatcatcccgcgccacgtgctccttgccatccgcaacgacgaggagctcggcaagctgcttgtccggcgtcaccatcggccacggggggcgtcctccccaacatcaaccccggtgctcctgccccagaagaccgctgaagagggcgg

SEQ ID NO: 15293 - DNA, 631 bp, Zea mays
  misc_feature: Ceres CLONE 1377874-F
  misc_feature: Encodes the peptide sequence at SEQ ID NO. 15294
agagctggagctccccgcggtggcggccgctctagaactagtggatcccccgggctgcaggaattcgcacgagaccattacctagaacatcctaatcgaaaattcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcatccctcctggttagcatctaagtattggttttttctggcatgcttagtgccttgtggttaaaaacataaagggcttatagagggtattgcaaaaaaagggactaaatatactctcatatggaaattactaattggggactctgggggcatttctccaagggggca

SEQ ID NO: 15294 - protein, 94 aa, Zea mays
  misc_feature: Ceres CLONE 1377874-F
  misc_feature (1)..(94): Pfam Name: HR_lesion Pfam Description: HR-like lesion-inducing
MGFISFVGRVLFASLFLLSAYQEFIEFGNDGGPAAKTLKPKFNLFVKLVSKNTGLGLPHMDIKTVIAATMFLKGFGGLLFIVSSSFGASLLVSI

SEQ ID NO: 15295 - DNA, 680 bp, Zea mays
  misc_feature: Ceres CLONE 1377878-F
  misc_feature: Translation starting site: 166
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatggagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgcgcgggtgtgggcagacgagcgccatgtaccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaacccatggcccatgaggatggcgcagacatgcccgnccatgggtggactctaccagtaccagtaccagctgccccgctacggaccagccccgtggtggg

SEQ ID NO: 15296 - DNA, 682 bp, Zea mays
  misc_feature: Ceres CLONE 1377879-F
  misc_feature: Translation starting site: 208
  misc_feature (389)..(389): n is a, c, t, g, unknown, or other
tggagctccccgcggtggcggccgctctagaactagtggatcccccgggctgcaggaattcgcacgagaccattacctagaacatcctaatcgaaaagatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccagttgggtgaggnctctgctggtcaggtcacaaggaacatgcttgcaaatgagggtgtccgttctttctacaagggtttgtccgccggattgctgaggcaagcgacgtacacgactgctcgtcttggatcctttagggttctaactaacaaagcagttgaaaagaatgaagggaaggcattgcctctatttcagaaagcttttattggtctgactgctggtgcagttggtgcttggggttgggagtcctgctgatctgggactcattagagtgcaagccgattcgaccctgccagttgacaacgac

SEQ ID NO: 15297 - DNA, 649 bp, Zea mays
  misc_feature: Ceres CLONE 1377880-F
  misc_feature: Translation starting site: 202
  misc_feature: Pfam Name: Fasciclin Pfam Description: Fasciclin domain
agagctggagctccccgcggtggcggccgctctagaactagtggatcccccgggctgcaggaattcgcacgagaccattacctagaacatcctaatcgaaaacaactcccccggccgtcctgctcgccggcttctggctggcccctgcatccgcccagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagagccaggcgaacgacacgaagcggggcggcatcaccggtcttcgtgcccaaggactcggcgttcgcggcgctgaagcagaccacggtcggcaacctcacccaggaccagctcaggtcgctgctgctgtgccacgcgctgcccaggtactactcgctgggcgagttcgaccggttgagcgcgctcgccccgggggcaccctcc

SEQ ID NO: 15298 - DNA, 705 bp, Zea mays
  misc_feature: Ceres CLONE 1377885-F
  misc_feature: Encodes the peptide sequence at SEQ ID NO. 15299
  misc_feature (151)..(151): n is a, c, t, g, unknown, or other
  misc_feature (356)..(356): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (370)..(370): n is a, c, t, g, unknown, or other
  misc_feature (371)..(371): n is a, c, t, g, unknown, or other
  misc_feature (391)..(391): n is a, c, t, g, unknown, or other
  misc_feature (393)..(393): n is a, c, t, g, unknown, or other
  misc_feature (395)..(395): n is a, c, t, g, unknown, or other
  misc_feature (410)..(410): n is a, c, t, g, unknown, or other
  misc_feature (443)..(443): n is a, c, t, g, unknown, or other
  misc_feature (482)..(482): n is a, c, t, g, unknown, or other
agagctggagctccccgcggtggcggccgctctagaactagtggatcccccgggctgcaggaattcgcacgagaccattacctagaacatcctaatcgaaaactcggctcatctcatttttctatttcggcccctctactgttccaataantaataaaaagattctcgattcgatttactcgccaattttcaggtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggacaagggcggtgaagtncgaatccnnnaaanngagaggtgagggagtatganancnacatgaggaagctgnaggagctgctttctaagctgaacccctcgccgnaggagttcgtgccgcagtccccgcggcgggtggacgggnggcgctccccgcctttcggccgacgggccccggggtccttgtcccccgggaatttaattatttaaggggggccacacacaggtttccgggcggcgggagttttttgggaaaaaaacaaacccgaatgcagtgcttgaaatttttgggggggggccccccccgggggtttgcatttttttgggcgccgggaagaaatttattcccccagatgggcggatcccca

SEQ ID NO: 15299 - protein, 45 aa, Zea mays
  misc_feature: Ceres CLONE 1377885-F
  misc_feature (41)..(41): Xaa is any aa, unknown, or other
  misc_feature (42)..(42): Xaa is any aa, unknown, or other
  misc_feature (43)..(43): Xaa is any aa, unknown, or other
MVAVAVDGLIRGADAVPAAEREAVRAAAAEAADKGGEVRIXXXER

SEQ ID NO: 15300 - DNA, 631 bp, Zea mays
  misc_feature: Ceres CLONE 1377887-F
  misc_feature: Encodes the peptide sequence at SEQ ID NO. 15301
  misc_feature (326)..(326): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
aagctggagctccccgcggtggcggccgctctagaactagtggatcccccgggctgcaggaattcgcacgagaccattacctagaacatcctaatcgaaaagaagtgttcgtgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattngctcacaagcaggcaattcccttcccgaatactgtgnnngtgttggtcggacgggcagctagtcgcgcactccatgggcaggccgctggccgttaatcagcgggtcatctggattgctgaaaatgctaaagtaccctaagtgagggtttgatgggaacacctctaatttccccctccggggaaccaacccaaagaaaaggggccgaacctacggggttcgggaggaaaaacccaaatggcccccccttgccaattggggttattttgccaaaaaagaaaaccctgggaaaaaaggggttaaaact

SEQ ID NO: 15301 - protein, 72 aa, Zea mays
  misc_feature: Ceres CLONE 1377887-F
  misc_feature (53)..(53): Xaa is any aa, unknown, or other
  misc_feature (65)..(65): Xaa is any aa, unknown, or other
  misc_feature (66)..(66): Xaa is any aa, unknown, or other
MVKYSQEPGNPTKSAKAMGRDLRVHFKNTRETAFALRKLSLTKAKRYLEDVIXSQAGNSLPEYCXXVGRTGS

SEQ ID NO: 15302 - DNA, 679 bp, Zea mays
  misc_feature: Ceres CLONE 1377888-F
  misc_feature: Translation starting site: 204
aaagctggagctccccgcggtggcggccgctctagaactagtggatcccccgggctgcaggaattcgcacgagaccattacctagaacatcctaatcgaaaaaaaccctagaagcctccaccctccagcgcctccaccttcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagcgttgaggatctaatcctctccgggggatctggtggtggcgctgctccagttgctgcttccgccccagctgggggtgctgcagctgctgctgcccctgctgcagaggaaaaaagggagagcccaaggaggagtctgatgacgacctgggcttcagcctggtcgactgagaccctcgctaccccggccatagcaaattcgcttatggtgtcccagacctatctttacgtaatggctggagggcttttggtattacaaggactccaggtttttgggtttttgaggagggggctaatgacaaggggagtgaagaagcc

SEQ ID NO: 15303 - DNA, 695 bp, Zea mays
  misc_feature: Ceres CLONE 1377891-F
  misc_feature: Encodes the peptide sequence at SEQ ID NO. 15304
  misc_feature (320)..(320): n is a, c, t, g, unknown, or other
  misc_feature (321)..(321): n is a, c, t, g, unknown, or other
aaagctggagctccccgcggtggcggccgctctagaactagtggatcccccgggctgcaggaattcgcacgagaccattacctagaacatcctaatcgaaaaaagttcgggagggactccatttttcttctgacgttcaccccgagtgggcgaccgccgccgccgccgccgccccacgccaggtgcacagatcttcgtcgggcccttggccggcgacgaacgccagcagattatcgggtaacatgcgcacaaccatgtcctttaccgggtccgcccctgccaatgatccctgcctcgccaagatcctgtccaagcaaggnngacacaaagttctctttgcggacaaggtattaaaggtcaccccatctggaaagatgaaaagacgcatcctagtgatcacagactttgctctatacctttgtgaccccgaggcccacatattggagaggaggatagcacttgcagctggggataagctatcattagcaacctcagggataacgcctttgcaacctttgggcccaatggatacaattggttaaatgggccccactaaaaaagaaggaaattgttggggccctttgtaagggtttccaaaaccaccttgagattagaccctggggggggtctcccttaaaagggtttggagatccggggcgggggggaaatattaaggggggggaaattttgggggg

SEQ ID NO: 15304 - protein, 95 aa, Zea mays
  misc_feature: Ceres CLONE 1377891-F
  misc_feature (23)..(23): Xaa is any aa, unknown, or other
MSFTGSAPANDPCLAKILSKQGXHKVLFADKVLKVTPSGKMKRRILVITDFALYLCDPEAHILERRIALAAGDKLSLATSGITPLQPLGPMDTIG

SEQ ID NO: 15305 - DNA, 653 bp, Zea mays
  misc_feature: Ceres CLONE 1377894-F
  misc_feature (402)..(402): n is a, c, t, g, unknown, or other
  misc_feature (525)..(525): n is a, c, t, g, unknown, or other
  misc_feature (541)..(541): n is a, c, t, g, unknown, or other
cgctctagaactagtggatcccccgggctgcaggaattcgcacgagaccattacctagaacatcctaatcgaaaagacacccgtggtaaatccttgggccgacctaggccgtccgatcacccgctcgtcgcatccaccggccccgccgccgcgcgcaccagcctctcgatgcccccaattaattcgggtcccgtggtgtggcggcagcggcagcggcagcagtactgcctccactgcagtcccaggttagcgctctcagcggtggcggccggcgaccggcgacatcctccggtatcgactcccgtagagtggagcgttgaaccacgctgcggacctgcattcaccagtccgccgtttccttcgccttctccgcgtggtccggttgctctggccactgatggncggtgacattacttgcggatccttgctgcaaaaattgcagttgatatgggatgaaggttgcgagagtgatgaggatcgtgacagggtctttatcagctggatcaggaatggcttgatgttacnagaggaaagttgaccnagcactaactctagggatctcctgatcaggctctggatgactcaaagatagaactggctaggcttctttctggtcttggagaaaaagctattgcaagaaccctgagaagaca

SEQ ID NO: 15306 - DNA, 678 bp, Zea mays
  misc_feature: Ceres CLONE 1377896-F
  misc_feature: Encodes the peptide sequence at SEQ ID NO. 15307
agagctggagctccccgcggtggcggccgctctagaactagtggatcccccgggctgcaggaattcgcacgagaccattacccagaacatcctaatcgaaaacactgaaacgaaattaccctatagggatgagatttaaaatgaggtttgaaggtgaagaggctccagaacaaaggttcactgggaccattgttggaaatgtggatcctgatcaagctggatgggctgaatctaaatggcgttacctcaaggtgaggtgggatgaagcttcctccattccacgtcctgaaagggtttctccctggcaaatagaacctgcagtcagccctccccctatcaacccgcttccagtgcacagacccaagagaccgcgctctgggggggggggttctctgcccgagtcttcagctccaacaaaagaagctgctccaaaggtcacattagagactcaacaacatgccctgcagaggcccttgcagacccaggataatgtggccccgaagagtgtttttggtgataacagtgaattggactctgctcataagtgctccctggcgaccggcagggttttgatctggaccagagcaccattggcatgcagagggaagctggtttcagatattttggatgcaaatggaacaggcctggatggtaccggtgaaatgttatcggggatac

SEQ ID NO: 15307 - protein, 183 aa, Zea mays
  misc_feature: Ceres CLONE 1377896-F
  misc_feature (1)..(41): Pfam Name: Auxin_resp Pfam Description: Auxin response factor
MRFKMRFEGEEAPEQRFTGTIVGNVDPDQAGWAESKWRYLKVRWDEASSIPRPERVSPWQIEPAVSPPPINPLPVHRPKRPRSGGGGSLPESSAPTKEAAPKVTLETQQHALQRPLQTQDNVAPKSVFGDNSELDSAHKCSLATGRVLIWTRAPLACRGKLVSDILDANGTGLDGTGEMLSGI

SEQ ID NO: 15308 - DNA, 735 bp, Zea mays
  misc_feature: Ceres CLONE 1377899-F
  misc_feature: Encodes the peptide sequence at SEQ ID NO. 15309
  misc_feature (407)..(407): n is a, c, t, g, unknown, or other
  misc_feature (408)..(408): n is a, c, t, g, unknown, or other
  misc_feature (429)..(429): n is a, c, t, g, unknown, or other
  misc_feature (484)..(484): n is a, c, t, g, unknown, or other
aaagctggagctccccgcggtggcggccgctctagaactagtggatcccccgggctgcaggaattcgcacgagaccattacctagaacatcctaatcgaaaacagaataaagataaagaacatggagcttgagattcgtcggcgtgaatctacagggtctggtcctaacacatacgttgagactgagacactagcgaaatttgagcttatggatggcgccccagttagaggagaatcgattccggtgagactattcttgacgccgtatgagcttaccccaactcatcgcaacataaacaacaagtttagtgtcaaatactacctaaacctagtcattgttgacgaggaagaccggaggtatttcaagcaacatgagatcacaatgtatcgccttctagaaaccccanncatctcataggctcccttccnttgcttctatgagttggaaccagagctagaggcattttggtttgaccttgcacgnagacgccaaagtggtgggccttacttttggcccgccttgaaataactctcccgagggagcatgcagttcttagggagaaacataaaaatgcagtctacccaatgggggtgctttggtactggccttgtttagacccacccggaaaaagcctggaaaaggtttggatcaccggccctcccctgggttccttttttgcccttgcggaacttgaaaagtttggaaggattcccagggggaaggaggaaaaaatt

SEQ ID NO: 15309 - protein, 98 aa, Zea mays
  misc_feature: Ceres CLONE 1377899-F
  misc_feature (1)..(77): Pfam Name: Vps26 Pfam Description: Vacuolar protein sorting-associated protein 26
  misc_feature (96)..(96): Xaa is any aa, unknown, or other
MELEIRRRESTGSGPNTYVETETLAKFELMDGAPVRGESIPVRLFLTPYELTPTHRNINNKFSVKYYLNLVIVDEEDRRYFKQHEITMYRLLETPXIS

SEQ ID NO: 15310 - DNA, 719 bp, Zea mays
  misc_feature: Ceres CLONE 1377900-F
  misc_feature: Encodes the peptide sequence at SEQ ID NO. 15311
  misc_feature (484)..(484): n is a, c, t, g, unknown, or other
aagctggagctccccgcggtggcggccgctctagaatagtggatcccccgggctgcaggaattcgcacgagaccattacctagaacatcctaatcgaaaactctctgttgcatttcccgtcctgtccttccacccggcggcttaaaccctagttctcactcccatcgccgcttcagctccgccgctgcagatggagttctggggtctcgaggtcaagcctggttccactgttaagggtgagcctggatatggctttgggctgcacctttcccaggcttggtcttggggaatcgaagaaaagtgataatgcccttgatggatgtcaaaaattgatgattcagaaacttgccattggaaacccctctctgttgacgagaggcggggcgttaccattttggatctgatttttttcgataaaaagaaggttgggaggtgtcgacacatcagaaactagcccggcgggttgttctttcccggggttagnagcggcagggtgaggagccctttcgagagggagggagggggatcctcggccgggtggttcttctgaaaatgacacgtggagttaatggttccagagcccaggaaaagggccaaggttgttggaaggaaaacgaaaggccagagaaaggggggggtggggggacggttggaaaataaaagcgccgggttccaagaaaagcaaggggtgggccaccgttcttgtgggagggggaagg

SEQ ID NO: 15311 - protein, 51 aa, Zea mays
  misc_feature: Ceres CLONE 1377900-F
MALGCTFPRLGLGESKKSDNALDGCQKLMIQKLAIGNPSLLTRGGALPFWI

SEQ ID NO: 15312 - DNA, 692 bp, Zea mays
  misc_feature: Ceres CLONE 1377901-F
aagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcttccttatgctccttggtctttctgcagtgctgctaccgcaaccattttcccacatgctcacaagctcctatagcttcctttctttccccatacctctcacaggggtggtctcaggatgggaaaacccaattctcaaccctacgggtccaacagggaatccgagagggaatctacttaatcaccctttggcctccaaaaacggaacccttttaaaggattaccttttggggattttttgggaaaaaatttggggggcaaaaacaacaaaattttggtaaaaaaatttttttcatttccaaaaaaggtttttttctttacacaatgggggaaaaaacccccgttttttttaaaaaaaacaactttgggggggtttgttcccccccccaatttttttttctctaaccggggggtattttctttttttttttttaaagaggggtcccccccctcctccgggggtgggggggcggcgttttttttaaaaaaaaaaatgttctcctcccccccccccc

SEQ ID NO: 15313 - DNA, 700 bp, Zea mays
  misc_feature: Ceres CLONE 1377903-F
  misc_feature: Encodes the peptide sequence at SEQ ID NO. 15314
aaagctggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcagggagctgaaagcagagggtggtgaggctgaaaccaggagattgcgtgcgcgcaggacgcgctgagacacagggcatcatccttatccacggtgacggtggaagccctaggaatgaagggtccctcgttccctggtgaaacgtgtccccgaaaaaaagttgcccggggttgctccctcccggggttgagaggctttcaagagaggtggggttaagggggttccaggcccccgggtgctttggccgaattctttcctctttaaaggccggggggggaaaaaaaaactgggggaaaaaaggggaacaacacccctcttaaaa

SEQ ID NO: 15314 - protein, 62 aa, Zea mays
  misc_feature: Ceres CLONE 1377903-F
MMSRERKKAAALQEKLKILRSITHSHALSNTSIIMDASAYIRELKAEGGEAETRRLRARRTR

SEQ ID NO: 15315 - DNA, 716 bp, Zea mays
  misc_feature: Ceres CLONE 1377910-F
  misc_feature: Translation starting site: 235
  misc_feature: SWISSPROT Homolog: EC 4.2.99.18 DNA-(apurinic or apyrimidinic site) lyase
aagctggagctccccgcggtggcggccgctctagaactagtggatcccccgggctgcaggaattcgcacgagaccattacctagaacatcctaatcgaaaaaggttaaagctgacgccgccgacggaagccgtccgccttggccttcacgaaggattgggcctcctccttgtatctccactccccccttcacagatacgttcctccagctaggggtagcggttcctctgcagcgatggagatcaagcggactaagggggataagaagatcgcgtacgacaagaagctgtgcagcctgctcgatgagtacaccaaggtgctcatcgccctgggcgacaaacgaccgttccaagcagctccaggacttccgacgagaactcaggggagactcggtagagctcatgccgaataacacactcatcaggcgttgcatcaaggtgtacgccgagtagaccggtaaccacacctttgacccgctcatgaacctcctggacggcaacgtacgactcatcttcaccaagggagaccctcatgaggagcgggagtaggactgcaagtacaaggtgtggtctcctgatcgtgtagcccaggtagatccagttgatggtgattgagccccctggcaacattgggcctgatccccccgcatactccttctttcgggtggttggcaccccctccaagattaactagggaaccgggggagattacaccccg

SEQ ID NO: 15316 - DNA, 654 bp, Zea mays
  misc_feature: Ceres CLONE 1377913-F
  misc_feature: Translation starting site: 167
  misc_feature (508)..(508): n is a, c, t, g, unknown, or other
  misc_feature (520)..(520): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcgggtgatatggttcttgcttctgcttactcgcatgagttgccacgatatggtctttgaagttggtctgaccaactatgcagctgcctactgcactgggcttctgttggctcgccgtgtgctcaagacccngtggtttagatnagggatatgagggcaatgtttgaggccactggggagggattttctctggntgagccagctggatgagaggaagggctttttcgggctttccttgggatggtgggcctttattagggactacgcactggggaacg

SEQ ID NO: 15317 - DNA, 771 bp, Zea mays
  misc_feature: Ceres CLONE 1377914-F
  misc_feature: Encodes the peptide sequence at SEQ ID NO. 15318
  misc_feature (417)..(417): n is a, c, t, g, unknown, or other
  misc_feature (420)..(420): n is a, c, t, g, unknown, or other
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (524)..(524): n is a, c, t, g, unknown, or other
tggagctccccgcggtggcggccgctctagaactagtggatcccccgggctgcaggaattcgcacgagaccattacctagaacatcctaatcgaaaaatctcgcaataccaaccttccggatccagtgccgcacgcctcactccccgtccccgacacccatgacacgcaagaggcggaagcacgccgccgccgccgccgccgcctagggttccgatcccttcctcatggattcgctgccgcggaagcgcaagggcgcgcgcgccgcgtgctccctggccggatcccgccacgatgcgcctgccgcccgcaagcgcacctgccgcgagcccaagccgcggcccgagaagaagaagccctcttccgccgatgagggctccgcctccgccgcgggggtttttttataagaggggggccgnctnntnnaatggnnnnngggtggaaaatgggtagtagggtgggtttttcgaagtggaagaggaaaatggtggtaatgtgagggtgatgggagccagggagggttttnccggctaccggcggtgcgttcctcttaacttgttgcccgcattacccccctctatggaacgccgaaacccctgggttggtgcttagggttgctggccaagatgtccctttctccactttcgcgcgtagggatgtccatccctttccctgcatgaaatcttcctgcggctcccttaaccggtcctggccgcggtacttcactcgcgtatgctcaaggggtcgaccccgttcaaactggatcaagtcgg

SEQ ID NO: 15318 - protein, 59 aa, Zea mays
  misc_feature: Ceres CLONE 1377914-F
MDSLPRKRKGARAACSLAGSRHDAPAARKRTCREPKPRPEKKKPSSADEGSASAAGVFL

SEQ ID NO: 15319 - DNA, 712 bp, Zea mays
  misc_feature: Ceres CLONE 1377916-F
  misc_feature: Encodes the peptide sequence at SEQ ID NO. 15320
  misc_feature (400)..(400): n is a, c, t, g, unknown, or other
tggagctccccgcggtggcggccgctctagaactagtggatcccccgggctgcaggaattcgcacgagaccattacctagaacatcctaatcgaaaaacatcgacccaggcatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggaggacctgcggtggtgcaagcaggcgtgcgagtggcagtacggagaggacgccccgcggaagagggaatgcngagagcgagtgccgcgagcggcaccagcaagctgacgcgggcgaggacggggacagcgggggtggacgcctacgtctcccgctccggggaggggggagtggccgggccagggcctggcgccgccacgaggggcaggccgggggagaccccagagtggatgagggggggccgcccgcggggactggccggcgacatggacgaggagtacggtcgcgggagggaagagccgggctagtgcccggagaggggggaccccccccccggggggactggggagaggcagctcttctgggagagggggggggggggggg

SEQ ID NO: 15320 - protein, 141 aa, Zea mays
  misc_feature: Ceres CLONE 1377916-F
  misc_feature (64)..(64): Xaa is any aa, unknown, or other
MGKGSVGASWWAFLLLAGVLLVVAATAGAEGRSGRTGPQGGPAVVQAGVRVAVRRGRPAEEGMXRASAASGTSKLTRARTGTAGVDAYVSRSGEGGVAGPGPGAATRGRPGETPEWMRGGRPRGLAGDMDEEYGRGREEPG

SEQ ID NO: 15321 - DNA, 702 bp, Zea mays
  misc_feature: Ceres CLONE 1377920-F
  misc_feature: Encodes the peptide sequence at SEQ ID NO. 15322
  misc_feature (342)..(342): n is a, c, t, g, unknown, or other
  misc_feature (399)..(399): n is a, c, t, g, unknown, or other
  misc_feature (448)..(448): n is a, c, t, g, unknown, or other
aaagctggagctccccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggagggcggcgcccgatgggtgagcaggtgaagggcatgctccacgacaaggggccgacggcgtcncaggcgctgaacgtggcgacgctgctcccgctgggcgggctgctgctggtgctgtcngggctggcgctgacggcctccggggtggggctgggcgtgggcacgccgntgttcctgatcttcagccccgggctggccccgccgcgctgctcatcggaacggcgtcatggggtcctcacgtcgggcgcgctggggctcggggggctgtcctcactcacggggctcgccaaaaggggggggagggcgttccagcgcaccccggactacgggaggaggccccccccaggatggcggaaggcccggggcaacccgggccaaaaaaccgggagggagggcaaggcattccagggaggggccaagaaa

SEQ ID NO: 15322 - protein, 166 aa, Zea mays
  misc_feature: Ceres CLONE 1377920-F
  misc_feature (44)..(153): Pfam Name: Oleosin Pfam Description: Oleosin
  misc_feature (82)..(82): Xaa is any aa, unknown, or other
MADRDRSGIYGGAHATYGQQQQQGGGRRPMGEQVKGMLHDKGPTASQALNVATLLPLGGLLLVLSGLALTASGVGLGVGTPXFLIFSPGLAPPRCSSERRHGVLTSGALGLGGLSSLTGLAKRGGRAFQRTPDYGRRPPPGWRKARGNPGQKTGREGKAFQGGAKK

SEQ ID NO: 15323 - DNA, 706 bp, Zea mays
  misc_feature: Ceres CLONE 1377923-F
  misc_feature: Encodes the peptide sequence at SEQ ID NO. 15324
  misc_feature (631)..(631): n is a, c, t, g, unknown, or other
tccccgcggtggcggccgctctagaactagtggatcccccgggctgcaggaattcgcacgagaccattacctagaacatcctaatcgaaaaaccgaattcattccacccccgtctcctccgatcggaccaccgggccagcagcggggcggatcgtgacgtcagcagccatggtgaaggcctaccccacggtgaacgaggactacctcaaggcggtcgacaaggccaagcgcaagctccgcggcctcatcgccgagaagaattgcgccccgctcatgctccgcctcgcatggcactccgcgggcaccttcgatgtggccaccaaaaccgggggccccttcggcaccatgaagaaccccgccgagcaggcgcacggagccaacgccggactggaaattgccatcaggctgctagagcccatcaaggagcagttccccatcctatcctacgctgacttctaccagcttgctggagtcgtggcagtcgaggtaaccggcggacctgatgtccccttccaccccgggaggcagggaaagcctgagcctccaccgggagggcgccttcctgatgccaccccaggttctgatcacctccaggaggttttctcgacacaggatgggtttgagcgaccangaatttgttgcgctttcctggtggccacaccctgggaagatgccaccagggacaggtctgggttttgaggggacc

SEQ ID NO: 15324 - protein, 176 aa, Zea mays
  misc_feature: Ceres CLONE 1377923-F
  misc_feature (19)..(175): Pfam Name: peroxidase Pfam Description: Peroxidase
  misc_feature: SWISSPROT Homolog: EC 1.11.1.11 L-ascorbate peroxidase
  misc_feature (155)..(155): Xaa is any aa, unknown, or other
MVKAYPTVNEDYLKAVDKAKRKLRGLIAEKNCAPLMLRLAWHSAGTFDVATKTGGPFGTMKNPAEQAHGANAGLEIAIRLLEPIKEQFPILSYADFYQLAGVVAVEVTGGPDVPFHPGRQGKPEPPPGGRLPDATPGSDHLQEVFSTQDGFERPXICCAFLVATPWEDATRDRSGF

SEQ ID NO: 15325 - DNA, 731 bp, Zea mays
  misc_feature: Ceres CLONE 1377926-F
  misc_feature: Encodes the peptide sequence at SEQ ID NO. 15326
  misc_feature (596)..(596): n is a, c, t, g, unknown, or other
  misc_feature (616)..(616): n is a, c, t, g, unknown, or other
  misc_feature (637)..(637): n is a, c, t, g, unknown, or other
  misc_feature (639)..(639): n is a, c, t, g, unknown, or other
aaagctggagctccccgcggtggcggccgctctagaactagtggatcccccgggctgcaggaattcgcacgagaccattacctagaacttcctaatcgaaaaattccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgactcccgtgtcaggaggaagttcaagggatgcaccttgatgcccaacattggttatggttctgacaagtcgaccaggcactacctccccaacaagttcaagaagtttgtggtccacaacgtttctgagctggagttgctcatgatgcacaacaggacctactgcgctgaaattgctcacaacgtgtccactaagaagcgcaaggagatcgtggagcgtgctgcgcagctcgacatggtggtcacgaacaagcttgctaggctccgcagccaggaggacgagtagtctggtttcttgtcttaacgacgaactggnatgtgcccattcctttctgnaggaactactttggcttgggncntggtaggactgaaaaaccagagtcactcctacctttttggcatcagtagctactaaaatgtggcagattccactatttccctgcatctatct

SEQ ID NO: 15326 - protein, 133 aa, Zea mays
  misc_feature: Ceres CLONE 1377926-F
  misc_feature (14)..(123): Pfam Name: Ribosomal_L32e Pfam Description: Ribosomal protein L32
MAVPLLTKKIVKKRVKQFKRPHLDRYKCLKPSWRRPKGIDSRVRRKFKGCTLMPNIGYGSDKSTRHYLPNKFKKFVVHNVSELELLMMHNRTYCAEIAHNVSTKKRKEIVERAAQLDMVVTNKLARLRSQEDE

SEQ ID NO: 15327 - DNA, 791 bp, Zea mays
  misc_feature: Ceres CLONE 1377929-F
  misc_feature (249)..(249): n is a, c, t, g, unknown, or other
  misc_feature (291)..(291): n is a, c, t, g, unknown, or other
  misc_feature (314)..(314): n is a, c, t, g, unknown, or other
  misc_feature (425)..(425): n is a, c, t, g, unknown, or other
  misc_feature (762)..(762): n is a, c, t, g, unknown, or other
aaagctggagctccccgcggtggcggccgctctagaactagtggatcccccgggctgcaggaattcgcacgagaccattacctagaacatcctaatcgaaaaagtcccaggagcgtggcctcactctcctcgtcgcatcccccctcctcatcttcgcagcgcgggcggcggcaatggcgatggcctccacctacgcgccgggcggaggcgcgcgggcgctcgcgcagggtagatgcagggtccgcggtnccgcgggggctgggcttcctcggcccctccaaggggcgcggnctcccccgccccctcgccctcgncaggcggatgagcagccccgtcgcggtgggcgccaggctgcgatggcgcggcgtcctcctccccccggggggggggggcggccccgccacggggccggggcttcatccagnaaaaggaagggaggcctcctgggttcaacggcttccccccccctgggggaagaaccaggtttttaattcggggcccttggggcccggagaattgggggcaaaaaaccgggggaaaatgtgggaacccttttgggggcgcactatagggggtcccaaaaaagggggggggggggagggggttttccccacgcgcgggggtttttttagagggcccccccccgggaagaaaaatttttttgtttaaaaaccccccccccccacatttattaaaagggggggaagagagagacgcccccccggggggggcccccaaccttgagggggggggggggagaancaccccccccctccccccaccacataatt

SEQ ID NO: 15328 - DNA, 673 bp, Zea mays
  misc_feature: Ceres CLONE 1377932-F
  misc_feature: Encodes the peptide sequence at SEQ ID NO. 15329
  misc_feature (419)..(419): n is a, c, t, g, unknown, or other
  misc_feature (597)..(597): n is a, c, t, g, unknown, or other
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggngtgctagttatggtctctggtctagtgcagaccaaggagtacagccaccaaaggaaatttatccagatgttcttccttgcccctcaggagaaggggtactttgtccctcacgattactttcactccgttgaccaagaacatgtgcagcctgcgccagtgattgctcaggaagactacnaggagcatttggcaccccacacagttggttaggacgctcctggagacgttccccgaggaaagagctcancaatagg

SEQ ID NO: 15329 - protein, 153 aa, Zea mays
  misc_feature: Ceres CLONE 1377932-F
  misc_feature (10)..(126): Pfam Name: NTF2 Pfam Description: Nuclear transport factor 2 (NTF2) domain
  misc_feature (144)..(144): Xaa is any aa, unknown, or other
MASAAAATQVGTYFLRNYYNLLQQTPDVVHQFYSEASTMVRVDDLTGTTAAANNMMDIHSLIMSLNFTQIEIKTANFVNSWGDGVLVMVSGLVQTKEYSHQRKFIQMFFLAPQEKGYFVPHDYFHSVDQEHVQPAPVIAQEDYXEHLAPHTVG

SEQ ID NO: 15330 - DNA, 665 bp, Zea mays
  misc_feature: Ceres CLONE 1377935-F
  misc_feature: Encodes the peptide sequence at SEQ ID NO. 15331
tggagctccccgcggtggcggccgctctagaactagtggatcccccgggctgcaggaattcgcacgagaccattacctagaacatcctaatcgaaaaatcaaccatattattgagaccaacaagcaacatagaaggtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcagcgcttgtttcacaatcggcagccctatctttggtgcagtcatgggtaccaaacatcagggcacagcagctgcagcaactcgtgctacctgggatcaccaagtagctctggcaaactttcttcctattctaggaaaaaaattccttcaattcaccactggcaacttggagcggggtggttaattggggaaacaaaattaccttcccccggttggtttggccaaactcaaaaaaaaaaattttttcttaaaacaattgggcccatgaaaccccctttttttatttaaaaaa

SEQ ID NO: 15331 - protein, 104 aa, Zea mays
  misc_feature: Ceres CLONE 1377935-F
MATKIFSLLMLLALSACVANATIFPQCSQAPIASLLPPYLPSMIASVCENPALQPYRLQQAIAASNIPLSALVSQSAALSLVQSWVPNIRAQQLQQLVLPGITK

SEQ ID NO: 15332 - DNA, 623 bp, Zea mays
  misc_feature: Ceres CLONE 1377936-F
  misc_feature: Encodes the peptide sequence at SEQ ID NO. 15333
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
aaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcgggaaggggggaatcgnnnaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgcagtttctgcagcagcagcaggccgatgcacggggtttgaaattttgggggtggggcc

SEQ ID NO: 15333 - protein, 48 aa, Zea mays
  misc_feature: Ceres CLONE 1377936-F
  misc_feature (41)..(41): Xaa is any aa, unknown, or other
  misc_feature (42)..(42): Xaa is any aa, unknown, or other
MVAVAVDGLIRGADAVPAAEREAVRAAAAEAAAKGGKGGIXXGGGEGV

SEQ ID NO: 15334 - DNA, 642 bp, Zea mays
  misc_feature: Ceres CLONE 1377938-F
  misc_feature: Encodes the peptide sequence at SEQ ID NO. 15335
  misc_feature (272)..(272): n is a, c, t, g, unknown, or other
aaagctggagctccccgcggtggcggccgctctagaactagtggatcccccgggctgcaggaattcgcacgagaccattacctagaacatcctaatcgaaaaaatcctccacagtctctctctagagtagacccaggaaagaggcgatggatatggccattgacacgccatcgccggcgccgccccacgccgccccggggccattcggcagcggccgggcggcagacgcgtgcggcagaggcggtgcgtctggagcacaaatggtgcgcgtngctctcgagtccctccggggcacgttcggtcgaaccaccggctcgcccaggggaaatccgcggcgtcctcttcttccggctccggggcccccgaaaaaaagaaggggggcggggggaaacacctcacctcccctgggtttttgccctccgggctctaaggcaaagagggggggggggcccccagggggggaaattggggtgtccccggtccccccgcccgttttgaacccggtttgggaacgtccccacccccgggcaaattccccgggggggggaaattgtgggttaaaaaagaaaaccgggggaaaaaataggggtttggggggggagacaaaaaaacccccccccaaggctttgggaaatttttttt

SEQ ID NO: 15335 - protein, 165 aa, Zea mays
  misc_feature: Ceres CLONE 1377938-F
MDMAIDTPSPAPPHAAPGPFGSGRAADACGRGGASGAQMVRVALESLRGTFGRTTGSPRGNPRRPLLPAPGPPKKRRGAGGNTSPPLGFCPPGSKAKRGGGPPGGEIGVSPVPPPVLNPVWERPHPRANSPGGGNCGLKKKTGGKNRGLGGETKKPPPKALGNFF

SEQ ID NO: 15336 - DNA, 741 bp, Zea mays
  misc_feature: Ceres CLONE 1377943-F
  misc_feature: Translation starting site: 227
  misc_feature (157)..(157): n is a, c, t, g, unknown, or other
  misc_feature (611)..(611): n is a, c, t, g, unknown, or other
  misc_feature (639)..(639): n is a, c, t, g, unknown, or other
  misc_feature (640)..(640): n is a, c, t, g, unknown, or other
aaagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgactcanagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtggctgtttttgttgaccttgagcccactgtcatcgatgaggtgaggactggcacctaccgccagctcttccatcctgagcagctcatcagtggcaaggaggatgcagccaacaactttcgctcgtggtcactacaccattggcaagggagattgttgacctgtgccttgacccgcatcagaagcttgcagatnattgcactggtctccagggcttctcgtnnctcaacgcttgtggggggaggacggcttcctgggcttggttctctcctcctgaaggcggctgtctggtgattaatggcagaggcccaacgtcggtttcacc

SEQ ID NO: 15337 - DNA, 675 bp, Zea mays
  misc_feature: Ceres CLONE 1377950-F
  misc_feature: Encodes the peptide sequence at SEQ ID NO. 15338
  misc_feature (256)..(256): n is a, c, t, g, unknown, or other
  misc_feature (356)..(356): n is a, c, t, g, unknown, or other
  misc_feature (366)..(366): n is a, c, t, g, unknown, or other
  misc_feature (427)..(427): n is a, c, t, g, unknown, or other
agagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcggnggcggcatgcacggcgaggcgcagcagcagcagaagcagggcgccatgatgacggcgctcaaggccgcgacggccgcgaccttcggcgggtcgatgctgntgctgtccgncctgatcctggcggcagcgtgatcgcgctcacggtggccaccccggtgctgtgatcttcancccgggctggggccggccgcatcgcgctgggctcatggcggccgggttcgtcacctccgggggcctcggggcccttggctgcccgggttcccctggatgaacaggacctgagggggaaacccccccggggcccccaccattgtgcccccccaagggagggtgtggggtcagggcccccgaattaggggggggaaaaagaccccttttaaaagggggggggggtttttgaaaaaaaaaccccctcgcgg

SEQ ID NO: 15338 - protein, 64 aa, Zea mays
  misc_feature: Ceres CLONE 1377950-F
  misc_feature (55)..(55): Xaa is any aa, unknown, or other
  misc_feature (58)..(58): Xaa is any aa, unknown, or other
MADHHRGATGGGGGYGDLQRGGGMHGEAQQQQKQGAMMTALKAATAATFGGSMLXLSXLILAAA

SEQ ID NO: 15339 - DNA, 697 bp, Zea mays
  misc_feature: Ceres CLONE 1377953-F
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (221)..(221): n is a, c, t, g, unknown, or other
  misc_feature (223)..(223): n is a, c, t, g, unknown, or other
  misc_feature (224)..(224): n is a, c, t, g, unknown, or other
  misc_feature (236)..(236): n is a, c, t, g, unknown, or other
  misc_feature (242)..(242): n is a, c, t, g, unknown, or other
  misc_feature (243)..(243): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (267)..(267): n is a, c, t, g, unknown, or other
  misc_feature (268)..(268): n is a, c, t, g, unknown, or other
  misc_feature (285)..(285): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (316)..(316): n is a, c, t, g, unknown, or other
  misc_feature (325)..(325): n is a, c, t, g, unknown, or other
  misc_feature (326)..(326): n is a, c, t, g, unknown, or other
  misc_feature (358)..(358): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (411)..(411): n is a, c, t, g, unknown, or other
  misc_feature (423)..(423): n is a, c, t, g, unknown, or other
  misc_feature (697)..(697): n is a, c, t, g, unknown, or other
aaagctggagctccccgcggtggcggccgcttcagaactagtggatcccccgggctgcaggaattcgcacgagaaccattacctaaaaacattcctaatcgaaaaatcacgcaatcgagaaaaaacacaaaccgaaaaacctcctctacagtcccatctaggcgccccttcctcggctccgatccagtttcgccggcggccatgtcgcagccggnnnnggngnncgaacggtgggncccggnncccggggnnnnnnngggggggggnncccggggcccaaaaagngnnnccccccgggcccagggggtttcccggnccggggggnncccccccccccgggccggggggggggccggcnccccaggggggggccgggnnnnccccccttggggggcgccaaggaaaaagggnccaatttccgcnaagggggcaattccggttgggcgggggaaatttggggccggggggtgggtttccttgggggtaaactttttttggcgggttccccccaaaaggtttttccctttttccggggggggcccccaaaaaaggggggggccccccccaccccccgcggggggggggaaaacccccccccccgggggggagaaattgggcctttccccaatttgggggttccccccaaaaaaaccccccttttcccttttttttcccccccaaagaaaaaaaaaggggn

SEQ ID NO: 15340 - DNA, 708 bp, Zea mays
  misc_feature: Ceres CLONE 1377956-F
  misc_feature: Translation starting site: 328
  misc_feature (351)..(351): n is a, c, t, g, unknown, or other
  misc_feature (372)..(372): n is a, c, t, g, unknown, or other
  misc_feature (468)..(468): n is a, c, t, g, unknown, or other
  misc_feature (572)..(572): n is a, c, t, g, unknown, or other
tggagctccccgcggtggcggccgctctagaactagtggatcccccgggctgcaggaattcgcacgagaccattacctagaacatcctaatcgaaaaagagactcaccagtcaccaccccaggccagccgccacgtttagccgggctaaacaaacacgggcgcacaatcggaactcgctgcactgcttggaatccaacgagccaatcattcaaatcctccccggaaccgcgttgagcagggcacggtcgattggatctagggtgagggtccgtcgccgaagaaactcgcaggcggtcacgaggaggcggcgggggagggcgggggagatggcctcggaggagatgacggcnacggaggtggctgcgctgctnggacttgaagccgcaccccggagggcggcttctacaccgagaccttccgcgacggctccatcacgctcaccacgtcccagctcccgccccactacnaggtaaaccgtgctgttagcaccgcaatctatttcctacttcccggcagggagtggtttcccgtctccaccgcattccctgtgctgaaacctggcacttctacnagggagagcctctcacggtcttcgagcttcacgacgacggtcacattggaccttactgtcattggcccacacctttgaggcaggcagcgcccccagtataccgtgcacgaaaagggggggggttggggtcgttccc

SEQ ID NO: 15341 - DNA, 751 bp, Zea mays
  misc_feature: Ceres CLONE 1377957-F
  misc_feature: Encodes the peptide sequence at SEQ ID NO. 15342
  misc_feature (538)..(538): n is a, c, t, g, unknown, or other
  misc_feature (551)..(551): n is a, c, t, g, unknown, or other
aagctggagctccccgcggtggcggccgctctagaactagtggatcccccgggctgcaggaattcgcacgagaccattacctagaacatcctaatcgaaaaattgcccatcacattccatcgaccagtctcaattcaaggagctgaggacgacctgtccgtccggagctgatcgagaaacggaggggcggttccagtttcagtccagctagctagctagctagaagatcccattcgctgacagatgggttcctacatccaaggagatgatgaggtccctgtgtacgagtcgggcgccgaggtgcttgcgaaggtgcaagagaaatgggcggcggcggcggcatcgcggcctcctccctacccggccatgtactcgagcgtgttcggcggcatcatcctggacccggccatgatggttctccccatcgacgaccacatggtccaccggggccacggcgtgttcgacacggccatgatcctggacggcgccctgtacgagctggacgcgcacctggaccgcttcctccggtcggccgcgncggcgcgcgtggncacggccccgttcccgcgcgaggcgctgcggcgcatcttgatccagatgaccgccgcctcgggctgccgcatgggctccatcggctactggctcagctccggggccggcgacttcctgctgtcctccaggggctgcccgtcgccgcgttctacggggtggtgatcgcgtcgaagtacaacatgggcggggtgaccggcac

SEQ ID NO: 15342 - protein, 156 aa, Zea mays
  misc_feature: Ceres CLONE 1377957-F
  misc_feature (99)..(99): Xaa is any aa, unknown, or other
  misc_feature (103)..(103): Xaa is any aa, unknown, or other
MGSYIQGDDEVPVYESGAEVLAKVQEKWAAAAASRPPPYPAMYSSVFGGIILDPAMMVLPIDDHMVHRGHGVFDTAMILDGALYELDAHLDRFLRSAAXARVXTAPFPREALRRILIQMTAASGCRMGSIGYWLSSGAGDFLLSSRGCPSPRSTGW

SEQ ID NO: 15343 - DNA, 740 bp, Zea mays
  misc_feature: Ceres CLONE 1377958-F
  misc_feature: Encodes the peptide sequence at SEQ ID NO. 15344
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaactcagctgctggcccgctgcctgcagccattgcccgctcctcgaggtcaaatggcccctgcccccgctctcaccgccacatccgtcctgaagcgttcccacctacccggcgtccactcgttggcctgtcgccggcagccgggggcggaccgcgtctcggtgctttctccagcgatcccgccgccccgcgtatcatggcagcaaggatctggagtgtctgctaagaggctcctctgggcgagtgcgagtggttccttcgagaaagataacatcggggaggacgcggtgttgccttctcagatagcggtggagaataaagtagattttttgaagattttaaagagtgcccactccattattcccccatatagggtgggggagtaccatttctcgccctggngtacccgccttcgtttacatgggtcactaccagggtattatgcaccagcttttggggttcttgatgtttgcctggtgggggaaacccaaggggccaaggatttttatcgaggcaataaagggggcaaaaggctattgctgggggcttaaatcggaaagtttggcctcaagccttttggttgggattcccttttggaacccttgggggggtgggagttttaacaccccccatgtggctgt

SEQ ID NO: 15344 - protein, 165 aa, Zea mays
  misc_feature: Ceres CLONE 1377958-F
  misc_feature (117)..(117): Xaa is any aa, unknown, or other
MAPAPALTATSVLKRSHLPGVHSLACRRQPGADRVSVLSPAIPPPRVSWQQGSGVSAKRLLWASASGSFEKDNIGEDAVLPSQIAVENKVDFLKILKSAHSIIPPYRVGEYHFSPWXTRLRLHGSLPGYYAPAFGVLDVCLVGETQGAKDFYRGNKGGKRLLLGA

SEQ ID NO: 15345 - DNA, 746 bp, Zea mays
  misc_feature: Ceres CLONE 1377976-F
  misc_feature: Translation starting site: 198
aaagctggagctccccgcggtggcggccgctctagaactagtggatcccccgggctgcaggaattcgcacgagaccattacctagaacatcctaatcgaaaaatctatcgcactcgtagtcgtagctcaagcatcatcggcaggagctctgggcagcgtgcgcacgaggggtacctagctcgctctgctagcctaccatggctgatcaccaccgggatgcgacgggaggtggcggcggctacggcgacctccagcgcggcggcggcatgcactgtgaggcgcagcagcagcagaagcagggcgccatgatgacggcgctcaaggccgcgacgagcgcgaccttcggcgggtcgatgctgtcgctgtccgggctgatcctggccggcaccgtgatcgcgctcacggtggccactcccgtgctggtgatcttcagccccggtgctggtgccggacgccatcgcgctggcgctcatggcggacgggctcgtcacccccgttggtctcggtgtcgctgcgctgtccgtgatctcctggatgtatagtacctgatggtcaagatcccgcggggcgcgaccagctggaacaccccagggtaggctggcgcccaagcccccgcgacatcaagggttgatgacaggaccccaatcaaccagcggcaggggtcttaagataagaaacacactcgaggggaacgggcggtgggatctccttgaaccacctgccggggcggtggaaaaagggccctt

SEQ ID NO: 15346 - DNA, 677 bp, Zea mays
  misc_feature: Ceres CLONE 1377978-F
  misc_feature: Encodes the peptide sequence at SEQ ID NO. 15347
  misc_feature (285)..(285): n is a, c, t, g, unknown, or other
  misc_feature (371)..(371): n is a, c, t, g, unknown, or other
  misc_feature (392)..(392): n is a, c, t, g, unknown, or other
  misc_feature (492)..(492): n is a, c, t, g, unknown, or other
  misc_feature (506)..(506): n is a, c, t, g, unknown, or other
  misc_feature (507)..(507): n is a, c, t, g, unknown, or other
  misc_feature (534)..(534): n is a, c, t, g, unknown, or other
  misc_feature (576)..(576): n is a, c, t, g, unknown, or other
  misc_feature (587)..(587): n is a, c, t, g, unknown, or other
  misc_feature (628)..(628): n is a, c, t, g, unknown, or other
caaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggccggggcggaggacggagtggtcgaacgggaccgcaaggaggacctgcggtggtgcaagcaggcgtgcgagtggcantacggaaaggacaccccgcgnaagaggtaatgcgagagcgagtgccgcgagcggcaccagcaagctgacgcgggcgaggacggcgacagcggcgtggacgcctacgtctcccgctccgggnaggggcgagtgccnngcgcagtgcctgcgcccgcacgagggncagccgtgggagacctaggaatgcatgaggcggtgccgccgncgcggactggncgtctaatggagcaagagtacggtcgcggcagcgagagcgncggcaagtgccggggagagtgcgagcgccaccaccgcgggactgtgggg

SEQ ID NO: 15347 - protein, 61 aa, Zea mays
  misc_feature: Ceres CLONE 1377978-F
  misc_feature (24)..(24): Xaa is any aa, unknown, or other
  misc_feature (52)..(52): Xaa is any aa, unknown, or other
MGKGSVGASWWAFLLLAGVLLVVXATAGAEDGVVERDRKEDLRWCKQACEWXYGKDTPRKR

SEQ ID NO: 15348 - DNA, 667 bp, Zea mays
  misc_feature: Ceres CLONE 1377981-F
  misc_feature: Encodes the peptide sequence at SEQ ID NO. 15349
  misc_feature (527)..(527): n is a, c, t, g, unknown, or other
  misc_feature (528)..(528): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaaacaacaacgagttaacgaaagccttttatccaagctcaggaaagctcacagtttcgttggatccaatcttagttttatccaagctcagcaatggcttctcgtcagcagcatcctactagctaccacgccggcgagacaaaggcccgtgccgaggagaagacgggtcaagtgatgggggcggcgcaggagaaagggagggaggccaagcacaaggcgtccgacgccgccgaccgcgccatggggatgggccacgacgcctgggaggcgaccagggagaaggcgcgcgccgccgcggaccgaaccatggggatgggccacgacgccggggagacggccaaggacagggcgtaccgggccaaggacgcggcctccggtgccgctgtccgcgccagggacactgcgtccgacgcggtcggcgctgccgnngaccgcgcccacgacggcgcgcagcagaccgggagctacgtcgcgcagacggccgaggccgccaggcagaaagcggccggcgccgcgctgtacgacaaggacaccgtggctgaccggcatggacaagaccggcgctctn

SEQ ID NO: 15349 - protein, 158 aa, Zea mays
  misc_feature: Ceres CLONE 1377981-F
  misc_feature (112)..(112): Xaa is any aa, unknown, or other
MASRQQHPTSYHAGETKARAEEKTGQVMGAAQEKGREAKHKASDAADRAMGMGHDAWEATREKARAAADRTMGMGHDAGETAKDRAYRAKDAASGAAVRARDTASDAVGAAXDRAHDGAQQTGSYVAQTAEAARQKAAGAALYDKDTVADRHGQDRRS

SEQ ID NO: 15350 - DNA, 748 bp, Zea mays
  misc_feature: Ceres CLONE 1377982-F
  misc_feature: Encodes the peptide sequence at SEQ ID NO. 15351
  misc_feature (368)..(368): n is a, c, t, g, unknown, or other
  misc_feature (395)..(395): n is a, c, t, g, unknown, or other
  misc_feature (564)..(564): n is a, c, t, g, unknown, or other
  misc_feature (572)..(572): n is a, c, t, g, unknown, or other
  misc_feature (660)..(660): n is a, c, t, g, unknown, or other
  misc_feature (662)..(662): n is a, c, t, g, unknown, or other
  misc_feature (673)..(673): n is a, c, t, g, unknown, or other
  misc_feature (674)..(674): n is a, c, t, g, unknown, or other
  misc_feature (705)..(705): n is a, c, t, g, unknown, or other
aagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacngaaaaaaaggacgacgcggtggtgcanccgcagaccttcccgcccttcgaccgcctcggcggcggcgcgtccccggcgttcggcggcctccccggcggcagcattcctggcagcagcattcccgggttcagcatgcccggcagcggcagcagcctacccgggttcagcttggccggcagcggcagcatgcccctcntcggcggncgctccccgggctcagcgggcttcggcgggatggcccgggtccccagcggccgggttcggtccccgagcacgccacaagcctggacgncnacaagcgtggnnaaggagaggggtgctactgttactgggaagnacgtcgtcgtcttcatggaatgggggggggttcgggggttccc

SEQ ID NO: 15351 - protein, 159 aa, Zea mays
  misc_feature: Ceres CLONE 1377982-F
  misc_feature (42)..(42): Xaa is any aa, unknown, or other
  misc_feature (99)..(99): Xaa is any aa, unknown, or other
  misc_feature (131)..(131): Xaa is any aa, unknown, or other
  misc_feature (135)..(135): Xaa is any aa, unknown, or other
  misc_feature (146)..(146): Xaa is any aa, unknown, or other
MARSSKMMVAAALLALALAVSIAEARNIKTTTTEKKDDAVVXPQTFPPFDRLGGGASPAFGGLPGGSIPGSSIPGFSMPGSGSSLPGFSLAGSGSMPLXGGRSPGSAGFGGMARVPSGRVRSPSTPQAWTXTSVXKERGATVTGKXVVVFMEWGGVRGF

SEQ ID NO: 15352 - DNA, 624 bp, Zea mays
  misc_feature: Ceres CLONE 1377986-F
  misc_feature: Translation starting site: 102
  misc_feature (369)..(369): n is a, c, t, g, unknown, or other
  misc_feature (520)..(520): n is a, c, t, g, unknown, or other
aagctggagctccccgcggtggcggccgctctagaactagtggatcccccgggctgcaggaattcgcacgagaccattacctagaacatcctaatcgaaaaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtgnattatctgaatggaaaattgcaagagtgcttccttcaaaggataaggcatgctatgaagccggatgaggcgtttggtctaattttttcgtgggacatggtattgctgatacagactcgctaagggtgaatgctttgagacacttgctttgnagggaggtaggatatcccaagtggtgctcatgtccgaagagcattattcatggtgctgctgaccaggttcttagaaaggttttgtactgggcaaagaagaagaa

SEQ ID NO: 15353 - DNA, 639 bp, Zea mays
  misc_feature: Ceres CLONE 1377988-F
aaagctggagctccccgcggtggcggccgctctagaactagtggatcccccgggctgcaggaattcgcacgagaccattacctagaacatcctaatcggaaactccctctcctctcgtccatcacgacctcccttcccctgcttcccggatctccctcccccccatccctgcacgccccttttcatgcacgaggagggaccgtggagaccatcatcagacacctccatccgcgagcatctcggggtggtgctcctcctcctcctcccctgttcccgagaagtacgctctcctgatcctcctcctcctgttgctggtgccaagaccgagaggccgaatggaaggtagacgctcatggagctcgccgtggacgttatgcaaacaacggcaacttcataaacagaacatgacgtatagttatgattggcagctctcctggatacgagacgacggagactctatgagctaggattacgacgtgaccacaaaaatcgaatgctagggacattacgacatggagattcaacttacgggctgttaagcgcatctttcccaattcatcaaggcccaattctctccctaaacccgaggtattggtgaacttaaaccggaaaaattataatttggaggctaaaggccca

SEQ ID NO: 15354 - DNA, 545 bp, Zea mays
  misc_feature: Ceres CLONE 1377991-F
  misc_feature (184)..(184): n is a, c, t, g, unknown, or other
  misc_feature (312)..(312): n is a, c, t, g, unknown, or other
  misc_feature (545)..(545): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcttccnatgctccttggtctttctgcaagtgttgctaccgcgaccattttccccaatgctcacaagctcctatagcttcccttcttccccatacctatcaccagcggtgtcttcagtatatgaaaacccaattngtcaaccctacaggatccacaggcaatcgcacgagcatcttaccattatcacccttgtccctccacaccgtcagcctattacaggagtactttggggcatttgggggaacaaaacttaggggacacaactaccaaaattggggtaacaaaacttggtggaatctttcgaaaacattagttttctccctttaaccaagggggggaattgaaccctgggctgttttttcaaaaan

SEQ ID NO: 15355 - DNA, 677 bp, Zea mays
  misc_feature: Ceres CLONE 1377992-F
  misc_feature: Encodes the peptide sequence at SEQ ID NO. 15356
  misc_feature (677)..(677): n is a, c, t, g, unknown, or other
gctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccggccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccggaggggtcgcggtcccccccgtgtctagccccgttgggtcccccgccgcggggaaggatgccaaacaggctcctagggatttccttcaagtcatggattttggcagggatacaatactgaagattcttaatcaagccctcgaggttaaggcattggataaaggcttggagacaagagctttccaaccggttcaaggggaaaaacaatgggccatggatttttttgccaagccaatcaagggagggactcggggtttccttttgaagaacggaattcctttttaactgggggggggcatggcaattttaatttggggtcccaaaagaaan

SEQ ID NO: 15356 - protein, 63 aa, Zea mays
  misc_feature: Ceres CLONE 1377992-F
  misc_feature: SWISSPROT Homolog: EC 2.1.3.3 Ornithine carbamoyltransferase
MDFGRDTILKILNQALEVKALDKGLETRAFQPVQGEKQWAMDFFAKPIKGGTRGFLLKNGIPF

SEQ ID NO: 15357 - DNA, 670 bp, Zea mays
  misc_feature: Ceres CLONE 1377994-F
  misc_feature: Encodes the peptide sequence at SEQ ID NO. 15358
  misc_feature (348)..(348): n is a, c, t, g, unknown, or other
  misc_feature (375)..(375): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (511)..(511): n is a, c, t, g, unknown, or other
aagctgggctccccgcggtggcggccgctctagaactagtggatcccccgggctgcaggaattcgcacgagaccattacctagaacatcctaatcgaaaaaaatagcaaatttctctagggggagcaggggctgagagagggctgcggagcaaggaatcaaggacgagccgccgagaggactagggtttagccatggcggccgaggaccagactccttgtaccaagctccgccccggcaaggcaaagacgcggaagaagacgaagagggacaagtggggacagcctatctccgccgccgccgccgatgaggagccgtcggtggagtaggagcaagagcacccggcggnggtatgtgaggcggcagtacaggtgtnagaacggagaggaggaaaaagcgactgctgcggcgttacgctatgcaccctggaaggtgtagnnnagtggcttggcctacccgaccaccggagggggacatcgggaagctgttcagagtctacgggcccatccagncagatgagttttcccggtttcccgaacccgggaaatttccgggggcttgccttccctttggtttggggggccctaaccccttaggaaccccacttcctttctttggaaaaaaaaggcaaaaaagccccttgggcgtgggggggaccaaaattgggggca

SEQ ID NO: 15358 - protein, 44 aa, Zea mays
  misc_feature: Ceres CLONE 1377994-F
MAAEDQTPCTKLRPGKAKTRKKTKRDKWGQPISAAAADEEPSVE

SEQ ID NO: 15359 - DNA, 617 bp, Zea mays
  misc_feature: Ceres CLONE 1378003-F
  misc_feature: Encodes the peptide sequence at SEQ ID NO. 15360
cagagctggagctccccgcggtggcggccgctctagaactagtggatcccccgggctgcaggaattcgcacgagaccattacctagaacatcctaatcaaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtttctaggactgattgcatgctcagtaccactgctacattcccaaaatcagctgctcctgggctcttaagtttaagcgcaatgattgtggtgaaaaagcatatccggaggggggtggcccgcagggctttccattggactcccaaggtaaaagggcttccatggcttggaatgctaaggaaaaagcgattagagggggaattggcaaagccctttgccggggctgggggtggaaaatctttgggggaaaagggggggcgggcccttaaaaatttttaaaaaaactttgggggggggaaaaattttttaaatcccccaaaattggccaaaggagttctttt

SEQ ID NO: 15360 - protein, 120 aa, Zea mays
  misc_feature: Ceres CLONE 1378003-F
MTASAAAGVQMVAARPCISASPGILTARVSRTDCMLSTTATFPKSAAPGLLSLSAMIVVKKHIRRGVARRAFHWTPKVKGLPWLGMLRKKRLEGELAKPFAGAGGGKSLGEKGGRALKNF

SEQ ID NO: 15361 - DNA, 637 bp, Zea mays
  misc_feature: Ceres CLONE 1378005-F
  misc_feature: Encodes the peptide sequence at SEQ ID NO. 15362
  misc_feature (359)..(359): n is a, c, t, g, unknown, or other
aaagctggagctccccgcggtggcggccgctctagaactagtggatcccccgggctgcaggaattcgcacgagaccattacctagaacatcctaatcgaaaaaggcatgctgaactaggcgaggtggactgggcgagcgagcgagatggagtggacgacggtggagacgagggacggcgcgaagctgagcgtgcggctgttcaagccccccgcgtccggaacgtggttgcagccgtagccgagggaggatgtggcgctggtgctggtgcatccctacaccatcctcggcggcgtgcagggcctgctgcgtgggatggcgaagggcgtcgcgcgacgtggttacaccgccgtcaccttcnacatgcgcggctcgacacggtccacgtgggcggacgtcgctcacgtcctccaccgaatgtcgggacgtcgtcgtcgtctgccgatgggtcgcagagaacatcaggccgcgcgacatcctcctcgtcggatcctcagctgacgtaccaattgcccgcatctgcagtgataaagtgaatgaagtgattcgttacgttagcatcgggtaccccctttggtctgatggcctcagtcctattcggcaggcataatgatgctatactcaagtctgaataaccaa

SEQ ID NO: 15362 - protein, 119 aa, Zea mays
  misc_feature: Ceres CLONE 1378005-F
MWRWCWCIPTPSSAACRACCVGWRRASRDVVTPPSPSTCAARHGPRGRTSLTSSTECRDVVVVCRWVAENIRPRDILLVGSSADVPIARICSDKVNEVIRYVSIGYPLWSDGLSPIRQA

SEQ ID NO: 15363 - DNA, 673 bp, Zea mays
  misc_feature: Ceres CLONE 1378009-F
  misc_feature: Encodes the peptide sequence at SEQ ID NO. 15364
  misc_feature (346)..(346): n is a, c, t, g, unknown, or other
  misc_feature (404)..(404): n is a, c, t, g, unknown, or other
  misc_feature (460)..(460): n is a, c, t, g, unknown, or other
  misc_feature (490)..(490): n is a, c, t, g, unknown, or other
  misc_feature (504)..(504): n is a, c, t, g, unknown, or other
  misc_feature (505)..(505): n is a, c, t, g, unknown, or other
  misc_feature (561)..(561): n is a, c, t, g, unknown, or other
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtgntgcaagcaggcgtgcgagtggcagtacggaaaggacaccccgcggaagagggaatgcnagagcgagtgccgcgagcggcaccagcaagctgacgcgggcgaggacggcgacagncgcgtggacgcctacgtctcccgctccggnaggggcgagtgccnngcgcagtgcctgcgccgccacgagggccagccgtgggagaccccagagtgcatgangcggtgccgccgccgcggactggccgtcgacatggagcaagagtacggtcgncgcagcgagagcgcgggcagtgcccgggagagtgcgagcgccacaccgcggggactggtg

SEQ ID NO: 15364 - protein, 153 aa, Zea mays
  misc_feature: Ceres CLONE 1378009-F
  misc_feature (44)..(44): Xaa is any aa, unknown, or other
  misc_feature (64)..(64): Xaa is any aa, unknown, or other
  misc_feature (82)..(82): Xaa is any aa, unknown, or other
  misc_feature (97)..(97): Xaa is any aa, unknown, or other
  misc_feature (116)..(116): Xaa is any aa, unknown, or other
MGKGSVGASWWAFLLLAGVLLVVAATAGAEDGVVERDRKEDLRXCKQACEWQYGKDTPRKRECXSECRERHQQADAGEDGDXRVDAYVSRSGRGECXAQCLRRHEGQPWETPECMXRCRRRGLAVDMEQEYGRRSESAGSARESASATPRGLV

SEQ ID NO: 15365 - DNA, 652 bp, Zea mays
  misc_feature: Ceres CLONE 1378011-F
  misc_feature: Encodes the peptide sequence at SEQ ID NO. 15366
  misc_feature (414)..(414): n is a, c, t, g, unknown, or other
caaagctggagctccccgcggtggcggccgctctagaactagtggatcccccgggctgcaggaattcgcacgagaccattacctagaacatcctaatcgaaaacatccgctccccgccttccgcttccctaccccccgcatcacctaccaacgccgacaccatggggggccttcgcgaaggaggagcaccagttcctagcgagctcggcctcgcgcagcgcacccaggcgcgttcgcatgcggtgcgggggcggctcaggtccaccgtccctcccgagcccgaccaaaatcaggcatcgcagaggtcgtggaggcgccgtgcacgactaaaggaggcatgcgcgcctgcttcgatgccgcaagacatggatggcgatcctgctccaagcgagggagagatcgtaggcaaatcgntgatgcactgagagcaaagctccatcaccttggcaggcttgtgtcacttgaaatggggaaaatcttcctggaaggatcgggggaggttcagaaaccccgaactgggggaatatgctgggggggtaaggccccaactaaaggattcctttaccctttggaaagccaacccttatgggggggggggggggacccccctggggtggggggggttaaacgggattaattcccctgggggggg

SEQ ID NO: 15366 - protein, 99 aa, Zea mays
  misc_feature: Ceres CLONE 1378011-F
  misc_feature: SWISSPROT Homolog: EC 1.2.1.3 Aldehyde dehydrogenase (NAD(+))
  misc_feature (26)..(26): Xaa is any aa, unknown, or other
MRACFDAARHGWRSCSKRGRDRRQIXDALRAKLHHLGRLVSLEMGKIFLEGSGEVQKPRTGGICWGGKAPTKGFLYPLESQPLWGGGGDPPGVGGVKRD

SEQ ID NO: 15367 - DNA, 697 bp, Zea mays
  misc_feature: Ceres CLONE 1378015-F
  misc_feature: Encodes the peptide sequence at SEQ ID NO. 15368
  misc_feature (404)..(404): n is a, c, t, g, unknown, or other
  misc_feature (487)..(487): n is a, c, t, g, unknown, or other
  misc_feature (489)..(489): n is a, c, t, g, unknown, or other
  misc_feature (495)..(495): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtggcgcgagcggcccagcaagctgacgcgggcgaggacggcgacagcggcgtggacgcctacgtctcccgctccngnaagggncgagtgccccgcccagtgcctgcccccgcacaaggggcagccggggggaaacccaagagtgctttaggggggggcccccccccccgggactgcccgtcaaaatggaacaaaaataaccgccccggnaacaaaagcgcgggcaaagtgccggaaaaagggcgaagccccccccccgggaacattggggaaaagagccctctcg

SEQ ID NO: 15368 - protein, 115 aa, Zea mays
  misc_feature: Ceres CLONE 1378015-F
  misc_feature (64)..(64): Xaa is any aa, unknown, or other
  misc_feature (92)..(92): Xaa is any aa, unknown, or other
  misc_feature (94)..(94): Xaa is any aa, unknown, or other
MGKGSVGASWWAFLLLAGVLLVVAATAGAEDGVVERDRKEDLRWCKQACEWQYGKDTPRKRECXSEWRERPSKLTRARTATAAWTPTSPAPXRXECPAQCLPPHKGQPGGNPRVL

SEQ ID NO: 15369 - DNA, 656 bp, Zea mays
  misc_feature: Ceres CLONE 1378018-F
  misc_feature: Encodes the peptide sequence at SEQ ID NO. 15370
  misc_feature (527)..(527): n is a, c, t, g, unknown, or other
tggagctccccgcggtggcggccgctctagaactagtggatcccccgggctgcaggaattcgcacgagaccattacctagaacatcctaatcgaaaatcatcgatcgtcaatgcaagtgttgtccattcgcattggtctgaatactgtagctactagagcgagtgccactgtgccgcagatgcctgctcgccattactgcaagctgtgttcaatcaaagattaattaggctccctctacatctgatccagctaagtagcacgcctgcactactcaacggcgtgacaacaatcccgacacacatagcagagagcgtatctagttcagctcgtgcgacgaagaatggccggaattgtgacgaacatgctgtctccgctgctggtgctcagcctcatcatgaacatcatcgtcatcggcttcgcgagctggtacctgaatcacttcatcaccggttagacctactaacccagcgtgggcagttaccgaacgacgatctatttcctgatgtccccatcctggcctatgtgngggcacctggttcaatcttgcgggagtgcacacttgcgcgcctgggcccggaaccctggccaccaagcctaaaacttgttcttcccttgggaatgaaagctttgcctccgtttgccggaaagaaaaccc

SEQ ID NO: 15370 - protein, 37 aa, Zea mays
  misc_feature: Ceres CLONE 1378018-F
MAGIVTNMLSPLLVLSLIMNIIVIGFASWYLNHFITG

SEQ ID NO: 15371 - DNA, 658 bp, Zea mays
  misc_feature: Ceres CLONE 1378020-F
aaagctggagctccccgcggtggcggccgctctagaactagtggatcccccgggctgcaggaattcgcacgagaccattacctagaacatcctaatcgaaaaatatctcctcaaggcacgttcaccacagtcctctctttccccggcaccaccaccacccagggtaaccggactggaccgagtgttgaacaacgctgaggctgaggcagatagagcgacggcaggaatgatgagccgtgaaatgtgcacctgtcgctggacccggagtctctggacgtgacgtgcgacgacccgaccgtcgtctagatcccttagaagatcctcatcggcgctgagagattacttctgcctcatccttgccgagatcgacgagaacgaggagagacgcgacaacgacgatcatcgtgcggagatccaggatgtacggatgtacgatcgagacgaagctctatgtgatctggtagccccaactttaacctcgtcgattcaaggctcgtccctgacgctgcttccggggattaccaaggggttttaccttcagaaggaagggggaatccccaagggactttgcctgaattttaagactggccagggaaagggaaaaaccccgccaaaaaccctttttctccgtttaacaagccggtccagaaaattggaa

SEQ ID NO: 15372 - DNA, 654 bp, Zea mays
  misc_feature: Ceres CLONE 1378022-F
  misc_feature: Translation starting site: 144
gctctagaactagtggatcccccgggctgcaggaattcgcacgagaccattacctagaacatcctaatcgaaaacacacccgcatctgcttcattccacccgccccgcgaggagcttctagaaggggagaccccggcggagccatggcggaggaaaaggagtcgacgtcgatcccgctcagccaggcggaggaggctgtcgaccccgaggacccggccaagtcgccgccgcgacccagctcgcccaccacctccacacgcaagtcccctatatgcaaaaattggaatcgacatatttggtcttggttttttgacttctctggcattcatatttctggatgcaatatttgtttcttcatgggttggatcaaccatcttctgggtgggcgagtggtttataaagaagtccatttgtaagacgtatatattcagcatcaaagcaagtcagcactgcaatttcaccagatcaaaatacgactgctttcaaagaagatgcaataattcctcatccacgagttggggaatatgcatttggattcataacatcaagcggggtgcttcagactgacaaaggagatgaagaactgtgtagtgggtatgtggcaacaaatcatctatacatcgggggaatatttctgggggaaatctgaaggaa

SEQ ID NO: 15373 - DNA, 666 bp, Zea mays
  misc_feature: Ceres CLONE 1378028-F
  misc_feature: Translation starting site: 174
  misc_feature: Pfam Name: Peptidase_M24 Pfam Description: metallopeptidase family M24
  misc_feature (377)..(377): n is a, c, t, g, unknown, or other
gctctagaactagtggatcccccgggctgcaggaattcgcacgagaccattacctagaacatcctaatcgaaaaaaacctaaacctctcacccggcgccgccgccgccgccgccaccgccgccgccccgaggccccatcccagcgaaaccgacttccgcctcggattgaagcaatgtcgtcggacgacgaggtcagggaggagaaggagctcgacctctcctccaacgatgtcgtcaccaagtacaagactgccgccgaaatcctgaacaacgctctgaagctggttgtgtctgagtgcaagccaaaagcaaagattgttgacctttgtgagaagggtgactctttcatagggagagggggactgggaatgtctacnagaatgcaaagaggaagattggaaggggcattgctttccccacctgtgtttcggtgaacaacacagtctgccacttctccccgcttaccacagatgatgcagttctgggaagaaaatgacatggttaaaattggcatggggtgtcatattgatggctttatggctgggggggcacatacacatgtaattgcaaatgggccctgtcacagggagaacagcttgatgggtctggctgctggcaacacagccaacaaaagttgccatggaggcttgtcagacctgggaagaa

SEQ ID NO: 15374 - DNA, 680 bp, Zea mays
  misc_feature: Ceres CLONE 1378029-F
  misc_feature: Translation starting site: 218
  misc_feature: SWISSPROT Homolog: EC 1.6.5.3 NADH dehydrogenase (ubiquinone)
aaagctggagctccccgcggtggcggccgctctagaactagtggatcccccgggctgcaggaattcgcacgagaccattacctagaacatcctagtcgaaaaactcccgcaggccgcagcccagcaccggccgctctacgcctccacgccggcacgtcctcgtttctgtccgaggtcatcgcctccgcaacttcgtggccggtgaggtcgcaccaccatggcgtcgctcctagcccggcaggcagcgcaggcgctccgcgcgaggcaaacggcgcagctcgggccggccgcgtcggcgatgcaagggcacctccgtacctacatgaacggcggggatccccaagcgttcaaagaggatgaggagaaaccacagcttgcaggagatgtcgcaaaagattggaatgctgtgtttgaaaggagcatcaatacattgtttttgactggaatggcccggggcttgatgctaactctcaagtacttctttgatagaaatgtcacaattaactatcggtttgagaagggtcctctgagcccccgctttccgggggaggatgctctcagacggtatgaatctggggagagcgctgcattgcttgtaaactatgcgaagctttttgcccagcggaggcaattaccattgaggctgagaaagtgaagatggcatccccgaccacaaaatt

SEQ ID NO: 15375 - DNA, 693 bp, Zea mays
  misc_feature: Ceres CLONE 1378030-F
  misc_feature: Encodes the peptide sequence at SEQ ID NO. 15376
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgctcgcccgatgggtgagcaggtgaagggcatgctccacgacaaggggccgacggcgtctcaagcgctgacggtggcgacgctgttcccgctgggcgggctgctgctggtgctgtcggggctggcgctgacggcctccgtggtgaggctgggcggggccacgccggtgttcctgatcttcagccccgtggtgggccccgccgggctggtcatcgggacggccggcatggggttcctcccgtcgggcgggctgggggtcggggggcctgtcctcgctcacgtggcctccccaaacgggggggggagggggtcccaagcgaacccccggattaactgggaggagggggcaccccaagaatgggggaaaggccgcggtcccaccccgggccacaaaaaaccccgcaaggaggg

SEQ ID NO: 15376 - protein, 162 aa, Zea mays
  misc_feature: Ceres CLONE 1378030-F
  misc_feature (44)..(158): Pfam Name: Oleosin Pfam Description: Oleosin
MADRDRSGIYGGAHATYGQQQQQGGGARPMGEQVKGMLHDKGPTASQALTVATLFPLGGLLLVLSGLALTASVVRLGGATPVFLIFSPVVGPAGLVIGTAGMGFLPSGGLGVGGPVLAHVASPNGGGRGSQANPRINWEEGAPQEWGKGRGPTPGHKKPRKE

SEQ ID NO: 15377 - DNA, 671 bp, Zea mays
  misc_feature: Ceres CLONE 1378034-F
  misc_feature: Encodes the peptide sequence at SEQ ID NO. 15378
aaagctggagctcaccgcggtggcggccgctctagaactagtggatcccccgggctgcaggaattcgcacgagaccattacctagaacatcctaatcgaaaaagatcagatccccctttcgctggtttctttccccttgggcaagcccaaaccgtctttaaatacacccgtcgtcgtccgcatcccccgcctgggcttaacattcctccaacaccaccctcgctgcgatcttcgtagcctccgtcgcgtcgagcatcgatcatgtcgggctactgcgggaagtaccaggatgagctcatcaagaatggctgctacatgggcacccccgggcagggtatccttgctggtgatgaggccactggcaccattgggagggggcgtttcagcatcaatgtcgagaacggtgaggagaaccgccgtgccctccgtgagctcctattctggtgcccgggtgctctccagtacatcaggggggtggatctcttcgaggagaccctgtaccaaaagacaaggatggcaagccttttgttgatgtcctcagggagggaggcgtcctccctggcatcaagggtggacagggcacaatggaggttgtgggactgataaggaaacccccacccagggcaatggcacctggggagggttggcgcaaagactacagaggaggggcg

SEQ ID NO: 15378 - protein, 113 aa, Zea mays
  misc_feature: Ceres CLONE 1378034-F
  misc_feature: SWISSPROT Homolog: EC 4.1.2.13 Fructose-bisphosphate aldolase
MSGYCGKYQDELIKNGCYMGTPGQGILAGDEATGTIGRGRFSINVENGEENRRALRELLFWCPGALQYIRGVDLFEETLYQKTRMASLLLMSSGREASSLASRVDRAQWRLWD

SEQ ID NO: 15379 - DNA, 661 bp, Zea mays
  misc_feature: Ceres CLONE 1378036-F
  misc_feature: Encodes the peptide sequence at SEQ ID NO. 15380
  misc_feature (591)..(591): n is a, c, t, g, unknown, or other
  misc_feature (639)..(639): n is a, c, t, g, unknown, or other
  misc_feature (642)..(642): n is a, c, t, g, unknown, or other
  misc_feature (647)..(647): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctgggaaaccttttctcctactctcagcaacaacaatttcttccattcaacccactgtctacattgaaccgtgctgcttatttgcagcaccaactattaccattcagncagttagctactgcctactctcagcaacaacaacttctttcatttaancanttggncgcactgaaccccc

SEQ ID NO: 15380 - protein, 165 aa, Zea mays
  misc_feature: Ceres CLONE 1378036-F
  misc_feature (142)..(142): Xaa is any aa, unknown, or other
  misc_feature (158)..(158): Xaa is any aa, unknown, or other
  misc_feature (159)..(159): Xaa is any aa, unknown, or other
  misc_feature (161)..(161): Xaa is any aa, unknown, or other
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALGNLFSYSQQQQFLPFNPLSTLNRAAYLQHQLLPFXQLATAYSQQQQLLSFXXLXALNP

SEQ ID NO: 15381 - DNA, 635 bp, Zea mays
  misc_feature: Ceres CLONE 1378040-F
  misc_feature: Encodes the peptide sequence at SEQ ID NO. 15382
  misc_feature (335)..(335): n is a, c, t, g, unknown, or other
aaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcnagccccgcgttcccagcacccgcaagcctaagcctaccaagctcaggtcgagcatcacgccctgggacggtgctgatcctcctcgcagggcgcttcatggggaaggagaggtgtgtttctcaagcaggctcaagtctggcctggctccttatctcctggggcctttcaaggataatgggaggaccccatcccccccgggggaaacccaaaccttgggggggttggggtcccccccccccaagggggggggctcccctcgggggggggggggggggcgccccccggtttttggggggggac

SEQ ID NO: 15382 - protein, 156 aa, Zea mays
  misc_feature: Ceres CLONE 1378040-F
  misc_feature (1)..(49): Pfam Name: Ribosomal_L6e_N Pfam Description: Ribosomal protein L6, N-terminal domain
  misc_feature (57)..(57): Xaa is any aa, unknown, or other
MAPTSKLSTGIKRASRSHTYHRRGLWAIKAKNGGAFPKADKAAAAVEPKFYPADDVXPRVPSTRKPKPTKLRSSITPWDGADPPRRALHGEGEVCFSSRLKSGLAPYLLGPFKDNGRTPSPPGETQTLGGLGSPPPKGGGSPRGGGGGRPPVFGGG

SEQ ID NO: 15383 - DNA, 625 bp, Zea mays
  misc_feature: Ceres CLONE 1378042-F
aaagctggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccggagagaaaaaaaaacaaaaaataacgcggagaagcatgagccacttcgccgcccccccccgtgaaaacccccctccgcggggcccccccccgccgccgggagaccccaaaaagccggtctttttggccccaaagccgggggggccccccgggggggcccccctgggggggcccccccgagggggggggaaaaccccccggggggggggttattttttcaaacccccccccccctggggttagaaaaaaaaaaacaacaaaatgtgtttttttgggggggggggggggaaaaaaaaagaaatacgtgtcgctctcctct

SEQ ID NO: 15384 - DNA, 677 bp, Zea mays
  misc_feature: Ceres CLONE 1378044-F
  misc_feature: Translation starting site: 511
  misc_feature: Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (292)..(292): n is a, c, t, g, unknown, or other
  misc_feature (391)..(391): n is a, c, t, g, unknown, or other
  misc_feature (392)..(392): n is a, c, t, g, unknown, or other
aaagctggagctccccgcggtggcggccgctctagaactagtggatcccccgggctgcaggaattcgcacgagaccattacctagaacatcctaatcgaaaaaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactgggggagngtcgcctcccgcctcatcgcctccacaccggccagctgccctccttctatgatgaagtaagggatgtgggtgttccaggaaagaggggcgtacaggcannaacctatctgagtccattaccgaacagaatgagacctgcaaatactttgccggtataaagcttggaaccgagtgttattgccgaccctgacttggaagagcgcaatcaagacgcgaatatggctgtttttttggacccccctcaattttggggaggtatattgaaaaaagttttgagggaacctacccccggagctgggggtatcttcctcatcaggggcttggaggcaagaatggaagggccgggctggaatcccaagtaaccccggatacccttggaatcatt

SEQ ID NO: 15385 - DNA, 670 bp, Zea mays
  misc_feature: Ceres CLONE 1378045-F
  misc_feature: Encodes the peptide sequence at SEQ ID NO. 15386
  misc_feature (283)..(283): n is a, c, t, g, unknown, or other
  misc_feature (318)..(318): n is a, c, t, g, unknown, or other
  misc_feature (418)..(418): n is a, c, t, g, unknown, or other
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcgaaaaacaagcaccagaccaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacnaggagcccccgccggcgccgctcttcgagcccggngagctcaagtcctggtccttctaccgcgccggcatcgccgagttcgtcgccaccttcctcttcgtctacatctccatcctcaccgtcatgggcgtctccnagtccaccctccagtgcgccaccgtcggcatccagggcatcgcctggtccttcggcggcatgatcttcgccctcgtctactgcaccgccggcatctccggcggcacacnaaaccgggcggtgacccttcggctggtctgggggggaggaagtgtcctcacccagggggcggtggtttacatcatcatgcagggcctgggcgcaccttgggggggcgggcgttcgtccaggggttcaagggaggggctgacag

SEQ ID NO: 15386 - protein, 162 aa, Zea mays
  misc_feature: Ceres CLONE 1378045-F
  misc_feature (46)..(160): Pfam Name: MIP Pfam Description: Major intrinsic protein
  misc_feature (34)..(34): Xaa is any aa, unknown, or other
  misc_feature (79)..(79): Xaa is any aa, unknown, or other
  misc_feature (115)..(115): Xaa is any aa, unknown, or other
MEGKEEDVRLGANKFSERQPIGTAAQGTDDKDYXEPPPAPLFEPGELKSWSFYRAGIAEFVATFLFVYISILTVMGVSXSTLQCATVGIQGIAWSFGGMIFALVYCTAGISGGTXNRAVTLRLVWGGGSVLTQGAVVYIIMQGLGAPWGGGRSSRGSREGLT

SEQ ID NO: 15387 - DNA, 751 bp, Zea mays
  misc_feature: Ceres CLONE 1378050-F
  misc_feature: Encodes the peptide sequence at SEQ ID NO. 15388
  misc_feature (311)..(311): n is a, c, t, g, unknown, or other
  misc_feature (346)..(346): n is a, c, t, g, unknown, or other
  misc_feature (348)..(348): n is a, c, t, g, unknown, or other
  misc_feature (353)..(353): n is a, c, t, g, unknown, or other
  misc_feature (369)..(369): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (549)..(549): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (614)..(614): n is a, c, t, g, unknown, or other
  misc_feature (621)..(621): n is a, c, t, g, unknown, or other
  misc_feature (634)..(634): n is a, c, t, g, unknown, or other
  misc_feature (635)..(635): n is a, c, t, g, unknown, or other
  misc_feature (696)..(696): n is a, c, t, g, unknown, or other
  misc_feature (698)..(698): n is a, c, t, g, unknown, or other
  misc_feature (700)..(700): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (717)..(717): n is a, c, t, g, unknown, or other
atagctggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtctttcgcggncagggctccggcatgggcttcagcaagctgacggncnggcgncccgacgacccccgcngggcctgatcgcggggggggggggcgcaccgcgtccccgctgttcggggggggggctgggggccgcaaacttttcccgggggggcacggaaacccgtggcgggacctttgggggcccttggggggaggaaaatacccccgggtccgggggggccctgggaggggnnngggggnnnnncgnccacacctgtgttgttgtggtggggnnnncccacccccccccccccccggggggggggcgcgggncgcgagntcttatttccggnncggccgcccccgcctctttttttttctcgcggaggggcggcgggcgggcgggaagagaggngngngnnnnnnnnncnnnncncccggggcacccttttcggggggggaaggggggg

SEQ ID NO: 15388 - protein, 58 aa, Zea mays
  misc_feature: Ceres CLONE 1378050-F
  misc_feature (49)..(49): Xaa is any aa, unknown, or other
  misc_feature (50)..(50): Xaa is any aa, unknown, or other
  misc_feature (57)..(57): Xaa is any aa, unknown, or other
MPINRIALGSHQEVYHPGALKAAFAEFISTLIFVFRGQGSGMGFSKLTXXRPDDPRXA

SEQ ID NO: 15389 - DNA, 694 bp, Zea mays
  misc_feature: Ceres CLONE 1378052-F
  misc_feature: Translation starting site: 269
  misc_feature (463)..(463): n is a, c, t, g, unknown, or other
agagctggagctccccgcggtggcggccgctctagaactagtggatcccccgggctgcaggaattcgcacgagaccattacctagaacatcctaatcgaaaaacaaaaaccagaccacgcggaacggcaacagcaagctgcctctctcccttgcgcgcgcgtgatttcatcttcgtccgatcccatcccaccccaccccacctcaccggagcccctctccccctaactcctccggcagctgctccgatcccgaaccgtgattcgctcgatggcggcaaccgcgggcgcaacagatccgcaacggcaagctggttcttcttggggacgtggggcgcggcaagtccaggctggtcctccggtttgtgaaaggccaggtcgtcgaggtcccaggatccaccatcggggcggttttcttctcgcagaccctgggggtgaacgacgagacggtcaaggtcgagatatngggaacggggggggcaggagcggtaccacagcttgggctcccatgtattaccgggggggctgcgggtgccatagttgtctaccaacatcacgaacgcgggctccttttacgcgggcgaaagaaatgggttcaagaaacttcaaggaacaaggaaactccaataacaaaaggtgggtccttgcccggaaaacaaggtgtgaatttgttaaaaaaacaaaggcaaggtggtca

SEQ ID NO: 15390 - DNA, 681 bp, Zea mays
  misc_feature: Ceres CLONE 1378054-F
  misc_feature: Encodes the peptide sequence at SEQ ID NO. 15391
  misc_feature (365)..(365): n is a, c, t, g, unknown, or other
  misc_feature (390)..(390): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcacacnagctcctctgtggcgcgcggagcgnatgccgcggnggggtggtgccggcgccggcgatgtcatgggcctcctcctccgggagcgcatagtcttcctcggcaacggggatcgaggacttcctcgcgggacgccgtcgtcagccagctcctccctccttgacgccatcgacccggactctgacatccgcctcttcgtcaatcaaccaggggggatcccttagcgcaacatgggccatcctatgaggtaatggcagcttggggggggcagacggggcccctaatggggaggggggcataggtgggatcacaggttctag

SEQ ID NO: 15391 - protein, 102 aa, Zea mays
  misc_feature: Ceres CLONE 1378054-F
  misc_feature: SWISSPROT Homolog: EC 3.4.21.92 Endopeptidase Clp
  misc_feature (30)..(30): Xaa is any aa, unknown, or other
  misc_feature (42)..(42): Xaa is any aa, unknown, or other
MRSRLRLGPLAATAARGTRQPQALRLTGTXAPLWRAERMPRXGGAGAGDVMGLLLRERIVFLGNGDRGLPRGTPSSASSSLLDAIDPDSDIRLFVNQPGGIP

SEQ ID NO: 15392 - DNA, 718 bp, Zea mays
  misc_feature: Ceres CLONE 1378055-F
  misc_feature: Encodes the peptide sequence at SEQ ID NO. 15393
  misc_feature (414)..(414): n is a, c, t, g, unknown, or other
  misc_feature (439)..(439): n is a, c, t, g, unknown, or other
  misc_feature (440)..(440): n is a, c, t, g, unknown, or other
  misc_feature (447)..(447): n is a, c, t, g, unknown, or other
  misc_feature (448)..(448): n is a, c, t, g, unknown, or other
  misc_feature (458)..(458): n is a, c, t, g, unknown, or other
  misc_feature (505)..(505): n is a, c, t, g, unknown, or other
  misc_feature (506)..(506): n is a, c, t, g, unknown, or other
aaagctggagctcaccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagaggcaggcgcccgccgcgncgttgcaggggttcctgtgcctggnnagagtgnnacggaggcgntggagctacgtggtggacgttggggcccgcaaaggggaggaacaggnngcgggcccgtccccgctgggggcgccgtccaggccgtgccgctgcagtcgccgcttcgcctggccaagaaaaaatgcattcataagatcatatgtggtggcctgaagggtttcaaacagggtaaccccttcaatggaccttacatgacctggagggttctgaaacatttctttggggggagggatgggagtggttaacaaaaagaaccctgg

SEQ ID NO: 15393 - protein, 117 aa, Zea mays
  misc_feature: Ceres CLONE 1378055-F
  misc_feature (53)..(53): Xaa is any aa, unknown, or other
  misc_feature (61)..(61): Xaa is any aa, unknown, or other
  misc_feature (64)..(64): Xaa is any aa, unknown, or other
  misc_feature (83)..(83): Xaa is any aa, unknown, or other
MAPAVGLKRSATQTITLPPPDTRLAVRDVMRSTIPSQPAVAPASTERQAPAAXLQGFLCLXRVXRRRWSYVVDVGARKGEEQXAGPSPLGAPSRPCRCSRRFAWPRKNAFIRSYVVA

SEQ ID NO: 15394 - DNA, 687 bp, Zea mays
  misc_feature: Ceres CLONE 1378056-F
  misc_feature: Encodes the peptide sequence at SEQ ID NO. 15395
  misc_feature (566)..(566): n is a, c, t, g, unknown, or other
  misc_feature (635)..(635): n is a, c, t, g, unknown, or other
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccgcctctgtggggcggcggcggcggcagcagcaccgcgccgcccgggcagccgaccacggtagcgtccaaggtgctggacatgggcgcggcggcgatgcagtcgttgcgccccgtgaagcaggcaaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgcacgagatcaagtcaggcctgtggacgagccgncacgtggcggggctggctggagaaaggcggagctgggacacatggcccgcacggtcggcaaggtctgtnggcacctggcagggtggaccgcggcgaccggcctgggcgctgggcgccccgc

SEQ ID NO: 15395 - protein, 177 aa, Zea mays
  misc_feature: Ceres CLONE 1378056-F
  misc_feature (26)..(177): Pfam Name: DUF1264 Pfam Description: Protein of unknown function (DUF1264)
MASSDGKPLPTPPLWGGGGGSSTAPPGQPTTVASKVLDMGAAAMQSLRPVKQAKQHMCTFALYAHDPKRQVETHHYVSRLNQDFLQCAVYDSDKADARLIGVEYIVSRKIFDSLPAEEQRLWHSHAHEIKSGLWTSRHVAGLAGERRSWDTWPARSARSVGTWQGGPRRPAWALGAP

SEQ ID NO: 15396 - DNA, 643 bp, Zea mays
  misc_feature: Ceres CLONE 1378058-F
  misc_feature: Encodes the peptide sequence at SEQ ID NO. 15397
  misc_feature (345)..(345): n is a, c, t, g, unknown, or other
  misc_feature (602)..(602): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaacactactctggtcgtcctcgcgccgccgcagcagcagcagcgacgcgaccgccggtaatggcttccaccgttgtgctccggaacgccggctcccgccgactcttctgctactccactctccgcgccgccgcaatattgggacccgccgcgccacctgatgcgcccgcggcggcgtcggcccagccgccaccgatggcaggaaccctctgggcgaggtccatgggcactttcacgcgcacgaangcacatgtgaacgtcggcaccattgcgcacgtgggagggcggaaaaacacactcactgctgccattaccaagggtctgggcagaggcagggaagggccaaagcatttgctttttgacgagatccgaacaaggccccgggaaagaagaaaagcccaaaggaaatcccccatttggcaacacggttaattgggccaaaaaatttagaaaaaccggtttaaaaaggggggttttttatggcgccccggggggggaaaaanggngcccccgcgggggccccccccaaaataaaaattattag

SEQ ID NO: 15397 - protein, 123 aa, Zea mays
  misc_feature: Ceres CLONE 1378058-F
  misc_feature (62)..(62): Xaa is any aa, unknown, or other
MASTVVLRNAGSRRLFCYSTLRAAAILGPAAPPDAPAAASAQPPPMAGTLWARSMGTFTRTXAHVNVGTIAHVGGRKNTLTAAITKGLGRGREGPKHLLFDEIRTRPRERRKAQRKSPIWQHG

SEQ ID NO: 15398 - DNA, 652 bp, Zea mays
  misc_feature: Ceres CLONE 1378062-F
  misc_feature (277)..(277): n is a, c, t, g, unknown, or other
  misc_feature (444)..(444): n is a, c, t, g, unknown, or other
  misc_feature (487)..(487): n is a, c, t, g, unknown, or other
  misc_feature (555)..(555): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaatcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcttgtcgtcgtcggcggagaacgaccccacggntgacgtgaccgagcgcggagcaaggacaagcacgaggacggcggcgacaaggagcagggcggcggcggcttcatcgaccaggtgaaggacttcatccacgacatcggcgaaaaaaattgaaggaggggtcgtcggtttcggcaagcccacgggccgacgtgtggggnatccacatcccggacatcagcctcccaccgcgcgacctcggtngtggacgtgctcatcaagaacccgaacccggtcccggatcccgctcgtggacatcgactacctcatcnacagggacgccgcaaagctggtgtcgggcctcatcccgggacggcgggaccattcacgcgcacggncaggagaccgtcaagaatcccggtgtcgctt

SEQ ID NO: 15399 - DNA, 682 bp, Zea mays
  misc_feature: Ceres CLONE 1378063-F
  misc_feature: Translation starting site: 477
  misc_feature: Pfam Name: Amino_oxidase Pfam Description: Flavin containing amine oxidoreductase
aaagctggagctccccgcggtggcggccgctctagaactagtggatcccccgggctgcaggaattcgcacgagaccattacctagaacatcctaatcgaaaatcgtccagttataaatactcttgcaaaaggcttagatatacgcctcaaccataaggttgtggaaattgttcgccaccggaacagggtagaggttactgtaagcagtggccaaacattcgttgcggacgcagcagtggtcactgttccgttgggtgtcctgaaagcgaaaacatcagatttgagccgaggctgccagagtggaaagagaggcaatcagagaactgacggttggagttgagaacaaaaattgtctgcacttcggccaggttttctgggctaacgtggagttcatcggcgtcgtttcctctagcacgtatggttgcagctatttcctcaaccttcacaaggcaacaggccaccctgtccttgtttacatgccctgctgccgacttgctcgtgacattgagaagatgtcagatggagctgctgcgcagtttgccttttctcagttggagaagatccttcccaatgcagctgagccgatgaattacctggtgtcgcactggggctcggacaaaacacacttggctcctacacgtttcgatggggtgacaaaccccgcgacctgtacgagagctgc

SEQ ID NO: 15400 - DNA, 786 bp, Zea mays
  misc_feature: Ceres CLONE 1378064-F
  misc_feature: Translation starting site: 206
aagctggagctccccgcggtggcggccgctctagaactagtggatcccccgggctgcaggaattcgcacgagaccattacctagaacatcctaatcgaaaagcgctcttcacccatttccccatctccgacctcccccttcctctcccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggcggaggatgagccgcaaaccctagagcgggcgcaggagctcttcgacagggggtcccaggccatccaaggatgaggacttcgtcgacgccgtaaactgcctcagccgagggctcgagatcggggcttcccattaggaaaaggtcccgccggagggggccagcacctacctccaaaaagggatgggccctggctaaacaaaggctccggggggaaaagggagggttttgggaaaagggtcccccaaaaacttggccaaaggaaaaacccccgggaaaaagcaacggtaaccaaagaggagacggggaaacccccaaaggccctcgggccacaaggggggggggggcgcggggccccaccaaaaaaggggggggcgtgaaagagcgccaaaaccaatggggcaaaacccaacaaaaagggcaactggggaaatataaaaaaaacctatgcgctccacccccccccaactaaaaaaggggggga

SEQ ID NO: 15401 - DNA, 745 bp, Zea mays
  misc_feature: Ceres CLONE 1378065-F
  misc_feature: Encodes the peptide sequence at SEQ ID NO. 15402
  misc_feature (580)..(580): n is a, c, t, g, unknown, or other
  misc_feature (581)..(581): n is a, c, t, g, unknown, or other
atagctggagctccccgcggtggcggccgctctataactagtggatcccccgggctgcaggaattcgcacgagaccattacctagaacatcctaatcgaaaactctcctcccgtccgtatctctctcttgctcgcactcgcggagatcgaagagaagcgcaggaggccccagcactagcgccgccccgccgccgcatcagacatggcgctggccgctcgcctcgtctcgcgctcccgtcagctatattcggttcaagccactttggggaatggaggtgtcactcaagttcgctcctttgccaaggatgcagctccagctgaccgtcctcctgtcagtggggatgatctcctgaagggcatattctttgaggtacagaagaagtttgagacagctcttggtgttctttaaaaggaaaagatcactattgatccagatgacccagcgccagtttctcgttatgcccagtcatgaagactggtagggaaaaggcggatcttctctctggatctcaaaggggataatataccattgaagacctcaccaaaggcatccctgatgcacggacttacttgaatactnncttcacagctcagaaataaggaggggtcctatagatcatcttggaattgaaccttttgatgatggaagctccttgagaagattgagagggactaaagaaaccactttttgaggagcgacaagaagaaactggccacccccctggcaagagtttgacaagaataa

SEQ ID NO: 15402 - protein, 68 aa, Zea mays
  misc_feature: Ceres CLONE 1378065-F
MALAARLVSRSRQLYSVQATLGNGGVTQVRSFAKDAAPADRPPVSGDDLLKGIFFEVQKKFETALGVL

SEQ ID NO: 15403 - DNA, 663 bp, Zea mays
  misc_feature: Ceres CLONE 1378066-F
  misc_feature: Translation starting site: 226
  misc_feature: SWISSPROT Homolog: EC 2.4.1.207 Xyloglucan:xyloglucosyl transferase
  misc_feature (363)..(363): n is a, c, t, g, unknown, or other
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctgggcggcaccgcgcagggcggcaacttctaccaggacacagagatgacctggggcgatggccgcggcagggtagtggacggcggncgccggctggacctgacgctggaccgcacgtccggctccgggttccagtccaagagcgagtacctgttcggcaagatcgacatgcagatcaagctggtggcaggcaactccgtggcacggtcacacctttctacgtgtcgtcccagggcgacgcgcacgacgagatcgactccgagttcctgggcacgtggagcggggagccctacacgctgcacaccaagtggtcacgcgcggacaggccagcgggagagcagttcccgctctggttgagcctacactgccttcacactactccgtgcg

SEQ ID NO: 15404 - DNA, 843 bp, Zea mays
  misc_feature: Ceres CLONE 1378068-F
  misc_feature: Encodes the peptide sequence at SEQ ID NO. 15405
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nnnnnncccccccnnnnncnncccaccacccccccgcgcccgcgggnnnggggccagagctgggagctccaccgcggtggcggccggctctagaactagtggatccccgcgggctgcaggaattcgcacgagaccattacctaggaacatcctaatgcgaaaaaaaagcaaattgacaccgttctccgtgtcccgacgactcccgtgagcgtggagcggcgactaggcgaggccatggcctccggcatcggctccggccagcagcaacccccagcgccggcggcagatgctgacccgggagccgtcggcgacaagctcgtcttctaagcgccgcctcagcccgtgagggaggactacgtccagaacgccgtcaagtttctctcccaccccaaggtcagggggctcccccgggcgtctacaggggatcccttcctcgaggaggagggggcctaagcacccgaggaagatcgacgaaggcctttccgaaagggttccctgatcctcaaccccaggcacttacgggctagccacttttctcccggcagcagcggggggccaccagcccagggagtcaagtcgccggcgggggggggggagcttaatggggcccaggaacaaagctggtgggaccccaagaaaagggggtgggcccctgggcggtcccttcccaagcgcaaggcccaggggatttagcgtggggtacccgaaggagttgccgggggggggggggggggttccttggggtttgggggttgtggggggcgctaacgggcataagctgggcctttaatacaaaaggacaacatgggggggccttcgcctaaggggggtggaagaggtgct

SEQ ID NO: 15405 - protein, 30 aa, Zea mays
  misc_feature: Ceres CLONE 1378068-F
MASGIGSGQQQPPAPAADADPGAVGDKLVF

SEQ ID NO: 15406 - DNA, 635 bp, Zea mays
  misc_feature: Ceres CLONE 1378069-F
  misc_feature: Encodes the peptide sequence at SEQ ID NO. 15407
  misc_feature (211)..(211): n is a, c, t, g, unknown, or other
  misc_feature (218)..(218): n is a, c, t, g, unknown, or other
  misc_feature (219)..(219): n is a, c, t, g, unknown, or other
  misc_feature (324)..(324): n is a, c, t, g, unknown, or other
  misc_feature (366)..(366): n is a, c, t, g, unknown, or other
  misc_feature (422)..(422): n is a, c, t, g, unknown, or other
  misc_feature (423)..(423): n is a, c, t, g, unknown, or other
  misc_feature (427)..(427): n is a, c, t, g, unknown, or other
  misc_feature (461)..(461): n is a, c, t, g, unknown, or other
aaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaanaaatggnngccgaaccccgcgggggaaagggtggaatccaaagtggccaaaaagccttgggccgggttggggcaatgggggaagggcccccggcaaaggccccaccttgttcngattccgaaggaagggtggagtagcgcctcgcagggcatggnagtgcgcgtcaagatcctctttcactcgctctggcacaccgacgtctactttctgnnagcnagggggcagactcccgtgttcccctcgatctttnggcacgagggtgaagggatcataagaaagggtggaaagaggtgttgactgacctaacctcccgggggaacatggcccttcctgggggtcacctgggggagaggcaaggaagtgtggcccccttgcaattccgcaaaaaaccaaccttgggggaattttgttcaggatcaacccc

SEQ ID NO: 15407 - protein, 48 aa, Zea mays
  misc_feature: Ceres CLONE 1378069-F
  misc_feature: SWISSPROT Homolog: EC 1.1.1.1 Alcohol dehydrogenase
  misc_feature (2)..(2): Xaa is any aa, unknown, or other
  misc_feature (21)..(21): Xaa is any aa, unknown, or other
  misc_feature (34)..(34): Xaa is any aa, unknown, or other
MXVRVKILFHSLWHTDVYFLXARGQTPVFPSIFXHEGEGIIRKGGKRC

SEQ ID NO: 15408 - DNA, 666 bp, Zea mays
  misc_feature: Ceres CLONE 1378073-F
  misc_feature: Translation starting site: 162
  misc_feature (185)..(185): n is a, c, t, g, unknown, or other
  misc_feature (524)..(524): n is a, c, t, g, unknown, or other
tggagctccccgcggtggcggccgctctagaactagtggatcccccgggctgcaggaattcgcacgagaccattacctagaacatcctaatcgaaaactagcttcagaacgaactaaaacccgcgatctgaagcgactagtcgaaggcggcggcggcggcgatggggagcgacctggagacgganaagaagaagaccccggtggcgctgatgcccatcgcgaagcctctcgctggaaagaagctctgcaagcggaccctcaagctcgtgcgacgagcctctgaggccaagtgcctcaagcgcggagtcaaagaggtagtcaagagcattcgccgcgggaacaaagggttgtgtgtgattgctggaaatatttcggctaggggatgtgattacacacgttccaatactatgtgagggatctaatgttccttacatatatgttccatcaaaagaggatcttgcgaccgcaggaaccactaagagggcaacttgttgcgtcctggttctgaccaaaccaaacagggngagctcagtgacgaggtgaggataaactgagtcagactatgaccaagttgtagcgggagttgctggggctacatctgcgatgttctagggacatttcagggacacatcatctgaggatcatgcagctacattcgtggcgtat

SEQ ID NO: 15409 - DNA, 670 bp, Zea mays
  misc_feature: Ceres CLONE 1378078-F
  misc_feature: Pfam Name: DUF1635 Pfam Description: Protein of unknown function (DUF1635)
  misc_feature (420)..(420): n is a, c, t, g, unknown, or other
aagctggagctccccgcggtggcggccgctctagaactagtggatcccccgggctgcaggaattcgcacgagaccattacctagaacatcctaatcgaaaaattttgcaggaatccaaatcattcgccctctagatcgtgctgccatgtctctgtccacccccaccaccttgtgttccgcgacgtctcctctctctctctctctctctagagttgctgatagtttttttactaactcactccaccaaatccgttccaattccggtgcaaactgcttgttcgtgcgagacaataaagccatggaactagctaacccttgctgaactgtggaatggtttctgagcagagcgtggcggagctgaatcagaccctgctggcgaccacgctggatctgtaggcggcgagggaggagctgaggcgnaaggagcacagcatcgccaagctgtcggacctggtgcgcgaggtggccaggagcgcgacgacgcgcgggaccaggcgcagagcctccgcctcctcgctagaccagccgcgccgccgctcgtcacgtccagtgtcaccgactccgactgcagtctcgcgtcgtcccccgtggacccgttcttcgaccccgtcacgtccgccgaacacagggggggctgcaaagtcagccccgacacggcgtcggccgcgcc

SEQ ID NO: 15410 - DNA, 680 bp, Zea mays
  misc_feature: Ceres CLONE 1378085-F
  misc_feature: Encodes the peptide sequence at SEQ ID NO. 15411
  misc_feature (462)..(462): n is a, c, t, g, unknown, or other
aagctggagctccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcgggggcggggggcgtcctttctccctctccgcggaaccacgagagccgggccgtggcgcctgcggtggtgttcacccccgccccgccgnctgcttctgtgaatgtcccgctgcccgcggtgcaggtgcccgcgccgaatacgagaggcgtccgcggggggcaagcatgacgtatcggcgttcggtttcttctggaagccgtcgcgggcgtcagaaaccgacgcaaggctcgaagagaacggggctaacctggttcggttggaaaagccaaggccaagggggcgttaacgataaaaccaaacataggg

SEQ ID NO: 15411 - protein, 116 aa, Zea mays
  misc_feature: Ceres CLONE 1378085-F
  misc_feature (91)..(91): Xaa is any aa, unknown, or other
MGSSSSPPPPPPLPLPMIGRAGNLTIFITPPSPASTPRGAGRTPPLESPRSDISTPIPQRAGAGGVLSPSPRNHESRAVAPAVVFTPAPPXASVNVPLPAVQVPAPNTRGVRGGQA

SEQ ID NO: 15412 - DNA, 738 bp, Zea mays
  misc_feature: Ceres CLONE 1378087-F
  misc_feature: Translation starting site: 281
  misc_feature: Pfam Name: ACT Pfam Description: ACT domain
  misc_feature (525)..(525): n is a, c, t, g, unknown, or other
  misc_feature (562)..(562): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcgaaaaaaggagggggtgtcgcttagactagcgaatccatccgccaagattccgtgcacctcgaccgccgccgccgctatctgtttgtccccgcccccgcgaccgcggcagcctagcaggaggggaggatccatgtctagtttctagagcagctgcttgcgtcccttgcaaatcacatcgaccgatggggatacccagcgacgacgtggtgcaaatccgccacgccgacgccgctggcgagcccaccgtcgtcaccgtcagctgccccgacaagacgggcctcggctgcgacctctgcccggtcgtcctcctcttccgcctcagcgtcgtcaagggagacatgagcacggacggggcggtggtgctacatcggtgctctggggtctgccacgcggggggcggccggtgcccgtgccatgggacctactncaggacaggttgcttcagctctgccccgtcgcgccgncgttcggattcgacaacgcgtacctcgctcggntggctacaggaccttgcgcctcccccacaaagctcttcttgctcaagctatgctgcttcgaccggatgggactcttgcatgatgggaaacgtgttctgtgcagctagagctcacgatccgaagggtgaagtctctacacgccg

SEQ ID NO: 15413 - DNA, 758 bp, Zea mays
  misc_feature: Ceres CLONE 1378089-F
  misc_feature (13)..(13): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ggggccccccccnncnncnnnnccgggggggggnnnntgcattnnnnnnaaaagctggggctccccgcggtggcggccgctctagaactagtggatcccccgggctgcaggaattcgcacgagaccattacctagaacatcctaatcgaaaaatctccctgactcgcctcgtcctccagatatcggccgccaccttcacctccaccgccccggggcacctgtgcgtctccatcgtcgccgcctctcctccttcggacacgactgaccttccactggcgccaacgaagaaaaacatagggaagaagctcaccgccaaacctcatccagatccagtcgctgccctccgaaggccgcatacgggacgtctcgtctcttcctttgggatccgggggggaactccatcacccccagcttcacctcgccgggggggccctccgtccgctctcaccccacgcttctatatcgccacctctcctcgttggagaagaagacacctgaggatctggcaggctttctggaatcacatttcttggagaactatcctgttggagaactaaaactagggtcttgggccatattaggggatcagcaaagttaagattgatggctgattttcttggaaccaactgggactctttagatgaggacccgtttacccggggggggggacaaaaggggtgataagggggggttggggccccgtccctggaaaaggaaaaagggggaaggccacgttcggtttaaaaggatgggggttc

SEQ ID NO: 15414 - DNA, 738 bp, Zea mays
  misc_feature: Ceres CLONE 1378091-F
  misc_feature: Translation starting site: 227
  misc_feature: SWISSPROT Homolog: EC 2.4.1.207 Xyloglucan:xyloglucosyl transferase
aaagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggcccgcgcaaggtagtggaacggcggcgcgccctggacctgacgctggaccgcacgtccggctccgggttccagtccaagagcgagtacctgttcggcaagatcgacatgcagatcaagctggtgcccagcaactccgtggcacggtcaccaccttctacctgtcgtcccagggcgacgcgcacgacgagatcgacttccagttcctgggcaacgtgagcggggagccctacacgctgcacaccaaccgggttcacgcccggacagggcccaggggaagccacaattccggcctctgggttcgaccctaccactggccttccacaccctaactccatccctgtggaaacccgcaacaacgggtatcttcgccgtgggcccgacacccccggggcggggaa

SEQ ID NO: 15415 - DNA, 675 bp, Zea mays
  misc_feature: Ceres CLONE 1378092-F
  misc_feature: Translation starting site: 252
  misc_feature (419)..(419): n is a, c, t, g, unknown, or other
aagctggagctccccgcggtggcggccgctctagaatagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatcgctctcttgatctcagccatgggcggagggggagcagcaacaggacacgccgaagctcttcaaccggtgaaccttcgatggatggccagggggacgacatctcgctgaacgactacctcgctggggacgcgacgaagcacgcgatgtacctgccgcacaccgcggggcgctactccaagaagcggttccccaaggcgcaggggcggatcgtttagcgccttacaaactccctcatgatgcacggncggcaacaacggcaagaaggtcatgggctggccccatcatcaaagataccctggagatcatttcaccttggtcacggatgccaaccccatcccgggtcgtcgcaacgcgatcatcaacgggggcccccgggaggatgccccccgaattggttcccctggggttggaaaaaggaagccgggataactcacccctgaggagggggaacaaggccatttacctcctccacaatgggggcagggaaagggttttccgaaa

SEQ ID NO: 15416 - DNA, 747 bp, Zea mays
  misc_feature: Ceres CLONE 1378096-F
  misc_feature: Translation starting site: 207
  misc_feature (500)..(500): n is a, c, t, g, unknown, or other
  misc_feature (501)..(501): n is a, c, t, g, unknown, or other
  misc_feature (585)..(585): n is a, c, t, g, unknown, or other
  misc_feature (646)..(646): n is a, c, t, g, unknown, or other
  misc_feature (647)..(647): n is a, c, t, g, unknown, or other
  misc_feature (661)..(661): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
catagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtgggtgggggctgggcgtggccacgcccggtgttcctgatcttcagccccgtgctggtccccgccgcgctgctcatnncggacggccgtcatggggtccctcacgtcgggcgcgctgggggctcgggggcctgtcctcgctcacgtgcctcgccacaccggngcggcaggcgtccagcgcacccgggactacgtggaggagcgcaccgcaggatggcggaggnncgcgcgcacgcggnccacaagaccgcgcaggcagccaggccatccaggcaagggcgcagaagccgnnncccgggggaaagtgcaggggccggccctggct

SEQ ID NO: 15417 - DNA, 721 bp, Zea mays
  misc_feature: Ceres CLONE 1378097-F
  misc_feature: Encodes the peptide sequence at SEQ ID NO. 15418
  misc_feature (311)..(311): n is a, c, t, g, unknown, or other
  misc_feature (415)..(415): n is a, c, t, g, unknown, or other
aaagctggagctccccgcggtggcggccgctctagaactagtggatcccccgggctgcaggaattcgcacgagaccattacctagaacatcctaatcgaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggagggcggcgcccgatgggtgagcaggtgaaggncatgctccacgacaaggggccgacggcgtcgcaggcgctgacggtggtgacgctgttcccgctgggcgggctgctgctggtgctgtcggggctggcgctgacgncctccgtggtggggctgggcgtggccacgccggtgttcctgatctttcagcccgtgctcgtcccggcgcgctgctcatcgggacggccgtcatgggttccctcacgtcgggcgcgctgggggctccgggggcctgtcctcgctcacgtgctcggcaaccgggggcggaagcggtccagggacccgggaataacgggaagaggcccaccgaaggatgggggaaggccgggcgcaagcggccacaagaccgggcaggaagccagcattcaggggaaggcgcaagaagccgccccccggggaaaaggga

SEQ ID NO: 15418 - protein, 172 aa, Zea mays
  misc_feature: Ceres CLONE 1378097-F
  misc_feature (44)..(136): Pfam Name: Oleosin Pfam Description: Oleosin
  misc_feature (36)..(36): Xaa is any aa, unknown, or other
  misc_feature (71)..(71): Xaa is any aa, unknown, or other
MADRDRSGIYGGAHATYGQQQQQGGGRRPMGEQVKXMLHDKGPTASQALTVVTLFPLGGLLLVLSGLALTXSVVGLGVATPVFLIFQPVLVPARCSSGRPSWVPSRRARWGLRGPVLAHVLGNRGRKRSRDPGITGRGPPKDGGRPGASGHKTGQEASIQGKAQEAAPRGKG

SEQ ID NO: 15419 - DNA, 721 bp, Zea mays
  misc_feature: Ceres CLONE 1378106-F
  misc_feature: Encodes the peptide sequence at SEQ ID NO. 15420
  misc_feature (316)..(316): n is a, c, t, g, unknown, or other
  misc_feature (398)..(398): n is a, c, t, g, unknown, or other
  misc_feature (478)..(478): n is a, c, t, g, unknown, or other
  misc_feature (619)..(619): n is a, c, t, g, unknown, or other
aaagctggagctccccgcggtggcggccgctctagaactagtggatcccccgggctgcaggaattcgcacgagaccattacctagaacatcctaatcgaaaaagtccaaacctttcgatccgtggtgtgttggatctgaacccaagctccgagtcgctttcggggtgggcattctcctcttcgtcttcggttgcaagaaagaaaaagcatcatggacggcttccccaagagcgtcggcggtgacggccctaacattccggcgggatcccaccccgcaggcgggagccaggcggcggcaggaggaggcgcgacgcancggacgcagtatccgtatgtgactggtaattcagtcattgccttgaatacaaggatggtgtgatcatggcatgtgacactgnagcctcttatggatcaactttgagatacaagagtgtggaacgcattaaggcagttggcaagcatagcatcattggagcangcggagaagtcagtgacttccaggagattttgcgctatttggatgaactaactctgtctgatcatatgtgggatgatggaaactcgctgggcccaaaagagaccacagctatttgacagagtgatgttacaccggcgcacncagtttgatcctctctggaactcattggacttggtgggggaaaaagggccaaaggtggtggaaatatcctgggatggtaacatgatggtccccatttcagga

SEQ ID NO: 15420 - protein, 70 aa, Zea mays
  misc_feature: Ceres CLONE 1378106-F
  misc_feature: SWISSPROT Homolog: EC 3.4.25.1 Proteasome endopeptidase complex
  misc_feature (6)..(6): Xaa is any aa, unknown, or other
  misc_feature (33)..(33): Xaa is any aa, unknown, or other
MACDTXASYGSTLRYKSVERIKAVGKHSIIGAXGEVSDFQEILRYLDELTLSDHMWDDGNSLGPKETTAI

SEQ ID NO: 15421 - DNA, 717 bp, Zea mays
  misc_feature: Ceres CLONE 1378111-F
  misc_feature: Encodes the peptide sequence at SEQ ID NO. 15422
  misc_feature (602)..(602): n is a, c, t, g, unknown, or other
  misc_feature (636)..(636): n is a, c, t, g, unknown, or other
  misc_feature (689)..(689): n is a, c, t, g, unknown, or other
aagctggagctccccgcggtggcggccgctctagaactagtggatcccccgggctgcaggaattcgcacgagaccattacctagaacatcctaatcgaaaacatttctaggcagcgccgtctcttcgcgcaccccccaattcgaacgacggagcacgacgcacgcagagccgcagagatccgtcacactgcaagttttgaaaactgaactgtaagatggcatcagcagagctttcccgtgaggaaaatgtgtacatggcgaagctcgccgagcaggcagagaggtacgaggaaatggttgagttcatggagaaggtagcgaaaactgttgactcggaggagctcactgtggaggagcgcaacctcctgtctgttgcatacaagaacgtcattggagcccgccgtgcctcatggcgcatcatctcctccatcgagcagaaggaggagggtcgaggcaatgaggaccgtgtaacactcatcaaggactaccgtggcaagattgaaactgagctcaccaagatctgtgatggcatccctcagcttctcgaatctcaccttggtgccgtcttccaccgctcccgagtcccaggtcttctatctcangatgaagggtgactactacagataccttgctgangtcaagactggagctgagagaaaggacgctgctgaaaacacatggtggcatancagctgccccagacatgctttggctgag

SEQ ID NO: 15422 - protein, 132 aa, Zea mays
  misc_feature: Ceres CLONE 1378111-F
  misc_feature (8)..(132): Pfam Name: 14-3-3 Pfam Description: 14-3-3 protein
  misc_feature (129)..(129): Xaa is any aa, unknown, or other
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGIPQLLESHLGAVFHRSRVPGLLSXDEG

SEQ ID NO: 15423 - DNA, 730 bp, Zea mays
  misc_feature: Ceres CLONE 1378112-F
  misc_feature: Translation starting site: 167
  misc_feature (551)..(551): n is a, c, t, g, unknown, or other
  misc_feature (674)..(674): n is a, c, t, g, unknown, or other
aaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccattttgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttttcagatcatggagtaccgatccgccgtgtgaccagacctatgtcattgctacatncacccaagtgacatctctggtggtgatgtcgccaagtttgatgacaagtactttgccagggagaagaagcagaaggtgaagaagaccgagggcgagctttttgagacagaaaagaggcatccnagtcactgcctgactccaagaagatgaccagagggtgtggattctgctctgatcaa

SEQ ID NO: 15424 - DNA, 732 bp, Zea mays
  misc_feature: Ceres CLONE 1378115-F
  misc_feature (258)..(258): n is a, c, t, g, unknown, or other
  misc_feature (267)..(267): n is a, c, t, g, unknown, or other
aaagctggagctccccgcggtggcggccgctctagaactagtggatcccccgggctgcaggaattcgcacgagaccattacctagaacatcctaatcgaaaatccacctgtcctcgcgtctcccttcccagatccatcgactcgctcgggccgcccctcccgtcgtccccgttcgaaggtgcggcagccggcaggcgagcgaattgattcgacatgaaatccgagtacgactaccctttcaaacttctgcttattggntgatctggntgtgggaaatcatgcttgcttctcagatttgcagacgattcttatttggacagctatatcagcacaattgggggttgatttcaaaattcgcacagtggagcaagatgggaagaccataaaacttcaaatttgggatactgctgggcaagagcgcttcaggacaatcactagcagctactaccggggagctcatggaatcattattggatatgacgtgacagaccaagaaagctccaataatgggaagcaatggttgaacgaaataaaccgtatgcaagggataatgttaacaagcctcctggttgggacaagaagggccttactgccaaaaaaagttgggaaactgaaaaagcaaaggggtttggtgaagaaaagggcatcccattctggaagacgaagggcaaaaaaccccatcaagggggaagcaggcccttctggctatggctggctcctcaagggagaggg

SEQ ID NO: 15425 - DNA, 708 bp, Zea mays
  misc_feature: Ceres CLONE 1378116-F
  misc_feature (521)..(521): n is a, c, t, g, unknown, or other
  misc_feature (522)..(522): n is a, c, t, g, unknown, or other
aaagctggagctccccgcggtggcggccgctctagaactagtggatcccccgggctgcaggaattcgcacgagaccattacctagaacatcctaatcgaaaatcacaattcactccactcatcttttctcgtttagaacctctaaaatttcccccactcgccagtcgcagcagcacctgtagcagtcatggacgccagcggagccggtagcaaggggaagaaggggggcggcggccgaaggcagggcggcccaagaaagagtcggtgacgcggtccgtcaagggcgggctgcagttccccgtcgggcggatcgggcgctacctcaagaaggccggtacgcgcagcgcgtgggcactggggccccccgtctacctcgccggcgtcctggagtactcgccgccgagggtctggagttggcagggaaagcgggcgaaaacaacaaagaggacgggcatcatcccgcgccacgtgctcctgggggatccgaaacgacgaggagttcggaaagttggtgggccggnntcacaatcgcggaacgggggggtcctccccaaaattacactcgttgttcctgcccaaaaaaggggggggaaaaaggggccaagggggggaagcagggaacccaagtccccccaaaaaggcggccaggtcccccaagaagggtttaaaaaggaagggcttcattttgggctggggggcggaaaaagg

SEQ ID NO: 15426 - DNA, 759 bp, Zea mays
  misc_feature: Ceres CLONE 1378117-F
  misc_feature: Encodes the peptide sequence at SEQ ID NO. 15427
  misc_feature (1)..(1): n is a, c, t, g, unknown, or other
  misc_feature (438)..(438): n is a, c, t, g, unknown, or other
nagaagctggagctccccgcggtggcggccgctctagaactagtggatcccccgggctgcaggaattcgcacgagaccattacctagaacatcctaatcgaaaaactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacgccgcccaccgtggtgggggacaagcaccatacggacgcctccggcgtcgggcgccgacccggcttggggngccgtgcccgtgcttggcatccccctggccctccggggaatgaaccttctcctccgcaactggaccggcggaatccgggggggccacttccacccccgccgtcaccttcgggcttcttccggggcggcaagggcccccctgggggccgcgcgctgcttccaatttcggggggggagggggccccggggccacatcggggcggagccggccccacggaaagggggttccaacaaagggccctcattttcgatagggagagggggcgggtggcggccccacttctccttcccctccccgggtatttcacgccggggggatgcc

SEQ ID NO: 15427 - protein, 188 aa, Zea mays
  misc_feature: Ceres CLONE 1378117-F
  misc_feature (82)..(82): Xaa is any aa, unknown, or other
MGKDDVIESGAGGGEFAAKDYTDPPPAPLIDAAELGSWSLYRAVIAEFIATLLFLYITPPTVVGDKHHTDASGVGRRPGLGXRARAWHPPGPPGNEPSPPQLDRRNPGGPLPPPPSPSGFFRGGKGPPGGRALLPISGGEGAPGPHRGGAGPTERGFQQRALIFDRERGRVAAPLLLPLPGYFTPGGC

SEQ ID NO: 15428 - DNA, 628 bp, Zea mays
  misc_feature: Ceres CLONE 1378122-F
  misc_feature: Encodes the peptide sequence at SEQ ID NO. 15429
aaagctggagctccccgcggtggcggccgctctagaactagtggatcccccgggctgcaggaattcgcacgagaccattacctagaacatcctgttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgttcgttggtttgttcccgttgctttcacgagggatcg

SEQ ID NO: 15429 - protein, 130 aa, Zea mays
  misc_feature: Ceres CLONE 1378122-F
  misc_feature (58)..(130): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFVGLFPLLSRGI

SEQ ID NO: 15430 - DNA, 627 bp, Zea mays
  misc_feature: Ceres CLONE 1378137-F
  misc_feature: Encodes the peptide sequence at SEQ ID NO. 15431
aaagctggagctccccgcggtggcggccgctctagaactagtggatcccccgggctgcaggaattcgcacgagaccattacctagaacatcctaatcgaaaaaatatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactt

SEQ ID NO: 15431 - protein, 155 aa, Zea mays
  misc_feature: Ceres CLONE 1378137-F
MAAKIFCLLMLLGLSASAATATIFPQCSQAPIASLLPPYLSPVVSSVCQNPILEPYRIQQAIAAGILPLSPLFLQQSSALLQQLPLVHLLAQNIRAQQLQQLVLANLAAYSQQQQFLPFNQLAALNSASYLQQQQLPFSQLPAAYPQQFLPFNQL

SEQ ID NO: 15432 - DNA, 637 bp, Zea mays
  misc_feature: Ceres CLONE 1378172-F
  misc_feature: Encodes the peptide sequence at SEQ ID NO. 15433
  misc_feature (319)..(319): n is a, c, t, g, unknown, or other
  misc_feature (539)..(539): n is a, c, t, g, unknown, or other
  misc_feature (566)..(566): n is a, c, t, g, unknown, or other
  misc_feature (567)..(567): n is a, c, t, g, unknown, or other
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcnttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgcactttgcgacgcccgtctccgcagattatgcttgcaacagcantaaaccattcatgttcaacccaatggnncatgacgatatccacccatgttctacaganccccccttttgtggtggtgctgcatctaataaaaaaaaaa

SEQ ID NO: 15433 - protein, 82 aa, Zea mays
  misc_feature: Ceres CLONE 1378172-F
  misc_feature (53)..(53): Xaa is any aa, unknown, or other
MAAKMLALFALLALCASATSATHIPGHLPPVMPLGTMNPCMQYCMMQQGLASXDGVSVPDAAATVGLTASDDASDDATDDDA

SEQ ID NO: 15434 - DNA, 656 bp, Zea mays
  misc_feature: Ceres CLONE 1378189-F
  misc_feature: Encodes the peptide sequence at SEQ ID NO. 15435
  misc_feature (329)..(329): n is a, c, t, g, unknown, or other
  misc_feature (399)..(399): n is a, c, t, g, unknown, or other
  misc_feature (405)..(405): n is a, c, t, g, unknown, or other
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgcccgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggngccgacgggcgtcgcaggcgctgacggtgggtgacgctgttcccgctgggcgggctgctgctggtgctgntcgggnctgacgctgacgacctccggggttggatgatgggggcggnccacgaccgatgttcatgatcttcagtgacgtgctcatgcacgtcgtggtggtcatcggaacgctcgtcttgacgaagctagagctcaaggaggtgcggcgacgaggtcgtcaagtacaatgagggggctgctgatcgtgagggcctggctgctcagggtggcgctgatgagccccaggacaagacgggcttgaatccgtaccaggactcg

SEQ ID NO: 15435 - protein, 52 aa, Zea mays
  misc_feature: Ceres CLONE 1378189-F
  misc_feature (42)..(42): Xaa is any aa, unknown, or other
MADRDRSGIYGGAHATYGQQQQQGGGGRPMGEQVKGMLHDKXPTGVAGADGG

SEQ ID NO: 15436 - DNA, 626 bp, Zea mays
  misc_feature: Ceres CLONE 1378191-F
  misc_feature: Encodes the peptide sequence at SEQ ID NO. 15437
tggagctccccgcggtggcggccgctctagaactagtggatcccccgggctgcaggaattcgcacgagaccattacctagaacatcctaatcgaaaaacgacacgaaccaggcaaccagctgccgagggaggaaaggaaccctagcggaacactgtgcaggtgacggcggcgcgctaccggtgacgggggatacggcggcatcgtccccctcggcccctcctccatccccggcgcggcggcgccagcagcctacctgcagatggatctcaaggatagcctctccaaatttaagcaacagcaggagagatgccagtcatcactggcgagcatagctgcttcgacctcaaagccaaagcacagggcccaaccagcgcatgctcccaacgtcccagcaagaccatcacaacctattaagttttcaaatgatacagaaaggctgcagcacatcaattcgattaggaaatctcctgttggagcacagatcaagcttgtcatcgaacttctttacaagacaagacaagcttttactgcagagcagataaatgaagcaacttatgttgatattcacggttaataaagctgtctttgacagcttgagaaacaccccaaagtaagtatgaatggg

SEQ ID NO: 15437 - protein, 104 aa, Zea mays
  misc_feature: Ceres CLONE 1378191-F
MDLKDSLSKFKQQQERCQSSLASIAASTSKPKHRAQPAHAPNVPARPSQPIKFSNDTERLQHINSIRKSPVGAQIKLVIELLYKTRQAFTAEQINEATYVDIHG

SEQ ID NO: 15438 - DNA, 625 bp, Zea mays
  misc_feature: Ceres CLONE 1378198-F
  misc_feature: Encodes the peptide sequence at SEQ ID NO. 15439
  misc_feature (303)..(303): n is a, c, t, g, unknown, or other
  misc_feature (463)..(463): n is a, c, t, g, unknown, or other
  misc_feature (552)..(552): n is a, c, t, g, unknown, or other
  misc_feature (571)..(571): n is a, c, t, g, unknown, or other
tggagctccccgcggtggcggccgctctagaactagtggatcccccgggctgcaggaattcgcacgagaccattacctagaacatcataatcgaaaatttttgttttgtcgtttcgtttggtcgtcgaggacgtctcacggaagcgtaggcaggcgagctaggctaattaacagcgacgtgacactgtgcgcgcgcagatacccgaggacctgcacttcgtgctgcggatgcgacacacgttcgagtcgctgggctaccagtcgggcttcttcctctcccagctcttctcggtcggcgcgggncgcctcgccgacgccgcctcctccggccgcgcgtcccccgccggcgcagcttttcaactggccgggcgcccaccagccgcagctcttcccgcccggtcccgggcgcgttccaccaccccgtcggcgcgggcgatgccgccattgttcccaggcggcggcnaaggacgagggccacatgttccacattccaccggcacaccatggcagcaagccacggcacatggacgagctcccgcaccggcacagcanacgaaggggggccggtggngaggcgcccgacggggaactcccggggggccaacgggttgtccttcttcacgcg

SEQ ID NO: 15439 - protein, 208 aa, Zea mays
  misc_feature: Ceres CLONE 1378198-F
  misc_feature (101)..(101): Xaa is any aa, unknown, or other
  misc_feature (184)..(184): Xaa is any aa, unknown, or other
GAPRGGGRSRTSGSPGLQEFARDHYLEHHNRKFLFCRFVWSSRTSHGSVGRRARLINSDVTLCARRYPRTCTSCCGCDTRSSRWATSRASSSPSSSRSARXASPTPPPPAARPPPAQLFNWPGAHQPQLFPPGPGRVPPPRRRGRCRHCSQAAAKDEGHMFHIPPAHHGSKPRHMDELPHRHSXRRGAGGEAPDGELPGGQRVVLLHA

SEQ ID NO: 15440 - DNA, 637 bp, Zea mays
  misc_feature: Ceres CLONE 1378201-F
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgcttgcaggtggaggacttctcgcccgcagtggtgggacctcatcaccaccaccgcctggttccgcgaccactggtcccgcgagcacccccacctggacgagatagccagcaggctcgagttggtcgccctccttgcaccgatggaggatgaggacctcttctacggcgagcaggcccccgccgccgcgncgccttaaaaaaagattcggtgctcaaggcgctgaacttgggctcccgaagagcggagccccccccgg

SEQ ID NO: 15441 - DNA, 597 bp, Zea mays
  misc_feature: Ceres CLONE 1378204-F
  misc_feature (186)..(186): n is a, c, t, g, unknown, or other
  misc_feature (187)..(187): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (215)..(215): n is a, c, t, g, unknown, or other
  misc_feature (234)..(234): n is a, c, t, g, unknown, or other
aaagctggagctccccgcggtggcggccgctctagaactagtggatcccccgggctgcaggaattcgcacgagaccattacctagaacatcctaatcgaaaactctctgtgtcatcaccctcattccgacagttccgctagaaggaaaagaaagaaaaaaaactctctttctctctcttttccagnnctctctctccctctccacggnnncgcancatgtcaaggctctacagncagggcttctcccctggcagaccctctcccccccagataagagcaccccgacgctgaaagccagtactgggcgagcttcccgcgggcatcagaaactggggccttcttggagtgctgccgatatggaaccggtggccaacaagaaatctggcgggataaggattggtcctggaccgggatttaaaggtcttgacgggcgcggggtataaaacctaaacccatgccccccccattggccggccaaactacatgggaaggggttttgggcctgggaaggggggccccaccaaagaatgggggtttccccccccccgggaaaaaaagtgggggggggaaggggaccccccaagccctggtctttat

SEQ ID NO: 15442 - DNA, 654 bp, Zea mays
  misc_feature: Ceres CLONE 1378211-F
  misc_feature (151)..(151): n is a, c, t, g, unknown, or other
  misc_feature (532)..(532): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaaaactctctttgcttcttctctcctaactcctactttgatctccttactgngctcaccaacaatatcatgccccatccaatgaagatccttactgccgcacgaaacttgatttccatatctcctcctgtcgatagcgtcgatcgactctctctcgctcctcaggctctgaaacagctcagcgcacgaacgccactggtttctccaagtggatatatactgtgtagggcttttgacatcagaaggagcagaaagattgcgagctatgcgactagcgatacgtgactcgacaatgcagattcttgagagagctacgagacttactcatgatgagctgcttagggctaactttagtggacactgagtgctgtgtgttcttgatcaccgagcagattgaacttgcctcgatgacgatccatctactgcaatctagntaatgcactgtctatgttatcctacaacgtccgttacaatggatgcctcgtcagcgtatgacgttgactcgtgctgagatccatacatgctgacgatgatgacgtaatgaagtgttcacatn

SEQ ID NO: 15443 - DNA, 636 bp, Zea mays
  misc_feature: Ceres CLONE 1378214-F
  misc_feature: Encodes the peptide sequence at SEQ ID NO. 15444
  misc_feature (528)..(528): n is a, c, t, g, unknown, or other
  misc_feature (551)..(551): n is a, c, t, g, unknown, or other
  misc_feature (611)..(611): n is a, c, t, g, unknown, or other
aagctggagctccccgcggtggcggccgctctagaactagtggatcccccgggctgcaggaattcgcacgagaccattacctagaacatcctaatcgaaaactagccgcctgcctctcctcctccagagctcgtcgccaccggccaccgccaccctcgatcacgccgtccgtcgaggtaaggtcagcatggtgagggtcagtgtgctcaacgatgcgctcaagtccatgtacaacgctgagaagatcggcaagaggcaggtcatgatcaggccgtcgtccaaggtcatcatcaagttcctgacggtcatgcagcgccacggctacattggagagttcgagtacgttgatgaccaccgatcgggcaagatcgtggtcgaactcaacgggaggctgaacaagtgcggcgtcatcagccctcgctttgatatcggcgtgaaagacattgagggatggactgcaaggctgctcccgtccaggcagttcggatacatcgtcctcacaacttcggcaggcatcatggaccacgnagaggcccgccggaagagcgtangaggcaaggtttctagtttcttctatttgagagctgagaatcttttgtatggcctgcctngctgtcttactctctcagactagaa

SEQ ID NO: 15444 - protein, 148 aa, Zea mays
  misc_feature: Ceres CLONE 1378214-F
  misc_feature (5)..(130): Pfam Name: Ribosomal_S8 Pfam Description: Ribosomal protein S8
  misc_feature (114)..(114): Xaa is any aa, unknown, or other
  misc_feature (122)..(122): Xaa is any aa, unknown, or other
  misc_feature (142)..(142): Xaa is any aa, unknown, or other
MVRVSVLNDALKSMYNAEKIGKRQVMIRPSSKVIIKFLTVMQRHGYIGEFEYVDDHRSGKIVVELNGRLNKCGVISPRFDIGVKDIEGWTARLLPSRQFGYIVLTTSAGIMDHXEARRKSVXGKVSSFFYLRAENLLYGLPXCLTLSD

SEQ ID NO: 15445 - DNA, 638 bp, Zea mays
  misc_feature: Ceres CLONE 1378217-F
  misc_feature: Encodes the peptide sequence at SEQ ID NO. 15446
  misc_feature (425)..(425): n is a, c, t, g, unknown, or other
  misc_feature (440)..(440): n is a, c, t, g, unknown, or other
  misc_feature (453)..(453): n is a, c, t, g, unknown, or other
  misc_feature (512)..(512): n is a, c, t, g, unknown, or other
  misc_feature (517)..(517): n is a, c, t, g, unknown, or other
  misc_feature (610)..(610): n is a, c, t, g, unknown, or other
  misc_feature (613)..(613): n is a, c, t, g, unknown, or other
aagctggagctccccgcggtggcggccgctctagaactagtggatcccccgggctgcaggaattcgcacgagaccattacctagaacatcctaatcgaaaaaacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattgncacaaaacatcaggncacaacaactacnacaacttgtgctagcaaaccttgctgcctactctcagcaacatcagttttcttccattncaccnactagctgcattgaactctgcttctttatttgcacaacaacactacccattcagcagctatctgctgcctacccccagcaatttcttccattncancaactgacagcattgaactctcctg

SEQ ID NO: 15446 - protein, 161 aa, Zea mays
  misc_feature: Ceres CLONE 1378217-F
  misc_feature (91)..(91): Xaa is any aa, unknown, or other
  misc_feature (96)..(96): Xaa is any aa, unknown, or other
  misc_feature (100)..(100): Xaa is any aa, unknown, or other
  misc_feature (120)..(120): Xaa is any aa, unknown, or other
  misc_feature (152)..(152): Xaa is any aa, unknown, or other
  misc_feature (153)..(153): Xaa is any aa, unknown, or other
MAAKIFCLLMLLGLSASAATATIFPQCSQAPIASLLPSYLSPAVSSVCENPILQPYRIQQAIAAGILPLSPLFLQQSSALLQQLPLVHLLXQNIRXQQLXQLVLANLAAYSQQHQFSSIXPTSCIELCFFICTTTLPIQQLSAAYPQQFLPXXQLTALNSP

SEQ ID NO: 15447 - DNA, 632 bp, Zea mays
  misc_feature: Ceres CLONE 1378219-F
  misc_feature: Translation starting site: 196
  misc_feature (432)..(432): n is a, c, t, g, unknown, or other
  misc_feature (515)..(515): n is a, c, t, g, unknown, or other
  misc_feature (564)..(564): n is a, c, t, g, unknown, or other
tggagctccccgcggtggcggccgctctagaactagtggatcccccgggctgcaggaattcgcacgagaccattacctagaacatcctaatcgaaaactcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggactgancagacctaccctgctgggttcatggatgtcatttccatccctaagacaatggagaactacaggctgctttatgacaccaaggnccgcttccgtcttcaccaatcagggatgaggatgccaagttcagctctngcaggtgaggtcccgttcagtttggccagaagggcatcccctacctgaacacctacgacggccgtacc

SEQ ID NO: 15448 - DNA, 634 bp, Zea mays
  misc_feature: Ceres CLONE 1378221-F
  misc_feature: Translation starting site: 164
  misc_feature: Pfam Name: Inositol_P Pfam Description: Inositol monophosphatase family
  misc_feature: SWISSPROT Homolog: EC 3.1.3.7 3'(2'),5'-bisphosphate nucleotidase
  misc_feature (384)..(384): n is a, c, t, g, unknown, or other
  misc_feature (405)..(405): n is a, c, t, g, unknown, or other
aagctggagctccccgcggtggcggccgctctagaactagtggatcccccgggctgcaggaattcgcacgagaccattacctagaacatcctaatcgaaaaacgcctcctcctccgcctcccgctcctgccgcgcgtcgccgcgttttgtcgcagtccgcgccatggcttcggggaacccctacgccgccgagctcgccgccgccaagaaggccgtcaccctcgccgccaaactctgccagacagttcaacaggatattatgcattctggcgttcaggctaaggcagacaaaagtcctgtcacagtggctgattatggatctcaaatattggtcggtttttccttaaagatggatgtatcatctggaccattttcattggtggnctgagaggactcagatgattngagaaaagatggcgctgaagaaattttggaagatattactgacccttgtcatgaaaccatctttgatgatggttcatataacatttcgtttacaaaggaaggtatactctctggcattgatgatgggaagtctgagggaggtcatctggacgacattgggtgcttgatccgattgacggtactaaaggtttcttgaggggcgacaatatgccattggcattgctctgct

SEQ ID NO: 15449 - DNA, 640 bp, Zea mays
  misc_feature: Ceres CLONE 1378226-F
  misc_feature: Translation starting site: 312
  misc_feature: SWISSPROT Homolog: EC 3.6.3.14 H(+)-transporting two-sector ATPase
  misc_feature (486)..(486): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaaaaaaacagtacttgtcccgccccacgtcgcagcgccgtgtccctctcgccttcttccccaccccaccctaccctggcacccacgcgctcttcagatcagatcggcaaggccaatcccgagcagtggtgcgaaacctcgagcgctcgcgccggtgaccataacaaagaggaagccgcggtagcactggtagcggcagcagtaagggggagatgtcgtcggcgttcagcggcgatgagaccgcccctttcttcggcttccttggcgcctccgctgcgctcgtcttctcatgcatgggggcggcgtacgggacagccaagagtggcgtcggcgtggcgtccatgggtgtcatgcgcccagagctcgtcatgaagtccatcgtgcccngtggtcatggctggtgtgctcggtatctacggcctcatcatcgccgtcatcatcagcactgggatcaaccccaaggccaagccatacntacctctttgacggctatgcccacctgtcgtctgcccttgcctgggggcctttgctgggcttgctg

SEQ ID NO: 15450 - DNA, 634 bp, Zea mays
  misc_feature: Ceres CLONE 1378229-F
  misc_feature: Encodes the peptide sequence at SEQ ID NO. 15451
  misc_feature (377)..(377): n is a, c, t, g, unknown, or other
  misc_feature (378)..(378): n is a, c, t, g, unknown, or other
  misc_feature (513)..(513): n is a, c, t, g, unknown, or other
  misc_feature (568)..(568): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (609)..(609): n is a, c, t, g, unknown, or other
aaagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgnncgggtgtgggcagccgagcgccatgttccagccgctccggcaacagtgctgccagagaagatggaggatgatgggacgtgcagtccgtcgcgcacagctgcagatgatgatgcaagcttgagcgtgccgctgccngcagcagcagcctgtacgagccagctctgatgcagcagcagcagcagctgctggncagcccagggctcacccatggnnncatgatggatggcgcanaaatgccgccccaggggtggaactc

SEQ ID NO: 15451 - protein, 125 aa, Zea mays
  misc_feature: Ceres CLONE 1378229-F
  misc_feature (71)..(71): Xaa is any aa, unknown, or other
MKMVIVLVVCLALSAASASAMQMPCPCAGLQGLYGAGAGLTTMMGAGGLYPYAEYLRQPQCSPLAAAPYYXRVWAAERHVPAAPATVLPEKMEDDGTCSPSRTAADDDASLSVPLPAAAACTSQL

SEQ ID NO: 15452 - DNA, 601 bp, Zea mays
  misc_feature: Ceres CLONE 1378231-F
  misc_feature: Encodes the peptide sequence at SEQ ID NO. 15453
  misc_feature (452)..(452): n is a, c, t, g, unknown, or other
aagctggagctccccgcggtggcggccgctctagaactagtggatcccccgggctgcaggaattcgcacgagaccattacctagaacatcctaatcgaaaaatcatcattcaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactaaacgccgggtgtgggcagccgagcgccatgttccagccgctccggcaacagtgctgccagcagcagattgaggatgttnggacgtgcagttcgtcgcgcagcagctgcagatgatgatgcaagcttgagcgtgccgctgccgccagcagcagcctgtacgagccagctctgatgcagcagcagcagcagctgctggcagcccaggtctcacccatggcgccatgatgg

SEQ ID NO: 15453 - protein, 69 aa, Zea mays; identical to SEQ ID NO: 13934
  misc_feature: Ceres CLONE 1378231-F

SEQ ID NO: 15454 - DNA, 637 bp, Zea mays
  misc_feature: Ceres CLONE 1378232-F
  misc_feature: Encodes the peptide sequence at SEQ ID NO. 15455
  misc_feature (527)..(527): n is a, c, t, g, unknown, or other
  misc_feature (584)..(584): n is a, c, t, g, unknown, or other
aaagctggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtgggatgggcgtctacaacatcgaccccaagcgcgccatggagcttccggccaagtgcggcctcgccacgccgcccgactggctagcagtgtgctagccaagccaagncaaagcaggaaggcccccggattgctagctgggacggggtctgtgtgtgatctgcancaggtggcaggcaggggccccccgaacgtaacgtgtctctttctctctctcat

SEQ ID NO: 15455 - protein, 160 aa, Zea mays
  misc_feature: Ceres CLONE 1378232-F
  misc_feature (124)..(124): Xaa is any aa, unknown, or other
  misc_feature (143)..(143): Xaa is any aa, unknown, or other
MAATSSKSSSSSSSAQRAAAALLVAAAVAVSVLVVGAAAVCDMSNEQFMSCQPAAAKTTDPPAAPSQACCDALAGADLKCLCGYKNSPWDGRLQHRPQARHGASGQVRPRHAARLASSVLAKPXQSRKAPGLLAGTGSVCDLXQVAGRGPPNVTCLFLSL

SEQ ID NO: 15456 - DNA, 632 bp, Zea mays
  misc_feature: Ceres CLONE 1378233-F
  misc_feature: Translation starting site: 201
  misc_feature: SWISSPROT Homolog: EC 3.2.1.39 Glucan endo-1,3-beta-D-glucosidase
  misc_feature (331)..(331): n is a, c, t, g, unknown, or other
  misc_feature (379)..(379): n is a, c, t, g, unknown, or other
aagctggagctccccgcggtggcggccgctctagaactagtggatcccccgggctgcaggaattcgcacgagaccattacctagaacatcctaatcgaaaaacaccgagctgtgcccatcgcgcacacacacacacacacacacactctctctcccaccgttcacggtccagtccagagagctcaagagctcctgcagccatggcggttcccctgcttctcctcctcctgctgtccgtgttcacagcctcagatgcggcgttctgcgtgtgcaagccgggcatgtccgaacagatgatgcagtcggccatcgactactcctgcagcaaggnggccgactgcgcctccacaccaagggcgcgccgtgctacgacaacggnaaacaagtgggcgtctgctcctacatctggaacaggtactaccagagccgcagcggaatgagcgccacctgcgaattcagcggcgtcgccaccctcacagggaccgaccccggttcggggacctggaaagtcgcctccgggcccaacaagggtaggccccgggggggggggctggtatggggacggggggagaggcgctgagcgcagggggaggaacggggggccggacctggccgggaggggggcccccccg

SEQ ID NO: 15457 - DNA, 615 bp, Zea mays
  misc_feature: Ceres CLONE 1378235-F
  misc_feature: Encodes the peptide sequence at SEQ ID NO. 15458
  misc_feature (306)..(306): n is a, c, t, g, unknown, or other
aagctggagctccccgcggtggcggccgctctagaactagtggatcccccgggctgcaggaattcgcacgagaccattacctagaacatcctaatcgaaaaacaaggctaggcacaagcgaaccaaacccatggcgtccgacggcagcggcgtggtgacggtgtacggcagcaacggcgcggagctgctggagccgtccaagcagcccaagtcggtgactttctccgtcaaggtggggctggcgcagatgctccggggcgggatcatcatggacgtggtgaccccggagcacgcgcgcctcgcggnagaagccgtcgcgtgcgccgtgatggcgctgtagcgggtcccccgccgacatccgctcgcaggacgacatggagagcatgtacgtacccgtgcctcatccgtcgacatcaagcgcgccggtcaccatccccgggccattgggcccaaagggcccgccattcggggggaaatttttttggggggggaggccccaaaattctccgggggggggggggggggggctccccccctctctttgggaaaaaaaaaagggggtgttttcccccccccccgaaaaaaggggcccacacctattaaagaggccccttt

SEQ ID NO: 15458 - protein, 69 aa, Zea mays
  misc_feature: Ceres CLONE 1378235-F
  misc_feature (59)..(59): Xaa is any aa, unknown, or other
MASDGSGVVTVYGSNGAELLEPSKQPKSVTFSVKVGLAQMLRGGIIMDVVTPEHARLAXEAVACAVMAL

SEQ ID NO: 15459 - DNA, 653 bp, Zea mays
  misc_feature: Ceres CLONE 1378236-F
  misc_feature: Translation starting site: 227
  misc_feature: SWISSPROT Homolog: EC 1.1.1.1 Alcohol dehydrogenase
aaagctggagctccccgcggtggcggccgctctagaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatggaggaggtggaggtcgccccgccggggcccatggagatccgtgtcaaggtcgtctccacctccgtctgccgcagcgacgtcactgcctggcaatccaagctgagagcctgagacaaacgatctctctgatcgaatttgctcatctgtgttctcttccaattccaacatgcaggcgcaacttgatctgttccccagagtcttcggccacgaggcatccggagtaagtaaagagtgtcgggtgaaggtgtgaccgagttcccaagtcgggtgaccacgttctcactggtctccattgggggattgcaagagctgcaagcactgcgttctcagggaagag

SEQ ID NO: 15460 - DNA, 653 bp, Zea mays
  misc_feature: Ceres CLONE 1378240-F
  misc_feature: Encodes the peptide sequence at SEQ ID NO. 15461
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (537)..(537): n is a, c, t, g, unknown, or other
  misc_feature (542)..(542): n is a, c, t, g, unknown, or other
  misc_feature (605)..(605): n is a, c, t, g, unknown, or other
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctaacttcctggtgttcgcatccggcccnnnnttgttggggncgcgncgtcccaacctgggcgggcgtgcaccacgtgcgcgcctggcgccacgacagcctggccacaangggccgcgtcgtcgctcatcgcctgggccatcacgggctcgccccttn

SEQ ID NO: 15461 - protein, 51 aa, Zea mays
  misc_feature: Ceres CLONE 1378240-F
MAGIGRNMVAPLLVLNLIMYIIVIGFASWNLNHFINGQTNYPGVAGNGATF

SEQ ID NO: 15462 - DNA, 603 bp, Zea mays
  misc_feature: Ceres CLONE 1378241-F
  misc_feature (206)..(206): n is a, c, t, g, unknown, or other
  misc_feature (216)..(216): n is a, c, t, g, unknown, or other
  misc_feature (253)..(253): n is a, c, t, g, unknown, or other
  misc_feature (260)..(260): n is a, c, t, g, unknown, or other
aaagctggagctccccgcggtggcggccgctctagaactagtggatcccccgggctgcaggaattcgcacgagaccattacctagaacatcctaatcgaaaatcaccaccactgggtcttcagaccattagctttatctactccagagcgcagaagaacccgatcgacaccatgagggtggtgctcggtgccctcgttctcctggntctcgctgcnagggccacctccaggcttaacaagggggggtggcggnttggcancccccggcgccgggttcatttaacggcggccgggggatttggcacttcccgggtacccgcgacctccggggggatttccccaccgccggtgacctggggggcggccggttacctgtcaacccccggccatgttggggccccccgttttattttcgcccggccccttgggttattctattttactgggcccgcgggggtaattttttttccccggaaacccttgtggtgggggaaaaaagggtttcaaaaccctgcgaaatttttggaacctccccgggggtgggagaaacccccatcctggcgcgggggggggggaattccttgtgggttaatttttgccccc

SEQ ID NO: 15463 - DNA, 660 bp, Zea mays
  misc_feature: Ceres CLONE 1378247-F
  misc_feature: Encodes the peptide sequence at SEQ ID NO. 15464
  misc_feature (442)..(442): n is a, c, t, g, unknown, or other
  misc_feature (479)..(479): n is a, c, t, g, unknown, or other
  misc_feature (480)..(480): n is a, c, t, g, unknown, or other
  misc_feature (595)..(595): n is a, c, t, g, unknown, or other
  misc_feature (607)..(607): n is a, c, t, g, unknown, or other
  misc_feature (626)..(626): n is a, c, t, g, unknown, or other
  misc_feature (627)..(627): n is a, c, t, g, unknown, or other
aaagctggagctccccgcggtggcggccgctctagaactagtggatcccccgggctgcaggaattcgcacgagaccattacctagaacatcctaatcgaaaaacacaaacaagaagcttgcattgttcgctgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgnaggctggcaggctaaagggctccacgctccttaccgnnaaagagtggtgacggatggggatccgatgaatgggcaatctacgggggaaccccggagagtttgctatgggcgaaagaggtgtcgttcaaaagaaggtaccttgcccgatagggnaacggcgccggnaaacactgacgagttcagnncatggcagtttctttcggcccccgggtgtttgg

SEQ ID NO: 15464 - protein, 170 aa, Zea mays
  misc_feature: Ceres CLONE 1378247-F
  misc_feature (98)..(98): Xaa is any aa, unknown, or other
  misc_feature (111)..(111): Xaa is any aa, unknown, or other
  misc_feature (149)..(149): Xaa is any aa, unknown, or other
  misc_feature (153)..(153): Xaa is any aa, unknown, or other
  misc_feature (159)..(159): Xaa is any aa, unknown, or other
  misc_feature (160)..(160): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFXGWQAKGLHAPYRXRVVTDGDPMNGQSTGEPRRVCYGRKRCRSKEGTLPDRXTAPXNTDEFXXWQFLSAPGCL

SEQ ID NO: 15465 - DNA, 594 bp, Zea mays
  misc_feature: Ceres CLONE 1378248-F
  misc_feature: Encodes the peptide sequence at SEQ ID NO. 15466
  misc_feature (298)..(298): n is a, c, t, g, unknown, or other
  misc_feature (299)..(299): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttccccatacccttcatcaaatatagnncttcatatggtgaaaacccagcttctcaaccatataggcttcaacaagaaatcggaagaaggaaaaatacctttatcggcctgggggtctaacacccccacccatattttgggggggcttggggaaaacccttgggggaaaaaggtggggaaattcggggaacccttaaaaaaaaaaaggattttgggaaaattttccccccatttcaaaaaaaaaaaatttttttttttacaaaaagggttacaaaagaacccgggggttttttttgggcaaaaaaaaaaattcttttttgggg

SEQ ID NO: 15466 - protein, 43 aa, Zea mays
  misc_feature: Ceres CLONE 1378248-F
MATKIFSLLMLLALSTCVANATIFPQCSQAPIASLLPHTLHQI

SEQ ID NO: 15467 - DNA, 650 bp, Zea mays
  misc_feature: Ceres CLONE 1378255-F
  misc_feature: Encodes the peptide sequence at SEQ ID NO. 15468
  misc_feature (447)..(447): n is a, c, t, g, unknown, or other
  misc_feature (448)..(448): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaagaattcccctgcgcctctcacctccctgctcgaatccagcgctcacccgcgccgcgtcgagacatgtcgaagaaaatcgtggtgaagctggacctgcacgacaacaaggacaagcagaaggcgctgaaggccatctccgtgctcgtcggcatcgacgccgtgtcggtggacatggcggcgcacaagatgacggtgatcgggacggtggacccggtgcaggtggtgagcaagctgcgcagcaagtcgtgggcggcgcacatcgactccgtcgggccggccaaggagcccgagaagaaggaggagaagaaggacggcggcggcgagaagaaggacggcggcggtgcnnaagggcaagaaggaggaaggggacggnaagaaggacggcggcggcggtggcgacggcaagaaagacggcgagggcaagaaggaggacggcgacggcaagaagcaggacggcgagggcaagaaggaggatggcgatggcaagaaggacgacagagggacacgcggcgggcggcggcgcaaaagagaagaagcccgccgccgcg

SEQ ID NO: 15468 - protein, 161 aa, Zea mays
  misc_feature: Ceres CLONE 1378255-F
  misc_feature (95)..(95): Xaa is any aa, unknown, or other
  misc_feature (104)..(104): Xaa is any aa, unknown, or other
MSKKIVVKLDLHDNKDKQKALKAISVLVGIDAVSVDMAAHKMTVIGTVDPVQVVSKLRSKSWAAHIDSVGPAKEPEKKEEKKDGGGEKKDGGGAXGQEGGRGRXEGRRRRWRRQERRRGQEGGRRRQEAGRRGQEGGWRWQEGRQRDTRRAAAQKRRSPPP

SEQ ID NO: 15469 - DNA, 633 bp, Zea mays
  misc_feature: Ceres CLONE 1378261-F
  misc_feature: Encodes the peptide sequence at SEQ ID NO. 15470
  misc_feature (371)..(371): n is a, c, t, g, unknown, or other
  misc_feature (454)..(454): n is a, c, t, g, unknown, or other
aaagctggagctccccgcggtggcggccgctctagaactagtggatcccccgggctgcaggaattcgcacgagaccattacctagaacatcctaatcgaaaaaactcgccgtctgccttctgcgcctccatttcggcctctgtcccttgcaagttcaatctcacctcccaccatgggtaaagagaagtcccacatcaacattgtggttattggccatgtcgactctggcaagtcgaccaccacagggacaccttatctacaagcttggaggcattgacaagcgtgtgatcgagagggtcgagaaggaggctgctgaaatgaacaagcggtccttcaagtacgcgtgggtgctcgacaagctcaaggctgancgtcacaccagtatcaccatggatatcgctctgtggaagtttggagacaccaagtactactgcacggtcattgatgcccctgnacaccgtgactcatcaagaacatgatcactggtacctcccagctgactgtgctgtccttatcattgactccacactggtggttttgaggttggtatcttcaagatggccagacccgggaacatgctctcctggggtcacccttggagtgagcaaatgatttgtgctgcaacaaaaggag

SEQ ID NO: 15470 - protein, 87 aa, Zea mays
  misc_feature: Ceres CLONE 1378261-F
  misc_feature (52)..(52): Xaa is any aa, unknown, or other
  misc_feature (80)..(80): Xaa is any aa, unknown, or other
MSTLASRPPQGHLIYKLGGIDKRVIERVEKEAAEMNKRSFKYAWVLDKLKAXRHTSITMDIALWKFGDTKYYCTVIDAPXHRDSSRT

SEQ ID NO: 15471 - DNA, 625 bp, Zea mays
  misc_feature: Ceres CLONE 1378265-F
  misc_feature: Encodes the peptide sequence at SEQ ID NO. 15472
  misc_feature (230)..(230): n is a, c, t, g, unknown, or other
  misc_feature (305)..(305): n is a, c, t, g, unknown, or other
  misc_feature (313)..(313): n is a, c, t, g, unknown, or other
  misc_feature (318)..(318): n is a, c, t, g, unknown, or other
  misc_feature (434)..(434): n is a, c, t, g, unknown, or other
  misc_feature (451)..(451): n is a, c, t, g, unknown, or other
  misc_feature (454)..(454): n is a, c, t, g, unknown, or other
  misc_feature (625)..(625): n is a, c, t, g, unknown, or other
aaagctggagctcaccgcggtggcggccgctctagaatagtggtcccccgggctgcaggattcgcacgagacattacctagaaatcctaatcgaaaaatttcactttccttctctcctctcctcctgctgctactaggttcgggccgtccgtccttgctcttgatctgcattatttaattcggaccattcccccgccgtcctcccgcccgcctgccggagatggagatgnagaaacgggcacgcaagtaccgggtgggcgtcatgggcagcggcaactggggcagcgtcgcctcccgcctcatcngctccaancacgncaagctgccctccttctatgatgaagtaaggatgtgggtgttttgagaaatactgcctacaggcaggaagctatctgagtccattaacgaacagaatgagaactgcaaatacttgnccaggtataaagcttgnaancgaaatgtattgccgaccctgacttggagagcgcagtcaaagacgcgaatatgctggtttttgtgacccccatcattttgtggagggtatatgtaggaagcttgtagggaagctaacacaggagctggagctatctccctcatcaagggcatggaggtcaaaatgaaggcn

SEQ ID NO: 15472 - protein, 47 aa, Zea mays
  misc_feature: Ceres CLONE 1378265-F
  misc_feature: SWISSPROT Homolog: EC 1.1.1.8 Glycerol-3-phosphate dehydrogenase (NAD(+))
  misc_feature (4)..(4): Xaa is any aa, unknown, or other
  misc_feature (29)..(29): Xaa is any aa, unknown, or other
  misc_feature (31)..(31): Xaa is any aa, unknown, or other
  misc_feature (33)..(33): Xaa is any aa, unknown, or other
MEMXKRARKYRVGVMGSGNWGSVASRLIXSXHXKLPSFYDEVRMWVF

SEQ ID NO: 15473 - DNA, 636 bp, Zea mays
  misc_feature: Ceres CLONE 1378270-F
  misc_feature (303)..(303): n is a, c, t, g, unknown, or other
  misc_feature (368)..(368): n is a, c, t, g, unknown, or other
aagctggagctccccgcggtggcggccgctctataactagtggatcccccgggctgcaggaattcgcacgagaccattacctagaacatcctaatcgaaaaaacaattcggtttcttgggtggtttttttttcttgcttgctcggtttcttgtggggcgggccgcgaaccggcgaggcgggggcgcgaggcaacgcaaagcagcgcagcgcagcgcagtgcagcaaaagcttcgatctttatccgccggattcctctcctcccctttcctctctctccgtctccccgcttgctttgtgcttcnttgttgagaggaggggagaggagaggagacccacatccacttgcctttctcctctctcctctcgnagcccccctttcaactcctcctgggtcctggaaaaaaaggagacttttggtgcaggattcgatctgctgtggctgcctcggccttgctgcggggcgcggagattgggttcttgggctgcggctggcccccgcggcaattggacctctttgatccaccggttcaaattggaccggaaagggccggtctctgggccaggttctgcctccccgggggtttccggccccctctttggggggggggggggggggcccccccgaaccggtttct

SEQ ID NO: 15474 - DNA, 641 bp, Zea mays
  misc_feature: Ceres CLONE 1378271-F
  misc_feature: Translation starting site: 156
  misc_feature (540)..(540): n is a, c, t, g, unknown, or other
  misc_feature (567)..(567): n is a, c, t, g, unknown, or other
  misc_feature (572)..(572): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctcatcggcgtggagtacatcgtggtcgaggaagatcttcgactcgctgccggcggaggagcagcggctgtggcactcgcacgcgcacganatcaagtcaggcctgtggacgagccgncacgntggcgggctgctggagaaggcggagctggacccatggccgcaccgtcggcaagttctggggcacctggn

SEQ ID NO: 15475 - DNA, 665 bp, Zea mays
  misc_feature: Ceres CLONE 1378273-F
  misc_feature: Encodes the peptide sequence at SEQ ID NO. 15476
  misc_feature (370)..(370): n is a, c, t, g, unknown, or other
aaagctggagctccccgcggtggcggccgctctagatctagtggatcccccgggctgcaggaattcgcacgagaccattacctagaacatactaatcgaaaaatccgcactctgaccggtgctacctccaagctgagcccgctcccagactcccagtcccctccgcattccgcaccgccgcctcgccatggaggcagctgccgccgccttcttgtcccctccccgcgtcgccctcgacgcccgcacactcttctccccgccccgttgcctccccgtctcgccctcatcccagctccgccttgctgctcggccccgcgcgctcgccggcgccaagccgcggttcctgagcccccatcgagaacccgccgtncgacgcggtcgcggcgccagggatgtcgtcgcgatggtggtgccgttccctgagggggccgcgtgggagcagccaccgcggacttggctcattcctatacaagaacggatcgtggacttggggatggggctcgtcccgcgggccagggactcatgctcgccgagttcccctaccctcagatggccgcccccgaaagcccaacaacgggaacttcaatccccctgggaccccccaaaatgggaaagaatttgtttttagaaaacaaaccctttgggcaaattgtgggcttgggggg

SEQ ID NO: 15476 - protein, 146 aa, Zea mays
  misc_feature: Ceres CLONE 1378273-F
MEAAAAAFLSPPRVALDARTLFSPPRCLPVSPSSQLRLAARPRALAGAKPRFLSPHREPAVRRGRGARDVVAMVVPFPEGAAWEQPPRTWLIPIQERIVDLGMGLVPRARDSCSPSSPTLRWPPPKAQQRELQSPWDPPKWERICF

SEQ ID NO: 15477 - DNA, 622 bp, Zea mays
  misc_feature: Ceres CLONE 1378278-F
  misc_feature: Encodes the peptide sequence at SEQ ID NO. 15478
  misc_feature (465)..(465): n is a, c, t, g, unknown, or other
  misc_feature (591)..(591): n is a, c, t, g, unknown, or other
aaagctggagctccccgcggtggcggccgctctagaactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcggttgctgaggtgctccggccttctcctgccctccgcgtatcggaggatggaaagaagattgntagagctagtgaactcttgaagccagatgagatcatagaaacagtagactctaggactattgctgtatctccgctgccttttgcatgtaagcaggaagacgtccaatcttttttcacaattatgcnaaggtaaatagcgtgagacttcccacgcata

SEQ ID NO: 15478 - protein, 145 aa, Zea mays
  misc_feature: Ceres CLONE 1378278-F
  misc_feature (17)..(89): Pfam Name: La Pfam Description: La domain
  misc_feature (102)..(102): Xaa is any aa, unknown, or other
  misc_feature (144)..(144): Xaa is any aa, unknown, or other
MAAPAAAPLDEGKAKKVLRQVEFYFSDSNLPRDKFLRETVEQSDDGLVSLPLICSFSRMKSHLGLDADVKPETVPEETVLAVAEVLRPSPALRVSEDGKKIXRASELLKPDEIIETVDSRTIAVSPLPFACKQEDVQSFFTIMXR

SEQ ID NO: 15479 - DNA, 673 bp, Zea mays
  misc_feature: Ceres CLONE 1378301-F
  misc_feature: Translation starting site: 258
  misc_feature (477)..(477): n is a, c, t, g, unknown, or other
  misc_feature (518)..(518): n is a, c, t, g, unknown, or other
  misc_feature (570)..(570): n is a, c, t, g, unknown, or other
  misc_feature (615)..(615): n is a, c, t, g, unknown, or other
tggagctccccgcggtggcggccgctctagaactagtggatcccccgggctgcaggaattcgcacgagaccattacctagaacatcctaatcgaaaaataggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattggaagaaggagttcagctacagcaagatcctcaaagatttcaagaaagagttctgctgcaatggntacagtggtccaggacccagaaacttggacaggtcattcangctccagggtgatcagaaggaagaacgtctcgaatttcctcgtccaggccgncattttgtgaagaaggagcacatcaagaatccatggtttctgagncaacggccgggtccatagcaaaccaacccctgcatgcagggccagcttattatatata

SEQ ID NO: 15480 - DNA, 591 bp, Zea mays
  misc_feature: Ceres CLONE 1378305-F
  misc_feature (498)..(498): n is a, c, t, g, unknown, or other
ggagctccccgcggtggcggccgctctagaactagtggatcccccgggctgcaggaattcgcacgagaccattacctagaacatcctaatcgaaaatcaccaccactgggtcttcagaccattagctttatctactccagagcgcagaagaacccgatccgacaccatggagggtggttggtccggtggccctccgtcccccgggggctcccgggggggggggccccccccccccccgataaaaaaccgcggggtttgtggcttttcaccccccccccccccgggcgggtatttttttcttcccccgccccgggggggggattctgccacccccccccggggatatcgggcggccgcccccccggggggggggtacctcccccccgcgcgggggtactctatcgggggggggggggcggggaatctacccccctaccgcccgggacccgcagtgggggggcggccgccgcccttttttttttttcttgccgccccccncgggcgggccgctcccccccccccacccccccgcggggcggggcgcgcggcccacttttctccttccctcccccccccccagcccccctaggg

SEQ ID NO: 15481 - DNA, 676 bp, Zea mays
  misc_feature: Ceres CLONE 1378306-F
  misc_feature: Encodes the peptide sequence at SEQ ID NO. 15482
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcacaacaactaccacagttg

SEQ ID NO: 15482 - protein, 172 aa, Zea mays
  misc_feature: Ceres CLONE 1378306-F
MAAKIFCLLMLLGLSASAATATIFPQCSQAPIASLLPPYLSPVVSSVCQNPILEPYRIQQAIAAGILPLSPLFLQQSSALLQQLPLVHLLAQNIRAQQLQQLVLANLAAYSQQQQFLPFNQLAALNSASYLQQQQLPFSQLPAAYPQQFLPFNQLAALNSPAYLQQHNNYHS

SEQ ID NO: 15483 - DNA, 710 bp, Zea mays
  misc_feature: Ceres CLONE 1378308-F
  misc_feature: Encodes the peptide sequence at SEQ ID NO. 15484
  misc_feature (480)..(480): n is a, c, t, g, unknown, or other
  misc_feature (657)..(657): n is a, c, t, g, unknown, or other
  misc_feature (658)..(658): n is a, c, t, g, unknown, or other
ggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgagcggcaccagcaagctgacgcgggcgaggacggcgacagcggcgtggacgcctacgtctcccgctccggnaaggggcgagtgccggcgccagtgcctgcgccgccacgagggccagccgtgggagacccaggagtgcatgaggcggtgccgccgccgcggactggccgtcgaatggagccaagagtacggtcgcggcagcgagagcgcgggcagtggcccgggagaggtgcgagcgccccaccgcgnnggactgggtggaagaggcagcgctgcctgatgactgcaaaaaaccgggaggg

SEQ ID NO: 15484 - protein, 73 aa, Zea mays; identical to SEQ ID NO: 14723
  misc_feature: Ceres CLONE 1378308-F

SEQ ID NO: 15485 - DNA, 810 bp, Zea mays
  misc_feature: Ceres CLONE 1378309-F
  misc_feature: Encodes the peptide sequence at SEQ ID NO. 15486
  misc_feature (810)..(810): n is a, c, t, g, unknown, or other
attccacaaaaataatacaattttttcctccatgtccctaagttaaaaaaaactggagctccccgcggtggcggccgctctagaactagtggatcccccgggctgcaggaattcgcacgagaccattacctagaacatcctaatcgaaaacacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggagaagaaggacgacgcggtggtgcagccgcagaccttcccgcccttcgaccgcctcggcggcggcgcgtccccggcgttcggcggcctcccccggcggcagcattcctggcagcagcattccccgggttcagcatgcccggcagcggcagcagcctacccgggttcagcttgcccggcagcggcagcatgcccctcttcggcggcggctcccccgggcttcagcgggtttcggcggcaatgccccgggaccccccaccgccgggctccgtcccccgaagcaccgccaaaaaagccccggaaccgcccatacaagccgagggttagtaagaaaggggcgcgctaacagtttaacctggtaagaaacccgccgctcagtgctttccaatgcan

SEQ ID NO: 15486 - protein, 147 aa, Zea mays
  misc_feature: Ceres CLONE 1378309-F
MARSSKMMVAAALLALALAVSIAEARNIKTTTTEKKDDAVVQPQTFPPFDRLGGGASPAFGGLPRRQHSWQQHSPGSACPAAAAAYPGSACPAAAACPSSAAAPPGFSGFRRQCPGTPHRRAPSPEAPPKKPRNRPYKPRVSKKGAR

SEQ ID NO: 15487 - DNA, 749 bp, Zea mays
  misc_feature: Ceres CLONE 1378316-F
  misc_feature: Encodes the peptide sequence at SEQ ID NO. 15488
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
ccccacctttnnnnnnnntnnnaggtcaccncannnnnnnnttaaagctggagctccaccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagcacagtgtttagggtgatgaacagtgacacactgacacgctatatctggggaaaaaaaaaaaaaggggccccaacccccaagggggggcggttataaggggcccccgccggggccccaaaaaaaaaagtgggtggggggagcggcccaaaaataaaaacccccccccccccccgccaaccaaaaatatg

SEQ ID NO: 15488 - protein, 61 aa, Zea mays
  misc_feature: Ceres CLONE 1378316-F
MSHFAAAAVKSPLAVAAPAAGDAKSPLFCPKPRRPAAPLRCHQGGDAGMDLLDLLLSKHSV

SEQ ID NO: 15489 - DNA, 689 bp, Zea mays
  misc_feature: Ceres CLONE 1378319-F
  misc_feature: Encodes the peptide sequence at SEQ ID NO. 15490
  misc_feature (335)..(335): n is a, c, t, g, unknown, or other
  misc_feature (368)..(368): n is a, c, t, g, unknown, or other
  misc_feature (399)..(399): n is a, c, t, g, unknown, or other
  misc_feature (418)..(418): n is a, c, t, g, unknown, or other
  misc_feature (426)..(426): n is a, c, t, g, unknown, or other
  misc_feature (482)..(482): n is a, c, t, g, unknown, or other
aagctggagctccccgcggtggcggccgctctagaactagtggatcccccgggctgcaggaattcgcacgagaccattacctagaacatcctaatcgaaaattctctcccctgagcctgactggaaccttcccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatngctccggggcggggtcatcatggacgtggtggnccccggagcagggccgcctccgcggaggagngccggcgcgtgcgccgtgnatggcggntgggagcgggtccccgccgacatccgcgcgcaggggcggcgtggggcgccatgtcngcacccgggcctcaaccgcgacatcaaatggggccgtcaccctcccggggcatggacaaagccccgcctcggttacctccccggacagacacaattcctggagaggctggggcgcgcgatactagggacgatcagccggtcggatccaccccacccgtccgtgattagcccacatgtattcatcacttctatctccaatcactctcg

SEQ ID NO: 15490 - protein, 144 aa, Zea mays
  misc_feature: Ceres CLONE 1378319-F
  misc_feature (40)..(40): Xaa is any aa, unknown, or other
  misc_feature (62)..(62): Xaa is any aa, unknown, or other
  misc_feature (68)..(68): Xaa is any aa, unknown, or other
  misc_feature (71)..(71): Xaa is any aa, unknown, or other
MASDGSGVVTVYGSNGAELLEPSKQPKSATFSVKVGLAQXAPGRGHHGRGGPRSRAASAEEXRRVRRXWRXGAGPRRHPRAGAAWGAMSAPGPQPRHQMGPSPSRGMDKAPPRLPPRTDTIPGEAGARDTRDDQPVGSTPPVRD

SEQ ID NO: 15491 - DNA, 708 bp, Zea mays
  misc_feature: Ceres CLONE 1378324-F
  misc_feature: Encodes the peptide sequence at SEQ ID NO. 15492
  misc_feature (625)..(625): n is a, c, t, g, unknown, or other
  misc_feature (687)..(687): n is a, c, t, g, unknown, or other
  misc_feature (700)..(700): n is a, c, t, g, unknown, or other
tggagctccccgcggtggcggccgctctagaactagtggatcccccgggctgcaggaattcgcacgagaccattacctagaacatcctaatcgaaaaaaaaaaccctcttctcctctgtccgagattcatacaaaaatgcttctcaaatccgcttctgctttctcgctcgtgaacatccatggaggagtcaacaaggacatctctcctctctcctcctcctcctcctcttcattgagtcttcccgtttcttcgggaaaatcaagaaacctctccttctctgtttctgcctccacgcaaaccctgagcggcgtcgttttcgagccgtttgaggaggtgaagaaggagctcgatctcgtcccttcgagtccacagctctctctcgctcgccatctatactctcccgagtgcgaagccgccgtgaacgaacagatcaatgtggagtacaacgtgtcgtatgtgtatcacgccttgtacgcttacttcgatcgtgacaacgttgctctcaaaggtcttgccaagtttttcaaggactcgcagtgtggaagagcgagaccacgctgagatgttgatggagtatcagaacaaacgtgtctgggaagggttaagttacagcccatggtgatngcctcagtctgaagtttgatcacgctgcagaaaggagatgctctctatgccatggagctggnctctgtcattggnagaagctt

SEQ ID NO: 15492 - protein, 141 aa, Zea mays
  misc_feature: Ceres CLONE 1378324-F
  misc_feature: SWISSPROT Homolog: EC 1.16.3.1 Ferroxidase
MLLKSASAFSLVNIHGGVNKDISPLSSSSSSSLSLPVSSGKSRNLSFSVSASTQTLSGVVFEPFEEVKKELDLVPSSPQLSLARHLYSPECEAAVNEQINVEYNVSYVYHALYAYFDRDNVALKGLAKFFKDSQCGRARPR

SEQ ID NO: 15493 - DNA, 663 bp, Zea mays
  misc_feature: Ceres CLONE 1378326-F
  misc_feature: Encodes the peptide sequence at SEQ ID NO. 15494
  misc_feature (663)..(663): n is a, c, t, g, unknown, or other
acagctggagctccccgcggtggcggccgctctagaactagtggatcccccgggctgcaggaattcgcacgagaccattacctagaacatcctaatcgaaaaaattccattctcggaagagaccatttccttcctcctgatctctcacggagttcctctccatggcgacgccccgctctccgagcccccgcgccgaagcgcccctcgattccgcgccgctgctgggcggtgcctccggcggcgggagccgtcgccgaggcggagcgctccgccgaccctcgctccgcggtgcggcgcagctgctgcgccgcggcggacggcgagccatgcgggagccctcggtgctggtgcgggaggcagccgcagagcacctggaggaacggcaggcggactggtcctactcccgccccgtcgtggcgctcgacctgctctggaacctcgccttcatcaccgtcgctgcggtcgtgctcgtgctcagccgcgacgaggactcgcccatgccgctccggacctgggtcgccggctacgccctgcagtgcgtcatacacatgatgtgcgccctcttctagtaccggatgcgacatgttcagcgcgaggtattcgaaggagcgcacgctgactaggtgagctataggtcgtgtagcttgaggctacagtggattn

SEQ ID NO: 15494 - protein, 135 aa, Zea mays
  misc_feature: Ceres CLONE 1378326-F
MATPRSPSPRAEAPLDSAPLLGGASGGGSRRRGGALRRPSLRGAAQLLRRGGRRAMREPSVLVREAAAEHLEERQADWSYSRPVVALDLLWNLAFITVAAVVLVLSRDEDSPMPLRTWVAGYALQCVIHMMCALF

SEQ ID NO: 15495 - DNA, 686 bp, Zea mays
  misc_feature: Ceres CLONE 1378328-F
  misc_feature: Encodes the peptide sequence at SEQ ID NO. 15496
  misc_feature (497)..(497): n is a, c, t, g, unknown, or other
  misc_feature (556)..(556): n is a, c, t, g, unknown, or other
  misc_feature (586)..(586): n is a, c, t, g, unknown, or other
  misc_feature (587)..(587): n is a, c, t, g, unknown, or other
  misc_feature (654)..(654): n is a, c, t, g, unknown, or other
  misc_feature (664)..(664): n is a, c, t, g, unknown, or other
  misc_feature (666)..(666): n is a, c, t, g, unknown, or other
tggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcggaggccagactcgcagggagcagctggggcagcagggtaccagcgagatggggaaagaagggcggtctgagcaccacgggacgagtccggcggcgagcgcgcccgccagggagggcgtcagcatcgacgagtccaagttcaccaagtatncctatcgcgtgcgtgggtacgcagcggttcgtagctggtctgcgtagtgtacctttggnccgtagctagtgctactctcctaccttggnnagtagctgaattgattaataatggtagctagcagcatgccatgtaggcgatcataccatacgtacgntacatgcaangnaaatttggggggggattcat

SEQ ID NO: 15496 - protein, 108 aa, Zea mays
  misc_feature: Ceres CLONE 1378328-F
  misc_feature (1)..(93): Pfam Name: LEA_5 Pfam Description: Small hydrophilic plant seed protein
  misc_feature (94)..(94): Xaa is any aa, unknown, or other
MASGQESRKELDRKAREGETVVPGGTGGKSVEAQEHLAEGRSRGGQTRREQLGQQGTSEMGKEGRSEHHGTSPAASAPAREGVSIDESKFTKYXYRVRGYAAVRSWSA

SEQ ID NO: 15497 - DNA, 681 bp, Zea mays
  misc_feature: Ceres CLONE 1378335-F
  misc_feature: Encodes the peptide sequence at SEQ ID NO. 15498
  misc_feature (500)..(500): n is a, c, t, g, unknown, or other
  misc_feature (509)..(509): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (538)..(538): n is a, c, t, g, unknown, or other
  misc_feature (541)..(541): n is a, c, t, g, unknown, or other
  misc_feature (542)..(542): n is a, c, t, g, unknown, or other
  misc_feature (544)..(544): n is a, c, t, g, unknown, or other
  misc_feature (548)..(548): n is a, c, t, g, unknown, or other
  misc_feature (554)..(554): n is a, c, t, g, unknown, or other
  misc_feature (557)..(557): n is a, c, t, g, unknown, or other
  misc_feature (571)..(571): n is a, c, t, g, unknown, or other
  misc_feature (580)..(580): n is a, c, t, g, unknown, or other
  misc_feature (582)..(582): n is a, c, t, g, unknown, or other
  misc_feature (600)..(600): n is a, c, t, g, unknown, or other
  misc_feature (601)..(601): n is a, c, t, g, unknown, or other
  misc_feature (611)..(611): n is a, c, t, g, unknown, or other
  misc_feature (637)..(637): n is a, c, t, g, unknown, or other
  misc_feature (670)..(670): n is a, c, t, g, unknown, or other
  misc_feature (673)..(673): n is a, c, t, g, unknown, or other
  misc_feature (675)..(675): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccgggccgccaatccccggtggtggacctctcggtgacgcggcgcgaggacctagtcgagcaggtgaggcacgcggccggggacggtgggctttcttctggctgggaaaccacggagtgccggaggagctgatgggcgcatgcctccgcggngtgcgcagnttcacaggggccccccggggaagnnnaancanncncccnaccccnagnacccccgcccgcanccggcgccncncccccaaacgcgaacccnncaaggcggcngcggccgacgggcgcgacacgccccnccggcgagggggccccaaaccccgcgccgcggnagnancnggcg

SEQ ID NO: 15498 - protein, 178 aa, Zea mays
  misc_feature: Ceres CLONE 1378335-F
  misc_feature: SWISSPROT Homolog: EC 1.14.11.20 Desacetoxyvindoline 4-hydroxylase
  misc_feature (121)..(121): Xaa is any aa, unknown, or other
  misc_feature (129)..(129): Xaa is any aa, unknown, or other
  misc_feature (130)..(130): Xaa is any aa, unknown, or other
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (137)..(137): Xaa is any aa, unknown, or other
  misc_feature (142)..(142): Xaa is any aa, unknown, or other
  misc_feature (145)..(145): Xaa is any aa, unknown, or other
  misc_feature (146)..(146): Xaa is any aa, unknown, or other
  misc_feature (152)..(152): Xaa is any aa, unknown, or other
  misc_feature (164)..(164): Xaa is any aa, unknown, or other
  misc_feature (175)..(175): Xaa is any aa, unknown, or other
  misc_feature (176)..(176): Xaa is any aa, unknown, or other
  misc_feature (177)..(177): Xaa is any aa, unknown, or other
MAPTTATKDDSGYGDERRRELQAFDDTKLGVKGLVDSGVKSIPSIFHHPPEALSDIISPAPLPPSPPSGPPIPGGGPLGDAARGPSRAGEARGRGRWAFFWLGNHGVPEELMGACLRGVRXFTGAPRGXXXXXPTPXTPARXRRXXPKREPXKAAAADGRDTPXRRGGPKPRAAXXXG

SEQ ID NO: 15499 - DNA, 717 bp, Zea mays
  misc_feature: Ceres CLONE 1378336-F
  misc_feature: Translation starting site: 256
  misc_feature (511)..(511): n is a, c, t, g, unknown, or other
ggagctccccgcggtggcggccgctctagaactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctggatttatgatcgactttatgnatgggtggagtttctgctgctgtctccaagacagctgcagctccgattgagcgtgtcaagcttttgattcagaaccaggatgaaatgctcaagactggcaggctttcgaaccgtaccaagggggtattggggactgctttggcgaaaaaaaaaaaaaaagggggggtttttgtctcactgggggagaggaaacacagctaatgtcc

SEQ ID NO: 15500 - DNA, 659 bp, Zea mays
  misc_feature: Ceres CLONE 1378342-F
  misc_feature: Encodes the peptide sequence at SEQ ID NO. 15501
aaagctggagctccccgcggtggcggccgctctagaactagtggatcccccgggctgcaggaattcgcacgagaccattacctagaacatcctaatcgaaaaaacaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccatcggcgtgtgggaagacggtcaagtccttcggtaacggcggggccctctgggatgctcgcgacctgcgtcatccagcctatcgacatggtcaagggtgaggatcccggttgggtggaggggtctgggttgttccaggtcaccagggacatgttgaaaatgaggggggggccggtcttttttacaaaggggtttgccccccgggatttgtgtagggaaaagggcgtaaaccgctggggccgccttggggacccttttagggggcctaaaaaaaaaaagggggttgggaaaaaaaggaggggggaagcccttgtcctcctatttttaaaag

SEQ ID NO: 15501 - protein, 92 aa, Zea mays
  misc_feature: Ceres CLONE 1378342-F
MLATCVIQPIDMVKGEDPGWVEGSGLFQVTRDMLKMRGGPVFFTKGFAPRDLCREKGVNRWGRLGDPFRGPKKKKGVGKKRRGEALVLLFLK

SEQ ID NO: 15502 - DNA, 770 bp, Zea mays
  misc_feature: Ceres CLONE 1378344-F
  misc_feature: Encodes the peptide sequence at SEQ ID NO. 15503
agagaattaaaaaaaaaaaaaataatattctacaaaaagagtgccgggttttttcaagctggagctcaccgcggtggcggccgctctagaatagtggatcccccgggctgcaggaattcgcacgagaccattacctagaacatcctaatcgaaaaagacacactcaaccaggggttttgctagggttctcatcctgccgccacagcgatggccgctgccgccgccggcgaggacgacgcggcgtgggagcgcgtcatctccgccgccaccaagtccacctcggcgcccaagaccctcaccctcgacggcgccggcaagtcctccacgggcggactcccctccgccgcgctcctcgagcgtttcgccgcctccctcaaggagttctccgtcgcggaggctcgcctctcctcgctcgcgggcctgacccgcctcccggcggtccggcgtctctccctccccgacgaccgtcctctcgggggacgctcgaccctcgaagactatcacccatggagtggggcgccctctgtaaccattgtcaaagtatagggacaaccagccccgcgacgaggggggggatccctccaaaccagccaccggtatcatcctttggttgcccaaggtgtctgcacgacgagctgcaccgcttgcccccactacaacccacaacggaacgcaccaacaccctacaaatcggaagaatagccccatacaggatgtgggccctcggcataaatttttcgtggtcggcacccatggagcaggaacaaccc

SEQ ID NO: 15503 - protein, 112 aa, Zea mays
  misc_feature: Ceres CLONE 1378344-F
MAAAAAGEDDAAWERVISAATKSTSAPKTLTLDGAGKSSTGGLPSAALLERFAASLKEFSVAEARLSSLAGLTRLPAVRRLSLPDDRPLGGRSTLEDYHPWSGAPSVTIVKV

SEQ ID NO: 15504 - DNA, 730 bp, Zea mays
  misc_feature: Ceres CLONE 1378352-F
  misc_feature: Encodes the peptide sequence at SEQ ID NO. 15505
  misc_feature (632)..(632): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (703)..(703): n is a, c, t, g, unknown, or other
cgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctaacttcctggtgttcccatcctggcccggcgtggtggggcgcggcgtccaagccttggcgggcgtgcaccacgtgcgcgcctggcgccacgacagcctggccaccaaacgccgcgtcgtcgctcatcgcctgggccatcacggcgctcgncctttcggctggcccttgcaaggagatccacatcgcggaacaccgcggtggnnnncctgcccccgtgctgnaaagccttcgtcatcatcctcggcttc

SEQ ID NO: 15505 - protein, 51 aa, Zea mays; identical to SEQ ID NO: 15461
  misc_feature: Ceres CLONE 1378352-F

SEQ ID NO: 15506 - DNA, 778 bp, Zea mays
  misc_feature: Ceres CLONE 1378357-F
  misc_feature: Translation starting site: 226
  misc_feature: Pfam Name: Glyco_transf_8 Pfam Description: Glycosyl transferase family 8
  misc_feature (524)..(524): n is a, c, t, g, unknown, or other
  misc_feature (748)..(748): n is a, c, t, g, unknown, or other
  misc_feature (749)..(749): n is a, c, t, g, unknown, or other
aagctggagctccccgcggtggcggccgctctagaactagtggatcccccgggctgcaggaattcgcacgagaccattacctagaacatcctaatcgaaaaaatcgcaagctcaagcaaaaacacaaagcgcttaaaccacactcaaaccaaccgccagccaacaaacaggcctcctagtcccgaccagaactcgctcgtagccccgagaacccgacagcgcgagatggctcccgagctgatgacagccaagatgaccgccaaggccgccgcggcggcggcggcggcggcggcggcgaagcctgccacgagggcgtacgtgacgttcctggcgggcgacggcgactactggaagggcgtggtggggctggccaagggcctccgcaaggtccgctcggcctaccccctgggtggtggccgtggctgcccgacgtgcccgagtcccaccgccgcatcctcgtctcgcaggggctgcgtccgtccgcgagaatcgagcccgtgtacccgcctgagaaccagacgcangttcgccatgggcgtactacgtcatcaactactccagctcgcaatcttgtgggaagttcgtggagtaccaaaaaaaggatggtgtacctggacgggaaacaatcccaggtgtcgaaaaaacatccgaccggcctgtcgagtttccagaaaaggggtactttcaatacacgggggtgaatggactgctttcgggcgaagaagacgtggagcccccacccccgcannttacagggatcggtttaactgccagcagg

SEQ ID NO: 15507 - DNA, 675 bp, Zea mays
  misc_feature: Ceres CLONE 1378358-F
  misc_feature: Encodes the peptide sequence at SEQ ID NO. 15508
  misc_feature (472)..(472): n is a, c, t, g, unknown, or other
  misc_feature (485)..(485): n is a, c, t, g, unknown, or other
  misc_feature (649)..(649): n is a, c, t, g, unknown, or other
  misc_feature (673)..(673): n is a, c, t, g, unknown, or other
tggagctccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcagaagcatgacgggccggnctccggcgggcgncgtcagcatggccaacgccgccaacatccccggcaagtgcggcgtctcccgtcggcgtgcccatcagccccaccgtcgactgcaccaagatcaactgatcgatggacccgaagtggaggtagctatgcctctgcatgctcgttgaatggcagcgtggccatcancagcatgcgggcggcgtcgtcgtnca

SEQ ID NO: 15508 - protein, 143 aa, Zea mays
  misc_feature: Ceres CLONE 1378358-F
  misc_feature (36)..(122): Pfam Name: Tryp_alpha_amyl Pfam Description: Protease inhibitor/seed storage/LTP family
  misc_feature (92)..(92): Xaa is any aa, unknown, or other
  misc_feature (96)..(96): Xaa is any aa, unknown, or other
MAARSSSQQLVAAAVLAAALLLLAAGAGTASAAVSCGEVTSSVAPCLGYAMGSAASPSAACCSGVRSLNSRASSTADRQATCNCLRSMTGRXPAGXVSMANAANIPGKCGVSRRRAHQPHRRLHQDQLIDGPEVEVAMPLHAR

SEQ ID NO: 15509 - DNA, 813 bp, Zea mays
  misc_feature: Ceres CLONE 1378360-F
  misc_feature: Encodes the peptide sequence at SEQ ID NO. 15510
  misc_feature (796)..(796): n is a, c, t, g, unknown, or other
ccgacacgccgttagcgggatcacgtataatagaataccaacaaagctggagctccccgcggtggcggccgctctagaactagtggatcccccgggctgcaggaattcgcacgagaccattacctagaacatcctaatcgaaaagtaccgacgagctcggcgcttccccacccgaaaaggagaacaaaccaccactcccaccaccctccgcctccgcctgaggcacagctgccgattcgaaagccctcgtcctgacccctcgcaaaaccctagctacaaccaccatgaggggcaaggccaacgcctccaagaaggatgaggccaggctccgggccggcggcgccggcgccggaaagcgcaagaaggccgccgcgagcggcaaggccaagcggcctccctccgacttcttcgtcttcatgtctgaattcaggcaggagtaccaggcgcagcaccctggcaacaagagcgttgcggccgtgagcaaggcagcaggggaaaagtgccgctctatgtcagagcgagagaagcaaccctatgtggcacaagctgcggcagaagaagcaggactatgagaagactaagggcaatattggaaaggagagcacaaggtcgaagaaggctaatactgatgaaggacgatgggtccaaggccgaggtccaagaacgaggaaggccggcaagggacagggaaagcgccgacgagggggaaaataggattttccggatggttgtgaaggtgtacaaaggaaggcggaacctaataagacgccccggcaggcgtggatagcactaagtncccattaacacaaaaaa

SEQ ID NO: 15510 - protein, 95 aa, Zea mays
  misc_feature: Ceres CLONE 1378360-F
  misc_feature (34)..(96): Pfam Name: HMG_box Pfam Description: HMG (high mobility group) box
MRGKANASKKDEARLRAGGAGAGKRKKAAASGKAKRPPSDFFVFMSEFRQEYQAQHPGNKSVAAVSKAAGEKCRSMSEREKQPYVAQAAAEEAGL

SEQ ID NO: 15511 - DNA, 752 bp, Zea mays
  misc_feature: Ceres CLONE 1378363-F
  misc_feature: Encodes the peptide sequence at SEQ ID NO. 15512
tggagctcaccgcggtggcggccgctctagaactagtggatcccccgggctgcaggaattcgcacgagaccattacctagaacatcctaatcgaaaaacgacaacgagttaacgatagcactattatccaagttcaggaaagatcacagcatcgttgaatccgatcttaagtatatccaagctcagcaatgtgttctcggcagcgacatcctactagataccaagacgtacaatacaaagtcccgtgcacgaggataatagccgacaagtgatggaagcggcgtgctatacaggaaaagatgacaatcatcaggtgtatgactccgtcgaccgctctgtggagatcgtccacgacgccggacacgtgaccatagagaaggcgcgtgacgccgaagaccgagccatggaaatgggacactacgccggcgagacacgcaatgacaggccgtacctcatcatatacgacgcctccggtgccgctgctagcagcggggacactgccttcgatgcggaaggtgctgtcggagaacagctccacgacgctgctcagcagaccgctagatacctccgacagacgtgcgagtcacccagttccaaggcgccgcgtccctcgcgctgctcccttccggacacgggggctgtgccgggaagagaaagtagccggactactcgtgacgaacgacacgggaaaaagatgactgacctgggccgccgtcagaacatggatccgaggtgcgataacggagcacgag

SEQ ID NO: 15512 - protein, 160 aa, Zea mays
  misc_feature: Ceres CLONE 1378363-F
MEAACYTGKDDNHQVYDSVDRSVEIVHDAGHVTIEKARDAEDRAMEMGHYAGETRNDRPYLIIYDASGAAASSGDTAFDAEGAVGEQLHDAAQQTARYLRQTCESPSSKAPRPSRCSLPDTGAVPGRESSRTTRDERHGKKMTDLGRRQNMDPRCDNGAR

SEQ ID NO: 15513 - DNA, 803 bp, Zea mays
  misc_feature: Ceres CLONE 1378364-F
  misc_feature: Encodes the peptide sequence at SEQ ID NO. 15514
  misc_feature (356)..(356): n is a, c, t, g, unknown, or other
accccccccacccacccacacaacaccaccccacaaatagcctccccaaaagctgaaactccccgcggtggcggccgctctaaaatagaggatcccccgggctgcaggaattcgcacgagaccattacctacaacatcctaatcaaaaaaaaacacacagcaagattccacgagaaccgtcaatgggttctataggaggacacacaaccacagctaccgccgaccggtggcgccgcgcgctgttcttcccgctcccgtaccaggggcacatcacccccatgttccaaatcgccggcctcctccacttgcgcggattctccgtcaccgtcttccacaccgacttccacgctcccganaagtcccgccaccctgcctacgacttcgcccccgttcccgtccgcggctgcttgccgaagggcacctcggatgccttgcaggtgaccgtggagcgcatcccccccctgaaccgcccctgcgaggctccgttccgggagcgcctggccgctctgctgccccgggaggaacgtcccgagcctgctccctgaagcccacctgttgatgctgctggacgtggtagcgggggctccatgtgccgaacctggtggtgcgcaccggccagagcggacgtgcctccgcatgttcggcgggagttacccgggcttctgccgacaagggctatccatccgggcgcaagaaagccgcaccctggaaagcgcttgggtgacttgaaccttgccccacgaaacagccgtccccggctaccctggctgtccacaccaaccaagcggccctggcccaacggg

SEQ ID NO: 15514 - protein, 120 aa, Zea mays
  misc_feature: Ceres CLONE 1378364-F
  misc_feature (58)..(58): Xaa is any aa, unknown, or other
MGSIGGHTTTATADRWRRALFFPLPYQGHITPMFQIAGLLHLRGFSVTVFHTDFHAPXKSRHPAYDFAPVPVRGCLPKGTSDALQVTVERIPPLNRPCEAPFRERLAALLPREERPEPAP

SEQ ID NO: 15515 - DNA, 739 bp, Zea mays
  misc_feature: Ceres CLONE 1378366-F
  misc_feature: Encodes the peptide sequence at SEQ ID NO. 15516
ggagctccccgcggtggcggccgctctagaactagtggatcccccgggctgcaggaattcgcacgagaccattacctagaacatcctaatcgaaaaatcgatcgtcaatgcgactttgtccattctcattggtctgaatactgcacctactactgcgagtgccactgtgacgcaactgcctgatcgccattactgcaagctgtgttcaaacaaagcttaatcatgctccctctacatctgatccatctaactacctagccatcactaaccaagggagtggcaagaatcaggacagaaataacatcggggatatctagctgagctcgtgctacgaataatggccggaattgacaagaacatgttgtggccgctcctggcgctcaacctcatcatgtacatcatcgacatcgcctgtcacgagctggaacctgaaccacttcatcaacgggcagaccaactaccccggcgtggccgccaacggcgccacgttctacttcctgaagttctccatcctgcacggccgtctgagcgcgacgtccaatgctggcgatcgtgcaccacgtgcgcgcctggcgccaccacagcctgttcaccaacaacgcgtcatcgctcatctgctgtgccatcacggcgctcgccttctgtctgacctgcaaggagatccacatcggagaacaccgcggatgcctactgtacgtgctgcaggacttcgtcatcatcctcggcttcctcagatccc

SEQ ID NO: 15516 - protein, 66 aa, Zea mays
  misc_feature: Ceres CLONE 1378366-F
  misc_feature (1)..(64): Pfam Name: AWPM-19 Pfam Description: AWPM-19-like family
MLAIVHHVRAWRHHSLFTNNASSLICCAITALAFCLTCKEIHIGEHRGCLLYVLQDFVIILGFLRS

SEQ ID NO: 15517 - DNA, 735 bp, Zea mays
  misc_feature: Ceres CLONE 1378367-F
  misc_feature: Encodes the peptide sequence at SEQ ID NO. 15518
  misc_feature (330)..(330): n is a, c, t, g, unknown, or other
  misc_feature (345)..(345): n is a, c, t, g, unknown, or other
  misc_feature (373)..(373): n is a, c, t, g, unknown, or other
  misc_feature (451)..(451): n is a, c, t, g, unknown, or other
tccccgcggtggcggccgctctagaactagtggatcccccgggctgcaggaattcgcacgagaccattacctagaacatcctaatcgaaaaagaaatccatcccgatcctatcgtccccaatttcttctgctccacctaaatagatccgtagccgtagcctaggcgcgcacattgcagaaagatcgagcgaaaggtcggcagcaggcgcatagatgcaggggtgagggcacgggcggcagcgcttgacgggcgacgagtaaaccctaacgctttgattgcgggcggcgtcgtctgagccagtcccgagtcgatacgctgtcatgcctgtncatcctcctccgccnactctgggtcgtcgtctttggctccggnggggccagctacttccccgctccctttcactgcagcagcaccagcccgccgcgccgcaggtgccgccgcctatggcgncgagcagctatcagcagtatcagcaacagctggatcaggcccatcagctcttccagggggacgggcagaccataacccccgagcgttgcaaagggtcaagggtgcccctcgccaccaggaggtcctcgacccggtggccgcggcaaaggccgggttttcccaacccctaaccgaaaaaaaccattcccccggggggtgggcggaaattcggggggaggtcctccccccttgaagggcccaaaacaacacccggggtttttggggggaaattaacaaaaaaaatt

SEQ ID NO: 15518 - protein, 58 aa, Zea mays
  misc_feature: Ceres CLONE 1378367-F
  misc_feature (3)..(3): Xaa is any aa, unknown, or other
MAXSSYQQYQQQLDQAHQLFQGDGQTITPERCKGSRVPLATRRSSTRWPRQRPGFPNP

SEQ ID NO: 15519 - DNA, 659 bp, Zea mays
  misc_feature: Ceres CLONE 1378369-F
  misc_feature: Translation starting site: 166
  misc_feature: Pfam Name: Diphthamide_syn Pfam Description: Putative diphthamide synthesis protein
  misc_feature (337)..(337): n is a, c, t, g, unknown, or other
  misc_feature (338)..(338): n is a, c, t, g, unknown, or other
  misc_feature (523)..(523): n is a, c, t, g, unknown, or other
gctctagaactagtggatcccccgggctgcaggaattcgcacgagaccattacctagaacatcctaatcgaaaagatggtctcgtactcttgtcacgttccttcctgactgcccccacttctcctccggcggcgcggcggcgggttacctcccaacagcccgaccatggaagccgacatcgctttcaggtatgagatcccccggaccgcccagttcctccgcgacggcgcctacaccagggtcgcgctccagttccccgacgagatgctgaaggatgctgctgcggtggcgagggcgttgcggcgggagcttgcctccggcggcgccgacagtgggnngttagggtggttcgtgatggccgacacggcgtacaactcctgctgcgtggacgaggtgggcgcgtcccacatcgatgcgccagtgcgtcgtccactacggccacgcctgcatgagcccaacatcaaatttgccagctttctttgtatttgggaaggcaccggttggatgtccacgcatgtgccgncacatttgctgaagtgctcaaggaaaagcaataagcgcattctggttttatatggactaaagtacgcatatggattggatgaccttaaaccgactttcatggagccctggaaatcaaattctggcaacctggagcc

SEQ ID NO: 15520 - DNA, 641 bp, Zea mays
  misc_feature: Ceres CLONE 1378371-F
  misc_feature: Translation starting site: 128
  misc_feature (596)..(596): n is a, c, t, g, unknown, or other
  misc_feature (613)..(613): n is a, c, t, g, unknown, or other
  misc_feature (641)..(641): n is a, c, t, g, unknown, or other
tccccgcggtggcggccgctctataactagtggatcccccgggctgcaggaattcgcacgagaccattacctagaacatcctaatcgaaaaatactctgcccagctaaactccctccgtccatcggcatggctactaccagtagtagcatcctcctcctcctcctcgtcgcagccactgacgtctcgtggtccgacctctccgggtaccacaacgtgcacccgccatccccgtccccgctcgagtccatcatcgcgctcgcccgcgccgacgacgcgcgactccgcttcctctcatccaaggcggactcgtgcggcggcggcaactccgctcccgtcgactccggccatactccgccctcgtacgtcctgcgcgcggagctcggcaccccggtccagcagctgctcctcgcgctcgacaccaggccgacgccacctggtcgcactgcgcgccgtgcgacacgtgccccgccggcagccgcttcatcccggccagctcctcctcgtacgcctccctcccgtgcgcctccgactggtgcccgctcttcgagggccagccgtgcccggcgaaccaggacgcctcggcgccgctgccggngtgcgccttctccaagncgttcgcggacacctcgttccaggcgtn

SEQ ID NO: 15521 - DNA, 690 bp, Zea mays
  misc_feature: Ceres CLONE 1378377-F
  misc_feature: Translation starting site: 184
  misc_feature (614)..(614): n is a, c, t, g, unknown, or other
ggagctccccgcggtggcggccgctctagaactagtggatcccccgggctgcaggaattcgcacgagaccattacctagaacatcctaatcgaaaaaaagttcggagtcgaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatggctgttagcggtggcatcaatgttccagtgatgccgactccgctttttgccaatgctccagctgagaaaggtggcaaaaacttcatgattgatttcatggatgggcggtgtttcagctgctgtttcgaagactgcagctgctcccattgaacgagtgaagctgcttattcagaatcaggatgagatgatcaagtctggtaggctatcagaggccgaaacaggggtaattgctgattgcttcaaacgtaccaccnaggggatgaggggtttctcttccttggcgggaggggtaacactgctaaatgtatattcgttacttgcctactcagg

SEQ ID NO: 15522 - DNA, 717 bp, Zea mays
  misc_feature: Ceres CLONE 1378379-F
  misc_feature (19)..(19): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
ggggggccgcccccgcccngggggggnnnnnnnnccnnntcgcccccgcacaaagctggagctccccgcggtggcggccgctctagaactagtggatcccccgggctgcaggaattcgcacgagaccattacctagaacatcctaatcgaaaaacgcacatattattgagaccagctagcaacatataaactcaatagtgtaccaacaatggcagccaaaatattttgcctccttatgctccttggtctttctgcaagtgctgctacggcgaccattttcccggaatgctcgcaagctcctatagcttcccttcttcccccgtacctctcaccagtggggtcttcggtatgtgaaaacccaattcttcaaccctacaggatccaacaggcaatcacagctgggatcttacctttatcagccttggtcctccaacaagcatcagccctattacatcacgttacctttggtggatttattggcacaaaacatcagggcacaacagctacaacaacttgtgctagcagaccttgctgcctactctcagcaacagcaggttcttccattcaaccaactagctgcattgaactctgcttcttatttgcaacaacaacaactaccattcaaccagctacctgctgtctacccccagcaatttcttccattcacccaactgggagcattgaactcctcctgcttatttaccgcagcaacaacta

SEQ ID NO: 15523 - DNA, 686 bp, Zea mays
  misc_feature: Ceres CLONE 1378381-F
  misc_feature: Encodes the peptide sequence at SEQ ID NO. 15524
tggagctccccgcggtggcggccgctctagaactagtggatcccccgggctgcaggaattcgcacgagaccattacctagaacatcctaatcgaaaaaacattagcaaggggatagataagaggaaggaaagaacataggcagccgaagcgactgtcgcgaggcaaggccatcgtccgccatgacgctctccctctccacctctttcctccccatccccgccgccgcgaggaccaccgcccgcactttacgctccgtcgtcccctcccaggggatgcgctgctcgatgcgcaagaagggggaggacagcggcgaccgctgcccttgcgagaagcagtgcgagggccaccacgaccgggaaagcaggcagcagtgcgtccaggcttgcgagcgccggcgacagcagcgcggcggcagccgtgactccaacgtcgacgaggacgacagcgaccggcggtgccagatgaaatgccggcgccacagcgatcggcaggcgaggcagtggtgcgtgcagcgctgcgagcgtaagcaacaggaggaggacgccgccgccgacgacgactacagcggtcggtgccagaagagatgccagcacccacagcgatcggagggcgaggccagtggtgcgtgcagcgctgcgagcgtaagcaacaggaggacgccgccgccgacgacgacgagaacagc

SEQ ID NO: 15524 - protein, 137 aa, Zea mays
  misc_feature: Ceres CLONE 1378381-F
MRCSMRKKGEDSGDRCPCEKQCEGHHDRESRQQCVQACERRRQQRGGSRDSNVDEDDSDRRCQMKCRRHSDRQARQWCVQRCERKQQEEDAAADDDYSGRCQKRCQHPQRSEGEASGACSAASVSNRRTPPPTTTRT

SEQ ID NO: 15525 - DNA, 712 bp, Zea mays
  misc_feature: Ceres CLONE 1378388-F
  misc_feature: Encodes the peptide sequence at SEQ ID NO. 15526
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagtagtagtcagaggcattcagattggacacatgcccacacacaccactaggttagcctagccttttacgctgcgaggaaggaggaagaaggctgcgcacgcccgcctcctatactacacgagagccgatcgaccgatagctaccacgcgatggcataggccgtccaagatgatggtcggcgacaactctgctgaccttgaccctgagcgtgacgatcaccgagcggaggaacatcatgaccaccaccatcacagaagaacgacgacgtgatggtgtacccgatcgaccttcccgcccttcgaccgcctcgactacggcgcgtcctcggacgtgcgagggactccccgcatgcacattcctgtgactgccattcacggccatcatcatgcccgtgaggggcatgaacctatgcgtcatcggcttgaccggcagcgacagcatgcccctcttcgcgggtgactgcccgggcatgagcgtcatcgagggcatgcacgggtcctccagcgacggatccgtctgcgaggatgtcacatgctcgtgaacgctacaagtgcggtagtagagaggtgctactgtgactgtangactg

SEQ ID NO: 15526 - protein, 51 aa, Zea mays
  misc_feature: Ceres CLONE 1378388-F
MPVRGMNLCVIGLTGSDSMPLFAGDCPGMSVIEGMHGSSSDGSVCEDVTCS

SEQ ID NO: 15527 - DNA, 788 bp, Zea mays
  misc_feature: Ceres CLONE 1378392-F
  misc_feature: Encodes the peptide sequence at SEQ ID NO. 15528
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (19)..(19): n is a, c, t, g, unknown, or other
  misc_feature (20)..(20): n is a, c, t, g, unknown, or other
nnngggccccccccccccnncccctcccccccccccccccccctaatatttaaagctggagctccccgcggtggcggccgctctagactagtggatcccccgggctgcaggaattcgcacgagaccattacctagaacatcctaatcgaaaatggaggcggccgtgtgcctctgcaccaccatcaagctcaggctcctgaacatcaacctctacctgcccctggcgctccagctcctcctcacctgcggcaagacgccgccgccgggctacacctgcaccgtctgatctggactagctggcagcccccggcccatgcgtccatttatccgacatgggttttggagtgagctagcatccagttcatcggtcgtttgaagagagatcgacatgagaggatgtcgtctgcttcgtcgttccaagctgaagaaggcacgccggaggaggaagagagtaacaacggccgggtcgatcagctaacgatgcatcgatcattttttccccatatttattgtgccgcgtccgctgcagtttctaattttctagacgtgctttccggtttgatctgtacaccctggcgccttgattttgggtaacacctcgatctcgatgccaggccaaactgcctgcgcgtcccgaactgcctaaataacccccccgcttcaataatttggacaacggccgccacggtagataaactctaacatatcactataatgtgggttgccgaaaaaaataacaccaacgtcgggagcagggtgcctgtctaagggactagtcagacctcact

SEQ ID NO: 15528 - protein, 44 aa, Zea mays; identical to SEQ ID NO: 12255
  misc_feature: Ceres CLONE 1378392-F

SEQ ID NO: 15529 - DNA, 669 bp, Zea mays
  misc_feature: Ceres CLONE 1378393-F
  misc_feature: Encodes the peptide sequence at SEQ ID NO. 15530
tggagctccccgcggtggcggccgctctagaactagtggatcccccgggctgcaggaattcgcacgagaccattacctagaacatcctaatcgaaaaataggaaaaacgactccacacggtccacggcgtcgtctccggcgaaccttcgcgagccctcggctcccctctaccaccgctgccgcgaccccgcctacggagcatcctcgggtagcgctctggcttcccgtgccggcggacgtcctgcaggaggcggcggcctccgtggcatgttgatgagggccgccgctgccctccctcgccgatcgtcgcggccctcggagccggggtcctcctcctcccgggctcccgcccctggggcctcctccagccgggctcctgcccccggggcctccttcgaccccttcgatgtcgataccgacccgccatcgcggcttgagctgacgcccgagcagatcgggctctgcgttgacgcgctcgcgcatttcgagtacaaggggaagcgccgggatgacttggtcgacgagttcagaagcctctcgggatcgggtattagaaatatggaaacgatcggtgtagctcattaccctggttaaagagaaaagaaccgataaattggaggcttaccatttggcggaaccagagtacggcttaatcccccggagggcccc

SEQ ID NO: 15530 - protein, 108 aa, Zea mays
  misc_feature: Ceres CLONE 1378393-F
MLMRAAAALPRRSSRPSEPGSSSSRAPAPGASSSRAPAPGASFDPFDVDTDPPSRLELTPEQIGLCVDALAHFEYKGKRRDDLVDEFRSLSGSGIRNMETIGVAHYPG

SEQ ID NO: 15531 - DNA, 697 bp, Zea mays
  misc_feature: Ceres CLONE 1378399-F
  misc_feature: Encodes the peptide sequence at SEQ ID NO. 15532
tggagctccccgcggtggcggccgctctagaactagtggatcccccgggctgcaggaattcgcacgagaccattacctagaacatcctaatcgaaaatttagctgccatctgtttctgaaccatggatccatttgttctctccatcctcttatgctcatcgatctttgttgtagtgtactggagaaggctgaacagcatgaggctaagacttccaccgggacctccaacatggccaattttcggcaatcttctccagttgagccctcttccccacaaagactttgcccaattttgcaccaaatatggccctctcgtctatcttcgcctgggaaccatcgatgccatcaccactgatgaccccgaagtgatccgtgaaatactcatccggcaagatgaggtctttgcttcgcggcctcggacactggctgccgtccatctcgcctatgggtgtggtgatgtggctctagctccactgggacccaactggaaaaggatgaggagagtttgcatggagcacttgctgacgaccaggcggctcgagtctttcgctgctcaccgagctcaggaggccgagcacctctgccagtttgtgtgggctaaatctcagtccgggaagcccgtgaacctcagagaggttctcggtgccttctcgatgaacacgtccccgcccgacggcctcgcccccgaggacgggac

SEQ ID NO: 15532 - protein, 191 aa, Zea mays
  misc_feature: Ceres CLONE 1378399-F
  misc_feature: SWISSPROT Homolog: EC 1.14.13.21 Flavonoid 3'-monooxygenase
MDPFVLSILLCSSIFVVVYWRRLNSMRLRLPPGPPTWPIFGNLLQLSPLPHKDFAQFCTKYGPLVYLRLGTIDAITTDDPEVIREILIRQDEVFASRPRTLAAVHLAYGCGDVALAPLGPNWKRMRRVCMEHLLTTRRLESFAAHRAQEAEHLCQFVWAKSQSGKPVNLREVLGAFSMNTSPPDGLAPEDG

SEQ ID NO: 15533 - DNA, 1027 bp, Zea mays
  misc_feature: Ceres CLONE 1378401-F
  misc_feature: Encodes the peptide sequence at SEQ ID NO. 15534
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ggccccccccnnnnncnnnncnncccccctcctnnnngggannnnnnccaaactggagctccaccgcggtggcggccgctctagaatagtggatcccccgggctgcaggaattcgcacgagaccattacctagaacatcctaatcgaaaactagcccagcaccgcagaggcgcagagacaggcgtcttcgtactcgcctatctccgcgactcagagcttcttccatttcctaccgccgccgctgcagctcgcccccattccgtcgacaccatgagggagtgcatctcgatccacatcggccacgccggtatccagtgcggaaacgcgtgctggcaggtccactgcctcgaggatggcattcaggccgatggtcagatgcccggcgacaagacccttgggggtggtgatgaggctttcacaccctccgcccgggagacgggggctggaaaacaggtccccccgggctggttttggcgggctttgacccaccgggacctccgatgagggggaggaccggggacctaaccggccggcttcttccacccctggggcgggctttatacagggggccaggggggggagggcaggccaaaccaacttttccgccccggggggcgcccgttaccacccaattcggccacagggaagggattggggaggaacccctgcgtgggccccggggaaccgccgaactccggagcaaaaccttgggatccaagcaaaactcgggccccctgggcgccacgcgccagggcgctctgccctcggggaccattgaacacctcctgtttggggggagtagaatggaaacaggagtcttccgggcgccatagcgcgccccctctcccccccccggggagacgagacccgagccctggggggcaaccacgcgaccaagaacccacccacccgggcgggcgcgttaagcgggggggagacaccgaccgccccccagacatcttgaaacctcaccgggggggcgagggcacaacacaaggacgttcgcccgggaaccctcccacccccc

SEQ ID NO: 15534 - protein, 77 aa, Zea mays
  misc_feature: Ceres CLONE 1378401-F
MRECISIHIGHAGIQCGNACWQVHCLEDGIQADGQMPGDKTLGGGDEAFTPSARETGAGKQVPPGWFWRALTHRDLR

SEQ ID NO: 15535 - DNA, 799 bp, Zea mays
  misc_feature: Ceres CLONE 1378402-F
  misc_feature: Encodes the peptide sequence at SEQ ID NO. 15536
  misc_feature (477)..(477): n is a, c, t, g, unknown, or other
  misc_feature (478)..(478): n is a, c, t, g, unknown, or other
  misc_feature (510)..(510): n is a, c, t, g, unknown, or other
  misc_feature (773)..(773): n is a, c, t, g, unknown, or other
accgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnnaggggcgagtgccgacgccagtgcctgcgccngcacgaggggcagccgtgggagacccaggagggcatgaggcggtgccgccgccgcggactggccgtcgactggaagcaagagtacggtcgcggcagcgagagcgcgggcagtggcccggaagaggtgccagcgccacaaccgcgggaactgggtgggagaggcagcgctgcctgatgactgaaaaaaacccgggaggggggaagagaaaaaggccccacaccggcggccggcggcgggggaagggaacaaaaaaaatagccgncaaccccttgccccttgcggagaaac

SEQ ID NO: 15536 - protein, 199 aa, Zea mays
  misc_feature: Ceres CLONE 1378402-F
  misc_feature (93)..(93): Xaa is any aa, unknown, or other
  misc_feature (191)..(191): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGXGRVPTPVPAPARGAAVGDPGGHEAVPPPRTGRRLEARVRSRQRERGQWPGRGASATTAGTGWERQRCLMTEKNPGGGKRKRPHTGGRRRGKGTKKIAXNPLPLAEK

SEQ ID NO: 15537 - DNA, 796 bp, Zea mays
  misc_feature: Ceres CLONE 1378408-F
  misc_feature: Encodes the peptide sequence at SEQ ID NO. 15538
  misc_feature (339)..(339): n is a, c, t, g, unknown, or other
  misc_feature (393)..(393): n is a, c, t, g, unknown, or other
  misc_feature (434)..(434): n is a, c, t, g, unknown, or other
  misc_feature (468)..(468): n is a, c, t, g, unknown, or other
  misc_feature (518)..(518): n is a, c, t, g, unknown, or other
  misc_feature (553)..(553): n is a, c, t, g, unknown, or other
  misc_feature (559)..(559): n is a, c, t, g, unknown, or other
  misc_feature (562)..(562): n is a, c, t, g, unknown, or other
  misc_feature (679)..(679): n is a, c, t, g, unknown, or other
  misc_feature (742)..(742): n is a, c, t, g, unknown, or other
  misc_feature (776)..(776): n is a, c, t, g, unknown, or other
tggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaaggncggtgagggggaatcggggaaggaggaggtgagggagtatgaaagcgacatgangaagctggaggagctgctttctaagctgaacccctcggcgnagggagtcgtgccgcagtcccgccgccgcgtggnacgcggcgctccccgctttcggccgacgcgcccgtgttcgtgtcgccggngatcgactactacgcgcggcacccacagttcccgncgccgnagnttctgcagcagcagcagccgatgcacgtgctgcagtttgtgggtggcgtccgcggggttggcatgggtgggcggcggggggatggactccagcagcgacggatccgcccatggtcanccgaatcgacggaagaaggaacggtttcatccaggggaagaaaaaaggatgatgggtggccgncctcgtcgagctgacagggaaggatagggggcgncggaaagtctattgcctctg

SEQ ID NO: 15538 - protein, 177 aa, Zea mays
  misc_feature: Ceres CLONE 1378408-F
  misc_feature (35)..(35): Xaa is any aa, unknown, or other
  misc_feature (53)..(53): Xaa is any aa, unknown, or other
  misc_feature (67)..(67): Xaa is any aa, unknown, or other
  misc_feature (78)..(78): Xaa is any aa, unknown, or other
  misc_feature (95)..(95): Xaa is any aa, unknown, or other
  misc_feature (109)..(109): Xaa is any aa, unknown, or other
  misc_feature (148)..(148): Xaa is any aa, unknown, or other
MVAVAVDGLIRGADAVPAAEREAVRAAAAEAAAKXGEGESGKEEVREYESDMXKLEELLSKLNPSAXGVVPQSRRRVXRGAPRFRPTRPCSCRRXSTTTRGTHSSRRRXFCSSSSRCTCCSLWVASAGLAWVGGGGMDSSSDGSAHGXPNRRKKERFHPGEEKRMMGGRPRRADREG

SEQ ID NO: 15539 - DNA, 726 bp, Zea mays
  misc_feature: Ceres CLONE 1378409-F
  misc_feature (333)..(333): n is a, c, t, g, unknown, or other
  misc_feature (334)..(334): n is a, c, t, g, unknown, or other
tccccgcggtggcggccgctctagaactagtggatcccccgggctgcaggaattcgcacgagaccattacctagaacatcctaatcgaaaaacaaaaaggcggcagcacagcgccacccctcctgtcccgccgagttcggagcgcagcgcaaggcggggggaggagcaagaagccgccggcctccctcctccggctcaccaccaggcttactccgcaccgcgctgccacgggtaggagcggcgtcaaattcgggattcccaagcggcttcagcccggagttgagccaagctatttctaagaaaaatgcggcatgatggtggcgatgactgcgnnagagcagaacagcatattacccatggaggaaaaagcaggggctgtcctattcaaggtacccagaggttcgggttccctgggaatcaccatgaggacaaggggtttctccctggagccggaagggatctgggccccttcccttggggggcctggttttgctaagggggggggcttaaaaggggggcaacggggcgcccccaaaggggggcccccggcccggggggggaaaggaaaataaaaaaaccccccctcccggggaacttttgagaagaaaaacacccggtcttgggggggaaattggggcgcccccggggttttattacccctaaaaggggggttccggggggggagggggggggggggggtttttctccaaaaaaaaaaaaaccccc

SEQ ID NO: 15540 - DNA, 774 bp, Zea mays
  misc_feature: Ceres CLONE 1378411-F
  misc_feature: Translation starting site: 161
  misc_feature (379)..(379): n is a, c, t, g, unknown, or other
  misc_feature (503)..(503): n is a, c, t, g, unknown, or other
  misc_feature (559)..(559): n is a, c, t, g, unknown, or other
  misc_feature (560)..(560): n is a, c, t, g, unknown, or other
tccccgcggtggcggccgctctagaactagtggatcccccgggctgcaggaattcgcacgagaccatacctagaacatcctaatcgaaaaacgccttcgctcgcgccgccgccgccgacgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcagcaggcggcgccgagtagcggctccccacctcgagcttgccaccatggctagaggattgaagaagcatttgaagaggctcaatgcgcccaagcattggatgctggacaagcttggcgnagcttttgctcccagccatcttctggacctcacaagtctagggagtgcctggcactgatcctcatcatcaggaacaggctcaagtatgctcttacataccgtgaggtcattttcatcctgatgncacgccatgtacttgttgatggcaaggtcaggacagacaagacttaccctgctggnntcatggatgtcattttcatccccaagacaatgagaactacggggtgctgaaggataccaaggccgcttcggccttcacccatcagggatgagatgctaagtcagctttgcaaggtaggttctgtcagtttgggcagagggctcccctatctgaaacgatgagggcggaccatcgttacctggaccgtcattaggcacgaccccttcagatggtg

SEQ ID NO: 15541 - DNA, 828 bp, Zea mays
  misc_feature: Ceres CLONE 1378415-F
  misc_feature: Encodes the peptide sequence at SEQ ID NO. 15542
  misc_feature (280)..(280): n is a, c, t, g, unknown, or other
  misc_feature (283)..(283): n is a, c, t, g, unknown, or other
  misc_feature (400)..(400): n is a, c, t, g, unknown, or other
aagctggagctccccgcggtggcggccgctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancanccacggccggggcggaggacgtagtggtcgaacgggaccgcaaggaggacctgcggtgttgcaagcaggcgtgcgagtggcaccccccccaggacaccccgcggaagagggaatgcnagagcgagtgccgcaagcgccaccagcaagctgacgcgggcgaggacggcgacaggggcgtggacgcctacgtctcccgctccgggaggggggagtggccgggccagtggctgcgccgccacgaggggcagccgggggaaacccagaagggcatggaggggtgccccccgcccggactggcccgtcaaatggaacaaaaaataccggcccgaaagggagagcggggccaagtgcccgggagagggggcaacgccccccacgggggggaatgggggaaaaaggcacccttgcctgatggactggcaaaaacccgaaaccggaaaagaagaggtcgtaaaacgggggccccggtcggtaaaagaaagaaaagaaaaaaggggcaaccccgttgccctttggagaaaaaaaggggcgaggggcgccccccg

SEQ ID NO: 15542 - protein, 206 aa, Zea mays
  misc_feature: Ceres CLONE 1378415-F
  misc_feature (24)..(24): Xaa is any aa, unknown, or other
  misc_feature (25)..(25): Xaa is any aa, unknown, or other
  misc_feature (64)..(64): Xaa is any aa, unknown, or other
MGKGSVGASWWAFLLLAGVLLVVXXTAGAEDVVVERDRKEDLRCCKQACEWHPPQDTPRKRECXSECRKRHQQADAGEDGDRGVDAYVSRSGRGEWPGQWLRRHEGQPGETQKGMEGCPPPGLARQMEQKIPARKGERGQVPGRGGNAPHGGEWGKKAPLPDGLAKTRNRKRRGRKTGAPVGKRKKRKKGQPRCPLEKKRGEGRPP

SEQ ID NO: 15543 - DNA, 777 bp, Zea mays
  misc_feature: Ceres CLONE 1378421-F
  misc_feature (532)..(532): n is a, c, t, g, unknown, or other
  misc_feature (688)..(688): n is a, c, t, g, unknown, or other
  misc_feature (714)..(714): n is a, c, t, g, unknown, or other
  misc_feature (716)..(716): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactacccccggcgtggccggcaacggcgcgacgttctactttcctggtgttcgccatcctgggccggcgtggtggggcgcgncgtccaagctggcgggcgtgcaccacgtgcgcgcctggcgccacgacagcctggccaccaacgccgcgtcgtcgctcatcggctgggccatcacggcgctcggccttcgggctgcccctggaaagagatccacatcggcggacccccgcggctggncccctggcccggggctggaaggcccncnttcatcattcttcgccttccgcaagctcctcttacgggctcagtgctcccaccggggcccc

SEQ ID NO: 15544 - DNA, 799 bp, Zea mays
  misc_feature: Ceres CLONE 1378423-F
  misc_feature: Encodes the peptide sequence at SEQ ID NO. 15545
  misc_feature (799)..(799): n is a, c, t, g, unknown, or other
tccccgcggtggcggccgctctagaactagtggatcccccgggctgcaggaattcgcacgagaccattacctagaacatcctaatcgaaaaaagttgtttctcttctcttgctccgcaaaccagcgcaagcccttccctgacagcggcggcgacatggtgctcgaggcgacgatgatctgcatagacaactcggagtggatgcggaacggcgactacgccccgtcgcggttccaggcgcaggccgatgccgtcaacctcatatgcggtgccaagacccagtcgaacccggagaacacagtaggcgtgatgacgatggccgggaagggcgtccgcgtgcttgtcactcccaccagcgacctcgggaagattctcgcctgtatgcacgggttggaagttggtgctgaggcaaacttggctgcggcaatccaggttgctcagcttgcgctaaagcatcgccagaacaagaggcagcagcagaggattatagcattcatcggaagtcctgtgaagtacgacaagaaaattttggagacaatcgggaagaagctgaaaaagaacaatgttgctcttgacattgttgactttggtgaatctgatgatgaaaagcctgagaaactggaagcattgatcgctgctgttaacagcagtgatagcagtcacattggtcatgtccctcctggtgaaatgcctctctctgatgtctcctagcctccatattactgtgaaaaaaaggggaaaaaaaatttttttttgtttcttccgcacagctgccgtagctacggaagatctggatttttn

SEQ ID NO: 15545 - protein, 184 aa, Zea mays
  misc_feature: Ceres CLONE 1378423-F
MVLEATMICIDNSEWMRNGDYAPSRFQAQADAVNLICGAKTQSNPENTVGVMTMAGKGVRVLVTPTSDLGKILACMHGLEVGAEANLAAAIQVAQLALKHRQNKRQQQRIIAFIGSPVKYDKKILETIGKKLKKNNVALDIVDFGESDDEKPEKLEALIAAVNSSDSSHIGHVPPGEMPLSDVS

SEQ ID NO: 15546 - DNA, 711 bp, Zea mays
  misc_feature: Ceres CLONE 1378432-F
tccccgcggtggcggccgctctagaactagtggatcccccgggctgcaggaattcgcacgagaccattacctagaacatcctaatcgaaaaacgagtgttctgcctcccgaatctcggtcgcgaagagactctccatctccgccgccgccatcatcggcgccaatctcgcgctccgctctgctccgcggcctccacgcccttggtgcccccacccccgtctcccgcccgggtgcctcccctgccccgttcacggtccccgcccccatccctcgaccggcgcgcatgtcgctgctgctgccacagcgcgtacgtgcccccgccccgtcgcgtcctcgccacatcggcgcgccccgtctgagttagcttcaggtctagcgacccgatctggaggcgggcaaaggcgtcacagacgaagatggacttgtctgcgtgcggagccgccgccgcaggcacctgcagtacgatgtcagtgggaatggacagctcggagtcgacggagagcagcccccagcgaaggaacaaccaaaaggtccgcaaggaggacccaaaaccaagaggccccccggggaagggggcttttttaaaccccaaccccccccccccgggaaacccaagtcctggggacccaaaaaaaaaaaacagcgggggggaaaacaaaagtgtttttgaaaaaaaaagccccccccccactggggggagaggaggggggg

SEQ ID NO: 15547 - DNA, 785 bp, Zea mays
  misc_feature: Ceres CLONE 1378435-F
  misc_feature: Encodes the peptide sequence at SEQ ID NO. 15548
  misc_feature (310)..(310): n is a, c, t, g, unknown, or other
cgcggtggcggccgctctagaactagtggatcccccgggctgcaggaattcgcacgagaccattacctagaacatcctaatcgaaaaactactccgccactttgttagcaaagctcctcctcgatccatcgatcactgcaccggccggcggcaccgcgctcgcaggggctagccaacgagacggcagcaatggcggaccgtgaccgcatcggcatctactgtggcgcccacgtcgactacgggcagcagcagcatcaggcatgatgcggtcgcccgatgggtgagccagtgcaaggcatgctccacgacnaggggccgacggcgtcacaagagctgacggtggccaccctgttcccgctgggcgagctactgctggtgctgtcggggctagcactttaggacctccaggagggggcctgccccggccaccccggggttcctggaacttcaggccccggggtggggccccccgcgctgttcatcgggaagggccggcattggggttccccacaaccggccgcgctgggggatccgcggggcttataccccccctcacggggcccccccaaaccgggaggggggggggtttccaacgcacccccgagtaatagggggggaaaggcccccccagaatggggggaaacccccgggccccaaacgagaccccaaaaacacccgcagggaagggcgggccctcccgggcatggggggcaagaatcggcgcccccggcgggggagggaaaaaaaaaccccccccccccaaaaaaaagaggggggttttcttt

SEQ ID NO: 15548 - protein, 40 aa, Zea mays
  misc_feature: Ceres CLONE 1378435-F
  misc_feature (12)..(12): Xaa is any aa, unknown, or other
MGEPVQGMLHDXGPTASQELTVATLFPLGELLLVLSGLAL

SEQ ID NO: 15549 - DNA, 799 bp, Zea mays
  misc_feature: Ceres CLONE 1378437-F
  misc_feature: Encodes the peptide sequence at SEQ ID NO. 15550
  misc_feature (675)..(675): n is a, c, t, g, unknown, or other
  misc_feature (716)..(716): n is a, c, t, g, unknown, or other
cgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatgcagcttgagcgtgccgctgccgccagcagcagcctgtacgagccagctctgatgcagcagcagcagcagctgctggcagcccagggtctcaaccccatgcccatgatgatggcgcagaacatgccggccatgggtggactctaccagtaccagctgcccagctaccgcaccaaccccctgtggcgtctccgctggcattcngccctactactgattcatgatatttgggaaatctcctctantcatctctctctatctatatatggaataatggagtaagacgaacacattatcatgtggtgtatgacccatttatatgctgggc

SEQ ID NO: 15550 - protein, 200 aa, Zea mays
  misc_feature: Ceres CLONE 1378437-F
  misc_feature (189)..(189): Xaa is any aa, unknown, or other
MKMVIVLVVCLALSAASASAMQMPCPCAGLQGLYGAGAGLTTMMGAGGLYPYAEYLRQPQCSPLAAAPYYAGCGQPSAMFQPLRQQCCQQQMRMMDVQSVAQQLQMMMQLERAAAASSSLYEPALMQQQQQLLAAQGLNPMPMMMAQNMPAMGGLYQYQLPSYRTNPLWRLRWHSALLLIHDIWEISSXHLSLSIYGIME

SEQ ID NO: 15551 - DNA, 775 bp, Zea mays
  misc_feature: Ceres CLONE 1378438-F
  misc_feature: Encodes the peptide sequence at SEQ ID NO. 15552
  misc_feature (530)..(530): n is a, c, t, g, unknown, or other
  misc_feature (558)..(558): n is a, c, t, g, unknown, or other
  misc_feature (559)..(559): n is a, c, t, g, unknown, or other
  misc_feature (669)..(669): n is a, c, t, g, unknown, or other
  misc_feature (748)..(748): n is a, c, t, g, unknown, or other
tccccgcggtggcggccgctctagaactagtggatcccccgggctgcaggaattcgcacgagaccattacctagaacatcctaatcgaaaaagatccacaacaaatagcgaaaccctagcccaaactcgaccgcctctgctataagtagctccactctctctcctccaagcctaccccagccgccgccgccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctcgaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacnagagaccatggagatgctcgctgccctnncgcatgccgacctgcccggcgttgagcgccaggctgaagtctccaacgcccccgctacgggcgcccgcagtaacgtggtccccgccgtgacgcgtttagactttcgcgtnggttgctcttgatccactgctattcgaaggtgtggcaactatgctaacttctttaaatctttggtgcatctgtggcggntaagttttgacttgcctgtatggataa

SEQ ID NO: 15552 - protein, 138 aa, Zea mays
  misc_feature: Ceres CLONE 1378438-F
  misc_feature (1)..(122): Pfam Name: Ribosomal_S17e Pfam Description: Ribosomal S17
  misc_feature (100)..(100): Xaa is any aa, unknown, or other
  misc_feature (109)..(109): Xaa is any aa, unknown, or other
MGRVRTKTVKKTSRQVIEKYYSRMTLDFHTNKKVLEEVSILPSKRLRNKVAGFSTHLMRRIQRGPVRGISLKLQEEERERRMDFVPEKSALEVEEIRVDXRPWRCSLPXRMPTCPALSARLKSPTPPLRAPAVTWSPP

SEQ ID NO: 15553 - DNA, 809 bp, Zea mays
  misc_feature: Ceres CLONE 1378441-F
  misc_feature: Translation starting site: 236
  misc_feature (463)..(463): n is a, c, t, g, unknown, or other
  misc_feature (559)..(559): n is a, c, t, g, unknown, or other
  misc_feature (632)..(632): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatggttttgagaagccctctgcaattcagcagagaggaattggtcccttctgncaggctcttgatgtcattcagcaagcacaatctggtacaggaaagacagcaaccttctggttctgggatctggcagcagctggactatgggctggnatgatggcaggccctggtccttgctcccaccgtgagcttgcacagcaaattgagaaggcatgcgagcgctggntgattaccttgganggtaaggccatgcatgtgtgggaggacatccgtccgggaggaccaaaggaatctgggcagtgcggggcatgttggttgtgcaacccccgggtcgggtggttggtatggtgggaaaaaaggtcctccggctgataacatcaagatggttggtcctggatgaact

SEQ ID NO: 15554 - DNA, 902 bp, Zea mays
  misc_feature: Ceres CLONE 1378445-F
  misc_feature: Encodes the peptide sequence at SEQ ID NO. 15555
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (36)..(36): n is a, c, t, g, unknown, or other
ttttccccnccctcccnnnnnttccaccacccaccngagagatatggagaaaactggagctccaccgcggtggcggccgctctagaactagtggatcccccgggctgcaggaattcgcacgagaccattacctagaacatcctaatcgaaaaacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtcccgccgccggtccagcccgtgatcgtcgtccagggcgtcatctactgcaagtcctgcaagctcaggggctacaacagcggcatggacgcgtcccctctccccaatgcgacggcgagcctggtgtgctacggcgacgcggagagcaagtaccgggtgctgaaccagacgagcacgggccaccgacacgaacggctacttcttcgtgatggtgtacgacgtgggcatggttccgaccgccgcagttgcaaggtggatcctccgctcctccgccgagggggactcttgggccgcggcccttcattcccgtccaaaccccaaggctgggggcttcccccctcggggagagaaccgcgcgggcccacgggggcccacaggggccggcgaggcgggaattcttcccaccccctaagaactgccgcctacattggtacccgccccgggggcaacccgggcgggaaaaggtgcccccg

SEQ ID NO: 15555 - protein, 213 aa, Zea mays
  misc_feature: Ceres CLONE 1378445-F
MASLKDHCAVVAVVVAICFVVLAAALPSHASTAVDEPAKYKPSRAPAPSPASASSYVPPPVQPVIVVQGVIYCKSCKLRGYNSGMDASPLPNATASLVCYGDAESKYRVLNQTSTGHRHERLLLRDGVRRGHGSDRRSCKVDPPLLRRGGLLGRGPSFPSKPQGWGLPPSGREPRGPTGAHRGRRGGNSSHPLRTAAYIGTRPGGNPGGKRCP

SEQ ID NO: 15556 - DNA, 896 bp, Zea mays
  misc_feature: Ceres CLONE 1378447-F
  misc_feature: Translation starting site: 251
  misc_feature: SWISSPROT Homolog: EC 4.1.1.35 UDP-glucuronate decarboxylase
  misc_feature (7)..(7): n is a, c, t, g, unknown, or other
  misc_feature (14)..(14): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (44)..(44): n is a, c, t, g, unknown, or other
  misc_feature (46)..(46): n is a, c, t, g, unknown, or other
  misc_feature (283)..(283): n is a, c, t, g, unknown, or other
ttccccnccccccntncnnatccccccacccctagggtggtttntntaatattggagctccccgcggtggcggccgctctagaactagtggatcccccgggctgcaggaattcgcacgagaccattacctagaacatcctaatcgaaaagtccgccccagtctaatccgattcaaaccgcccgttccccgtgtccgtgccaagcaagccgagcccaacccccaagagccagctgctcggtgctccacgcgatggcgcagaaggagactaatggcagcaacggngatcacatctccacccgcccgccgccgaccccctcgcccctccgcttctccaagttctttcaggctaacctgcggatcctggtcactggtggggcggacttcatcggctcgcacctcgtagacaagctcatggagaacgagaagcacgaggtcattgttgctgataacttttttcactggttcaaaagacaacctgaagaaggggattgggcacccaagatttgagctcatccggcatgatgtcaccgagccgcttcttgtggaagttgaccaaatctatcaccttgcttgccctgcttccacaatctttctacaagcacaacccctgtttaagaccatcaagacacaatggtaattgggaccctgaaaattgctaggacttggcaaaagagaggtggaacctaggaattttgttgacatccagcctctggaggtttaatgggggatccacttggaccatcctccaaaatggaggccctactgggggccaatgttaaaccccaatgtgggggttaagaagttgcttattgatgaagggtaaaagcgtgtaacaaaaagaaccctgaagggttccactaatcaaaagcgcggcttggtaatttaaaactccgcc

SEQ ID NO: 15557 - DNA, 733 bp, Zea mays
  misc_feature: Ceres CLONE 1378449-F
  misc_feature: Translation starting site: 224
  misc_feature: SWISSPROT Homolog: EC 2.4.1.207 Xyloglucan:xyloglucosyl transferase
  misc_feature (602)..(602): n is a, c, t, g, unknown, or other
  misc_feature (608)..(608): n is a, c, t, g, unknown, or other
  misc_feature (631)..(631): n is a, c, t, g, unknown, or other
  misc_feature (651)..(651): n is a, c, t, g, unknown, or other
gctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtccggctccgggttccagtccaagagcgagtacctgttcggcaagatcgacatgcagatcaagctggtgccaggcaactccgtggcacggtcaccaccttctacctgtcgtcccagggcgacgcgcacgacgagatcgacttcgagttcctgggcaacgtgagcggagagccctacacgctgcacaccaacgtgttcacgcgcggacaggnccagcnggagcagcagttccgcctctggntcgaccctaccactgccttncacacctactccatcctgtggaacccgcagcacgtgatctttccgttggacggcaccccggtgcgggactttcagaacacga

SEQ ID NO: 15558 - DNA, 784 bp, Zea mays
  misc_feature: Ceres CLONE 1378451-F
  misc_feature: Encodes the peptide sequence at SEQ ID NO. 15559
  misc_feature (360)..(360): n is a, c, t, g, unknown, or other
  misc_feature (437)..(437): n is a, c, t, g, unknown, or other
  misc_feature (499)..(499): n is a, c, t, g, unknown, or other
  misc_feature (571)..(571): n is a, c, t, g, unknown, or other
  misc_feature (592)..(592): n is a, c, t, g, unknown, or other
  misc_feature (593)..(593): n is a, c, t, g, unknown, or other
  misc_feature (651)..(651): n is a, c, t, g, unknown, or other
  misc_feature (705)..(705): n is a, c, t, g, unknown, or other
  misc_feature (708)..(708): n is a, c, t, g, unknown, or other
  misc_feature (709)..(709): n is a, c, t, g, unknown, or other
ggagctccccgcggtggcggccgctctagaactagtggatcccccgggctgcaggaattcgcacgagaccattacctagaacatcctaatcgaaaaactcatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcgncaggtggagacgcaccactacgtctcccgcctcaaccaggacttcctccagtgcgccgtctatgactcccgacaagncgacgcgcgtctcatcggcgtggagtacatcgtgtcgaggaagatcttcgactcgctgccgncggaggagcagcggctgtggcactcgcacgcgcacgagatcaagtcaggcctgtggacgagcccgcacgtgncggggctgctggagaaggcgnnactgaacacatggccgcacgttcggcaaggtctggtgcacctggcaggtggaccgcgngaccgcctgccgctgggcgcccccccgtcatggtgtccccgcaggcgaccccgncgnnagcgtgggcccgacctggcccgaagcagaacgacagtacggctcctccacgaagagctcccggcgcttaggcccc

SEQ ID NO: 15559 - protein, 210 aa, Zea mays
  misc_feature: Ceres CLONE 1378451-F
  misc_feature (26)..(201): Pfam Name: DUF1264 Pfam Description: Protein of unknown function (DUF1264)
  misc_feature (95)..(95): Xaa is any aa, unknown, or other
  misc_feature (116)..(116): Xaa is any aa, unknown, or other
  misc_feature (140)..(140): Xaa is any aa, unknown, or other
  misc_feature (147)..(147): Xaa is any aa, unknown, or other
  misc_feature (186)..(186): Xaa is any aa, unknown, or other
MASSDGKPLPTPASVGGGGGSSTAPPGQPTTVASKVLDMGAAAMQSLRPVKQAKQHMCTFALYAHDPKRQVETHHYVSRLNQDFLQCAVYDSRQXDARLIGVEYIVSRKIFDSLPXEEQRLWHSHAHEIKSGLWTSPHVXGLLEKAXLNTWPHVRQGLVHLAGGPRDRLPLGAPPSWCPRRRPRRXRGPDLARSRTTVRLLHEELPALRP

SEQ ID NO: 15560 - DNA, 739 bp, Zea mays
  misc_feature: Ceres CLONE 1378452-F
  misc_feature: Encodes the peptide sequence at SEQ ID NO. 15561
aaagctggagctccccgcggtggcggccgctctagaactagtggatcccccgggctgcaggaattcgcacgagaccattacctagaacatcctaatcgaaaaaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcggaggcggacctcaagtgcctgtgcggctacaagaactcgccgtggatgggcgtctacaacatcgaccccaagcgcgccatggagcttccggtcaagtgcggtctcgccacgccgcccaactgctagcagtgtgctagccaagccaagccaagcaggaaggcccccggcattgctagctgtacgtgtctgtgtgtgcatctgcagcaggatgcaggcaggggcccgtacgtacgggtctctttctctctctcatcttgacgccgtacctatctagagtgtgtgtggtcgtactaattaaatgctcttgtcgtcgtcgtctgtgcatgcatgtgacatgtcgtcgtgcatgtcta

SEQ ID NO: 15561 - protein, 115 aa, Zea mays
  misc_feature: Ceres CLONE 1378452-F
  misc_feature (41)..(115): Pfam Name: Tryp_alpha_amyl Pfam Description: Protease inhibitor/seed storage/LTP family
MAATSSKSSSSSSSAQRAAAALLVAAAVAVSVLVVGAAAVCDMSNEQFMSCQPAAAKTTDPPAAPSQACCDALAEADLKCLCGYKNSPWMGVYNIDPKRAMELPVKCGLATPPNC

SEQ ID NO: 15562 - DNA, 784 bp, Zea mays
  misc_feature: Ceres CLONE 1378458-F
  misc_feature: Encodes the peptide sequence at SEQ ID NO. 15563
gctggagctccccgcggtggcggccgctctagaactagtggatcccccgggctgcaggaattcgcacgagaccattacctagaacatcctaatcgaaaaaccgaattcattccacccccgtctcctccgatcggaccaccgggccagcagcggggcggatcgtgacgtcatcagccatggtgaaggcctaccccacggtgaacgaggactacctcaaggcggtcgacaaggccaagcgcaagctccgcggcctcatcgccgagaagaattgcgccccgctcatgctccgcctcgcaaggaactccgcgggcaccttcgatgtggacaccaaaaacgggggcccctttcgccaccttgaacataccccccgaagcgggggcacggcggccaacgccgttactgtatattgcccattaagggtggtaaaaaccccttccaggtcacaggttctcattcctagatctaacccggcaattctacccaatcttgactgcgagaccgtcgacactccaatgctaaccccgccgggactttggattgtttccccctccaaccaccgggtaggtacaggcaacagccattgatctctcccgccccggtacggccgtccctatctttatgggccccactaaaggcttatagaattacccttcagattccgcactttctcatcacaaacgcgaaaaaactgagaacacccagtcatccagctgcccaaccttccaggacggatactcaccccattggattatacaacccacttgacccctgatcttctcttctc

SEQ ID NO: 15563 - protein, 135 aa, Zea mays
  misc_feature: Ceres CLONE 1378458-F
  misc_feature: SWISSPROT Homolog: EC 1.11.1.11 L-ascorbate peroxidase
MVKAYPTVNEDYLKAVDKAKRKLRGLIAEKNCAPLMLRLARNSAGTFDVDTKNGGPFRHLEHTPRSGGTAANAVTVYCPLRVVKTPSRSQVLIPRSNPAILPNLDCETVDTPMLTPPGLWIVSPSNHRVGTGNSH

SEQ ID NO: 15564 - DNA, 737 bp, Zea mays
  misc_feature: Ceres CLONE 1378460-F
  misc_feature: Encodes the peptide sequence at SEQ ID NO. 15565
  misc_feature (638)..(638): n is a, c, t, g, unknown, or other
  misc_feature (639)..(639): n is a, c, t, g, unknown, or other
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgccgcgggaccgcaagtaccccaacggctcccgccccaaccgcgccgccgggtcgggctactggaaggccacgggcgcggacaagcccgtggagcacgggggccggacggcggagatcaagaaggcgctcgtgttctaccacggcaagccgccgcgcgnngtcaagacggagtggatcatgcacgagtaccgctccgccggcgacgcgaagaagtccggcgccggcacgctcagggtaagcggcgagcacctcgcgtn

SEQ ID NO: 15565 - protein, 166 aa, Zea mays
  misc_feature: Ceres CLONE 1378460-F
  misc_feature (21)..(147): Pfam Name: NAM Pfam Description: No apical meristem (NAM) protein
  misc_feature (134)..(134): Xaa is any aa, unknown, or other
MAAVQQQQQQQRRDAEAELNLPPGFRFHPTDEELVAHYLCARAAGRRPPVSIIAEVDLYRFDPWDLPERALFGRREWYFFTPRDRKYPNGSRPNRAAGSGYWKATGADKPVEHGGRTAEIKKALVFYHGKPPRXVKTEWIMHEYRSAGDAKKSGAGTLRVSGEHLA

SEQ ID NO: 15566 - DNA, 725 bp, Zea mays
  misc_feature: Ceres CLONE 1378461-F
  misc_feature: Encodes the peptide sequence at SEQ ID NO. 15567
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (709)..(709): n is a, c, t, g, unknown, or other
tggagctccccgcggtggcggccgctctagaactagtggatcccccgggctgcaggaattcgcacgagaccattacctagaacatcctaatcgaaaggcggacgggcgattgcacgcccgtgacttcgaccccgacgtcccttcccaactcgtccaccgccgccgcccgccgtcgcaaaactcgccagcggccagccatggggtacacgaaggaccagcttctcgcgcacctccagaagcttaagattgatttcacgtgctacgatcacccggttgtgttgacagtgtaggaacaggccaaacatgttggccatttaggaggtgctttgagcaaaaatttactcttgaaggacaagaagcatcggttatatgttatttctgcccttgctggcaccaaagttgacatgaaaattctttcccaacgtcttgggttgggaaaaggtggtctacgaatggctcctgaggaaaatcttctagaagtacttcaggtgcccttagggtgtgttactccttttgctttaataaacgagtctgcgagtgctgtttcacttttacttgatcaggnnnttcagtctaaacagagctgctacttccatccactgacaaatgatgtgacaattgctcttagctcaagtaatctgggacaagttctccatctcattgggaagcaaccagcatatgtggactggcaggctgcaccagctgaggntaacgataatcctcct

SEQ ID NO: 15567 - protein, 107 aa, Zea mays
  misc_feature: Ceres CLONE 1378461-F
  misc_feature (54)..(54): Xaa is any aa, unknown, or other
  misc_feature (55)..(55): Xaa is any aa, unknown, or other
  misc_feature (102)..(102): Xaa is any aa, unknown, or other
MKILSQRLGLGKGGLRMAPEENLLEVLQVPLGCVTPFALINESASAVSLLLDQXXQSKQSCYFHPLTNDVTIALSSSNLGQVLHLIGKQPAYVDWQAAPAEXNDNPP

SEQ ID NO: 15568 - DNA, 709 bp, Zea mays
  misc_feature: Ceres CLONE 1378462-F
  misc_feature: Encodes the peptide sequence at SEQ ID NO. 15569
  misc_feature (111)..(111): n is a, c, t, g, unknown, or other
  misc_feature (295)..(295): n is a, c, t, g, unknown, or other
  misc_feature (333)..(333): n is a, c, t, g, unknown, or other
  misc_feature (390)..(390): n is a, c, t, g, unknown, or other
aagctggagctccccgcggtggcggccgctctagaatagtggatcccccgggctgcaggaattcgcacgagaccattacctagaacatcctaatcgaaaaaatgcagcagnagccgtctgcctcctcgctttccctttcgtccgtacgccgccgcctcgcaccgccgacagtcctcagtccagaactccagatcgagcctccctctcccagatcgggtcctaggctacagcagccgccgcatccgtcaccttcacaccgcgtgggtggtctctctcccccctccccctctcgtgngacgactgagtgggctaccgccgccctacgcaaggtgncgagaactttcgcgatatctggcgcggagaacagcgccgaccagatcaggcgcttanaaggcgcgctgcccggtgaatgacgatggcgggtggcgggggactgaaccgggcctcatcaagggggcagctgccgccgcaagagctgcttgacgactctggagccggttccctctgaatgggcccaaggagagctgggagctttcgagcgagtcctgttcctggtggagcagggcactgggtttaatgaggaaaactccgtgagaacaaccccaactcaagcccctctcttcaaggatttcctcccctcaggtcaaaaggtgaatggtctccggcctaaatggggaactgggtgatataacagggattcaacattaca

SEQ ID NO: 15569 - protein, 30 aa, Zea mays
  misc_feature: Ceres CLONE 1378462-F
MAGGGGLNRASSRGQLPPQELLDDSGAGSL

SEQ ID NO: 15570 - DNA, 741 bp, Zea mays
  misc_feature: Ceres CLONE 1378464-F
  misc_feature: Translation starting site: 265
atagctggagctccccgcggtggcggccgctctagaactagtggatcccccgggctgcaggaattcgcacgagaccattacctagaacatcctaatcgaaaagatttcttctcttaactctcgcgtctcgcgtccttttcccttcctcccctccgttgcgtccctccgtccgtccgtccgtcgtcaccagcctcctccctcgcgcccaccgccgggatccgtccctcctcgtctgcgcccgcctcggtctagatttctgagaaaatggcgagaagtgcgggaactaggaggcgtgtggctcgccagctcaagtccacacatcccattccttcataccgatggaagtcaaagcccatgaaaaagccgatgaaaaaatccaaccgaaagcaagtgttgccaaccttgcaaaagatggactgggaagatgccaattgctctgtgtgcatggaatacccacataatgctgtgctcatcctttgctcatccccatgataagggttgtcgtccttatatgtgtggaactagctaccgccactctaattgcttggatcagttcaagaaagcttacaccaaggcgggcattgcttgaggaagttcctgcaaatagggttggctctaatctggattcggcgccattggctgcaaaaaaaactgactccattgaccttggaatgtccattgggggcctggcaaggggaaagggtggaacgttggccggaaccagctcgaaacctacctcca

SEQ ID NO: 15571 - DNA, 710 bp, Zea mays
  misc_feature: Ceres CLONE 1378466-F
  misc_feature: Encodes the peptide sequence at SEQ ID NO. 15572
  misc_feature (382)..(382): n is a, c, t, g, unknown, or other
  misc_feature (597)..(597): n is a, c, t, g, unknown, or other
  misc_feature (643)..(643): n is a, c, t, g, unknown, or other
  misc_feature (650)..(650): n is a, c, t, g, unknown, or other
  misc_feature (651)..(651): n is a, c, t, g, unknown, or other
  misc_feature (688)..(688): n is a, c, t, g, unknown, or other
ggagctccccgcggtggcggccgctctagaactagtggatcccccgggctgcaggaattcgcacgagaccattacctagaacatcctaatcgaaaagatctaggccgccgcctctcctactgcatctccctcgctctcgtcgcctcgttcgcttcgcctccgccccgccccgccccgagtagagcgcagccctatccggagctgggatggcggacgcgaagcagcagcagcagcagcagcagcagcagccacagcaggcggcagcggcagccaccggcgtgtggaagacggtcaagcccttcgttaacggcggagcctctgggatgctcgcgacctgcgtcatccagcctatcgacatggtcaaggtgaggatccagttgcntgagggctctgctggtcaggtcacaaggaacatgcttgcaaatgagggtgtccgttctttctacaagtgtttgtccgccggattgctgagggcagcgacgtacacgactgctcgtcttggatcctttagggttctaactaacacagcagttgactagaatgaagggaagccattggctctatctcagaaagcttttattggtctgactgctggtngcattggtgcttgtgttcgtgagcctgctgatctggcactcattanaatgganngcgatcgaccctgcagttgcaaacgacgcaatatgangagtgcttccatgactctaccg

SEQ ID NO: 15572 - protein, 110 aa, Zea mays
  misc_feature: Ceres CLONE 1378466-F
  misc_feature (27)..(108): Pfam Name: Mito_carr Pfam Description: Mitochondrial carrier protein
  misc_feature (59)..(59): Xaa is any aa, unknown, or other
MADAKQQQQQQQQQPQQAAAAATGVWKTVKPFVNGGASGMLATCVIQPIDMVKVRIQLXEGSAGQVTRNMLANEGVRSFYKCLSAGLLRAATYTTARLGSFRVLTNTAVD

SEQ ID NO: 15573 - DNA, 669 bp, Zea mays
  misc_feature: Ceres CLONE 1378468-F
  misc_feature: Encodes the peptide sequence at SEQ ID NO. 15574
  misc_feature (544)..(544): n is a, c, t, g, unknown, or other
tggagctccccgcggtggcggccgctctagaactagtggatcccccgggctgcaggaattcgcacgagaccattacctagaacatcctaatcgaaaaaacccagggtgagtctccggatccgtcgccgtctggtctccgtgtgctctcgtcgccgtcgccgtcgccgccgtctgactgaccccctcgcctcccgcggcgtcgggtctctggtgctgctgctactgctgctgcgtgcagggctgtgatggcgacgaagaggagcgtgggcaccctcggcgaggcggatctgaagggtaagaaggtgttcgtgcgcgccgacctctacgtccctctcgacgacgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttgttccacgcttgtctgagctccttgaagttgaagtcgtgatggccaatgattgcattgntgaggaagttgagaaagttgctgccgctttgcaagatggtggagttctgctccctagagatgttagattctacaaggaggaagagaagacggaccctgagtttgctaagagctagcatctgttgt

SEQ ID NO: 15574 - protein, 137 aa, Zea mays
  misc_feature: Ceres CLONE 1378468-F
  misc_feature (3)..(137): Pfam Name: PGK Pfam Description: Phosphoglycerate kinase
  misc_feature: SWISSPROT Homolog: EC 2.7.2.3 Phosphoglycerate kinase
  misc_feature (100)..(100): Xaa is any aa, unknown, or other
MATKRSVGTLGEADLKGKKVFVRADLYVPLDDAQKITDDTRIRASVPTIKFLLEKGAKVILASHLGRPKGVTPKYSLKPLVPRLSELLEVEVVMANDCIXEEVEKVAAALQDGGVLLPRDVRFYKEEEKTDPEFAKS

SEQ ID NO: 15575 - DNA, 676 bp, Zea mays
  misc_feature: Ceres CLONE 1378469-F
  misc_feature: Encodes the peptide sequence at SEQ ID NO. 15576
tggagctccccgcggtggcggccgctctagaactagtggatcccccgggctgcaggaattcgcacgagaccattacctagaacatcctaatcgaaaaatcacctataatattttgagcatttagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacgtctaacaatacatagcatcgcaacgcaacagcaaccacctgttcctaccagaactgagccacctagccatggtgaacccctgccgcctactttgcacagcagctgcttgcatccaacccacttgctctagcaaaggtattgcaaaacagcaaaaacacaattgaaaaagttctggcaggggttaatcacctaccatgttgaacctggcccctaactaaaaaggaacaacggttttatataacccctccctggggccaagccccaaatacctg

SEQ ID NO: 15576 - protein, 122 aa, Zea mays
  misc_feature: Ceres CLONE 1378469-F
MATKILSLLALLALFASATNASIIPQCSLAPSSIIPQFLPPVTSMAFEHPAVQAYRLQQAIAASVLQQPIAQLQQQSLARLTIHSIATQQQPPVPTRTEPPSHGEPLPPTLHSSCLHPTHLL

SEQ ID NO: 15577 - DNA, 653 bp, Zea mays
  misc_feature: Ceres CLONE 1378474-F
aagctggagctccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctcctaggtccagcggcctaagtggacccagcttccaggccctcaagcatcgggcccgcctccctccccgaacgccagtggcaaggccgaaaaccccggccccggcccaaaggtaaagggggaggtttggctttttgtgggggccccaagggtttagttgaaggcccaaaaggttaaaagcccccaaaaattggggaaaaaggggggttttagaaacccccggggtgttttttttttaaaaaaggaaaaaaaaaaaaaaccgtgggggggggaaaaaataaaaaaaaaaacaaccccgcggaagaaaaa

SEQ ID NO: 15578 - DNA, 730 bp, Zea mays
  misc_feature: Ceres CLONE 1378478-F
  misc_feature: Encodes the peptide sequence at SEQ ID NO. 15579
gctggagctccccgcggtggcggccgctctagaactagtggatcccccgggctgcaggaattcttcgctgactgttacctacgatgtcgtagtaccaccaccaggacattcgataagtataaatttgaatgatatttttggccaagcaaatgtcaatgctagcggtcaaggatcaagtcaaacagggaattcaaataaccatactccatctgcttctttctcaactggtgctgctgttcctcctccctttgccttctcgggctcaggaaatgaaggaacgcaggcacgccaagcttctaatggacttgaaggggaacatggtgaaccaggcatacacagggatgatgacgtccatataaatttgtctgcacccgagcaggctgcggaggctttgagagctgtgatgcagatgcttcggccacagatgggtcaacatgagggtgcacctagaggaccagggtaaacgtgggaggtaggaaaagtgttacgtggcgaattgtggtctgcaggagtcttatacgggacattattttgtcctctccatcctgaccaaaaatggagattctcgtgcgccttattattatagcagcttattctgggggctacaacaattccaacggtattgggtacccggggtcaacctatcttgccctggtcataatggcgggaggtggggaattaacctgggctggggcctgggtctttgttttttagaaattttctcccaaag

SEQ ID NO: 15579 - protein, 153 aa, Zea mays
  misc_feature: Ceres CLONE 1378478-F
LELPAVAAALELVDPPGCRNSSLTVTYDVVVPPPGHSISINLNDIFGQANVNASGQGSSQTGNSNNHTPSASFSTGAAVPPPFAFSGSGNEGTQARQASNGLEGEHGEPGIHRDDDVHINLSAPEQAAEALRAVMQMLRPQMGQHEGAPRGPG

SEQ ID NO: 15580 - DNA, 731 bp, Zea mays
  misc_feature: Ceres CLONE 1378481-F
  misc_feature: Encodes the peptide sequence at SEQ ID NO. 15581
  misc_feature (595)..(595): n is a, c, t, g, unknown, or other
  misc_feature (690)..(690): n is a, c, t, g, unknown, or other
aagctggagctccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcggcatgggtaagattatgatcggaatcaacggcttcggaaggatcggcaggctcgcggccagggtcgccctccagagcgaggatgtcgagctcgtcgccgtcaacgaccccttcatcaccacggactacatgacctacatgttcaagtacgacaccgtccacggccactggaaggacagcgacatcacactcaaggactccgagacccttctcttcggtgacaagccggtcaccgtctttggcatcaggaaccctgaggaaatcacgaggtgtgaggctgacgctgagtacgtcgtgtagtccacgctgtcttcactgacaaggacaaggctgctgcacatctccaaggttgctgtcaagaacgttgttatctctgcccccaagcaagatgtgcccatgtttgttgttggtgtcaatgangacaagtacacctcggatggtaacattgtttccaatgctaagttgccctacaactgccttgctccccttagctagggcattcatgacacttcagnatagtggagcgttgatgacactgttcatgcatccctgcacc

SEQ ID NO: 15581 - protein, 98 aa, Zea mays
  misc_feature: Ceres CLONE 1378481-F
  misc_feature (4)..(95): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIMIGINGFGRIGRLAARVALQSEDVELVAVNDPFITTDYMTYMFKYDTVHGHWKDSDITLKDSETLLFGDKPVTVFGIRNPEEITRCEADAEYVV

SEQ ID NO: 15582 - DNA, 700 bp, Zea mays
  misc_feature: Ceres CLONE 1378482-F
  misc_feature: Encodes the peptide sequence at SEQ ID NO. 15583
tggagctccccgcggtggcggccgctctagaactagtggatcccccgggctgcaggaattcgcacgagaccattacctagaacatcctaatcgaaaactacaagctctttggaggagtagagacttccagccatcccttctacgctctccccgttcccgtgtcgtcctcccgacaaagagggagccgctagggtttagcggcttccgcttctgggcgagggcttacccgcgagggacggcgcgacgcggcggaacttgagctagggtttccctccgatcccgttcctttcccggagaggcgatggacgaggcgtcgattgacgacttgatccggtggctcctcgaggcccgcggcggtcgcaccccgcgcaacgcgcaggtgactgacgccgagatccgagcgctctgcgccaccgccatgaacgatgtcctctcccagcccaaccctctgtagctcgaggcccccattaagatatgcggggatgtgcatgtgcagcattcagaccctcctccgataatttgaggatgtgggctatccaacagaggcaaattatctggctcctgagggattatgttgttccggggaaaccggacctaactaaccatttggccttcccctgggggaaaaaatataaggccccagaaaaatttctttctttcccggggaaacccatggaaggggccccaattcaccggtatt

SEQ ID NO: 15583 - protein, 50 aa, Zea mays
  misc_feature: Ceres CLONE 1378482-F
  misc_feature: SWISSPROT Homolog: EC 3.1.3.16 Phosphoprotein phosphatase
MDEASIDDLIRWLLEARGGRTPRNAQVTDAEIRALCATAMNDVLSQPNPL

SEQ ID NO: 15584 - DNA, 722 bp, Zea mays
  misc_feature: Ceres CLONE 1378483-F
  misc_feature: Encodes the peptide sequence at SEQ ID NO. 15585
  misc_feature (572)..(572): n is a, c, t, g, unknown, or other
ggagctccccgcggtggcggccgctctagaactagtggatcccccgggctgcaggaattcgcacgagaccattacctagaacatcctaatcgaaaaatctcatcttcgtctgtgttcttgggcgtacgcggacgcagccccgatccgaatcgtcgttccttgcgagactcgccgatcccccactcccctcccctcgcttcaagatgcatatctttgtgaagaccctcaccgtcaagactatcaccctcgaggtgtagtcttctgacaccattgacaatgtcaaggctaagatccaggacaaggagggcatccctcctgaccagcagcggcttatcttcgccggaaagcagcttgaggacggacgcacacttgctgactacaacatccagaaggagtcaaccctccacttggtgctgcgccttaggagaggcatgcagatctttgtcaagaccttgactggcaagacaatcacccttgaggtggagtcctcagacaccattgacaatgtcgaggcaaagatccaggacgaggagggcatcccacctgaccagcaacgtctcatctttgccggnaaggagttggaggatgtgaggacccttgctgactgacacatccagaaggagagcacgctccgactaggtgctgcgtcttaggcgtgggatgcagatctttgtgaaaaccttactggtaagaccatcactcttggaggtggagtcttcaga

SEQ ID NO: 15585 - protein, 58 aa, Zea mays
  misc_feature: Ceres CLONE 1378483-F
  misc_feature (6)..(59): Pfam Name: ubiquitin Pfam Description: Ubiquitin family
MQIFVKTLTGKTITLEVESSDTIDNVEAKIQDEEGIPPDQQRLIFAGKELEDVRTLAD

SEQ ID NO: 15586 - DNA, 723 bp, Zea mays
  misc_feature: Ceres CLONE 1378484-F
  misc_feature: Encodes the peptide sequence at SEQ ID NO. 15587
  misc_feature (262)..(262): n is a, c, t, g, unknown, or other
  misc_feature (268)..(268): n is a, c, t, g, unknown, or other
  misc_feature (313)..(313): n is a, c, t, g, unknown, or other
tggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtgtcggtgtccgtcctgatgatgggcgcgncgccgntgtgcgacatgagcaacgagcagttcatgtcgtgccagcccgcgnggacaagacgacggaccccgcgggcgcgccgtcgcaggtgtgctgggacgcgctggggggggcgacctcaagtgcctgggcggctacaaaactcgccggggatggggcgttaacacatcgaccccaagcgcgccatgaagctttcggccaaggtggggctccccacgccgcccgactgctatcagtgtggtagccaagcccagccaagcaggaaagcccccgggcattgctagctggacgggcctgggtgtgcatctgaaagagggtggaagcaaggggccccgacgtacggggtctttttccttctttcatcttggcaccggacctaattaagaaggggggggggcccaacaaaataaaaaagggtcttgggcccccccccccctggggattggcttggacccatgggg

SEQ ID NO: 15587 - protein, 91 aa, Zea mays
  misc_feature: Ceres CLONE 1378484-F
  misc_feature (38)..(38): Xaa is any aa, unknown, or other
  misc_feature (40)..(40): Xaa is any aa, unknown, or other
  misc_feature (55)..(55): Xaa is any aa, unknown, or other
MAATSSKSSSSSSSAQRAAAALLVAAAVSVSVLMMGAXPXCDMSNEQFMSCQPAXTRRRTPRARRRRCAGTRWGGRPQVPGRLQNSPGMGR

SEQ ID NO: 15588 - DNA, 633 bp, Zea mays
  misc_feature: Ceres CLONE 1378507-F
  misc_feature: Encodes the peptide sequence at SEQ ID NO. 15589
  misc_feature (618)..(618): n is a, c, t, g, unknown, or other
ggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgacacatcggtctcgttggtttgttcccgttgtttcaaccnagggatccgtgccgt

SEQ ID NO: 15589 - protein, 133 aa, Zea mays
  misc_feature: Ceres CLONE 1378507-F
  misc_feature (58)..(131): Pfam Name: PAP_fibrillin Pfam Description: PAP_fibrillin
  misc_feature (129)..(129): Xaa is any aa, unknown, or other
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILATHRSRWFVPVVSTXGSVP

SEQ ID NO: 15590 - DNA, 628 bp, Zea mays
  misc_feature: Ceres CLONE 1378518-F
  misc_feature: Encodes the peptide sequence at SEQ ID NO. 15591
tccccgcggtggcggccgctctagaactagtggatcccccgggctgcaggaattcgcacgagaccattacctagaacatcctaatcgaaaaatatcccatccatcacagctagctagcgtacagacgaataatctcttcttcacctcactagctaacaccagctagcagctcgatcgctctgtcctgcaataatggccgctcgctcctcctcccagcagctggtcgcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcgacggcggaccggcaggccacctgcaactgcctcaagagcatgacgggccggctcggcggcggcgtcagcatggccaacgccgccaacatccccggcaagtgcggcgtctccgtcggcgtgcccatcagccccaccgtcgactgcaccaagatcaactgatcgatggaccgtagtggaggtagctatgcctctgcatgctcgttggatggcagcg

SEQ ID NO: 15591 - protein, 126 aa, Zea mays
  misc_feature: Ceres CLONE 1378518-F
  misc_feature (36)..(122): Pfam Name: Tryp_alpha_amyl Pfam Description: Protease inhibitor/seed storage/LTP family
MAARSSSQQLVAAAVLAAALLLLAAGAGTASAAVSCGEVTSSVAPCLGYAMGSAASPSAACCSGVRSLNSRASSTADRQATCNCLKSMTGRLGGGVSMANAANIPGKCGVSVGVPISPTVDCTKIN

SEQ ID NO: 15592 - DNA, 639 bp, Zea mays
  misc_feature: Ceres CLONE 1378519-F
  misc_feature: Encodes the peptide sequence at SEQ ID NO. 15593
aagctggagctccccgcggtggcggccgctctagaactagtggatcccccgggctgcaggaattcgcacgagaccattacctagaacatcctaatcgaaaaacatcgaaccatccatctcctcaccctcgttcaccacacagtccgccactcctttagtagcttgcgatttgtacgtctacgacatcactgggcgggtggctcacgacgacacatgcataagggtagtgtgggtgcatcatggtgggcgttcctcctgctcgccggcgtgctgctggtcgtaacagccacggccgtggcgcaggacggagtggtcaaacgggaccgcaaggaggacctgcggtggtgcaagcaggcgagcgagtggcagtacggaaaggacaccccgcggaagagggaatgcgagagcgagtgccgcgagcgggaccagcaagctgacgcgggcgaggacggcgacagcggcgtggacgcctacgtctcccgctcccggaggggcgagtgccggcaccagtgcctgcgccgccacgagggccacccgtgggagacccaggagtgcatgagggggtgcctccgccgcggactggccgtcaacatggagcaagagtacggtcgtggcatcgacagccccggcaattgccgg

SEQ ID NO: 15593 - protein, 142 aa, Zea mays
  misc_feature: Ceres CLONE 1378519-F
MHKGSVGASWWAFLLLAGVLLVVTATAVAQDGVVKRDRKEDLRWCKQASEWQYGKDTPRKRECESECRERDQQADAGEDGDSGVDAYVSRSRRGECRHQCLRRHEGHPWETQECMRGCLRRGLAVNMEQEYGRGIDSPGNCR

SEQ ID NO: 15594 - DNA, 657 bp, Zea mays
  misc_feature: Ceres CLONE 1378530-F
  misc_feature: Encodes the peptide sequence at SEQ ID NO. 15595
aaagctggagctccccgcggtggcggccgctctagaactagtggatcccccgggctgcaggaattcgcacgagaccattacctagaacatcctaatcgaaaaatatatgtaacttcattcttgcaacatcacaagcacacaggctttcacacccatcttgcattggctctccggctgctgttcttgcttcctcgctgcacacaaccaagcaaagtcacttttccaaggtaaagaagcatgcatccgagctgctctccactggcagtgcctccgggcttccggttccacccgacagacgaggagctcctctactactacctgaggaagaaggttgcctatgagcccatagatcttgatgtcataagggaggtggacctcaacaagcttgaaccatgggacctcaaagatcggtgcaggattgggacggcggagcctcaggacgagtggtatttcttcagccacaaggacaggaagtaccctacggggacgcgaaccaaccgggcgacgacggctgggttctggaaggcgaccggacgggacaaggccatcttcctcggcaacgctgggaggaggatcggcctgaggaagacgctggtgttttacactggcagggcaccccatggcaagaagacggactggatcatgcacgagtaccgc

SEQ ID NO: 15595 - protein, 140 aa, Zea mays
  misc_feature: Ceres CLONE 1378530-F
  misc_feature (10)..(140): Pfam Name: NAM Pfam Description: No apical meristem (NAM) protein
MHPSCSPLAVPPGFRFHPTDEELLYYYLRKKVAYEPIDLDVIREVDLNKLEPWDLKDRCRIGTAEPQDEWYFFSHKDRKYPTGTRTNRATTAGFWKATGRDKAIFLGNAGRRIGLRKTLVFYTGRAPHGKKTDWIMHEYR

SEQ ID NO: 15596 - DNA, 639 bp, Zea mays
  misc_feature: Ceres CLONE 1378536-F
  misc_feature: Encodes the peptide sequence at SEQ ID NO. 15597
tccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagtacggctccaagttcgt

SEQ ID NO: 15597 - protein, 37 aa, Zea mays
  misc_feature: Ceres CLONE 1378536-F
MSSLHATRAELGLVVLYLNKAEARDKICRAIQYGSKF

SEQ ID NO: 15598 - DNA, 511 bp, Zea mays
  misc_feature: Ceres CLONE 1378540-F
  misc_feature (80)..(80): n is a, c, t, g, unknown, or other
gcggtggcggccgctctagaactagtggatcccccgggctgcaggaattcgcacgagaccattacctagaacatcctaantcgaaaagccacatctgttctactgagtggtaatccgagcacgcggcgccgtgcgaggactgcatcctgcttcttccggtcgcgcccgacccggccgcagaatcagatcccggtgccactgggtgccttccctcctccctcatcgaagctttgggcctgtcgccgcctccctgcatcgcacccctgttactggccttctgcgggagaaaaatgggttgggaaacggtgtgaagggggcacaccccctgaaaggggggggatccccctccccaacccaaaaggaaaaaaatccttctttttcttaccaggggaaaaaatcccgtgggtcccgggaagggcctttttttttcttagggggagcccccccccccccaaaaaggggggggcctccccccgggggtttttttttgggggaaaaaataaatgggggt

SEQ ID NO: 15599 - DNA, 687 bp, Zea mays
  misc_feature: Ceres CLONE 1378541-F
  misc_feature: Encodes the peptide sequence at SEQ ID NO. 15600
  misc_feature (370)..(370): n is a, c, t, g, unknown, or other
  misc_feature (472)..(472): n is a, c, t, g, unknown, or other
  misc_feature (473)..(473): n is a, c, t, g, unknown, or other
cgcggtggcggccgctctagaactagtggatcccccgggctgcaggaattcgcacgagaccattacctagaacatcctaatcaaagccggatatgccactccccgcaccgttccgagttttctccccaccctcctccgcggctgccagtcccgccggagcgcagcgcgtgctgctctacggacgccgcgcgccgttcgcgggagcgctcctgtttttcagcatcggcgccgtcagcgctgcggtcgcgttcaggacagggtgcgccatctcccaccgacgtccccccttcctcggggcaagaggtctcagttcaactagaatggagtcagcttcgaccacagtgccatccattgtcgtgtatgtgacagntccaaacagggaagcagggaagaagctgtcacagagcatcatcagcgagaagcttggctgctgtgtcatatagtacctggcattgaatcgtgtactggtggnnaggggaaaggtacaatctgatggctgaagaattactcatcatcaagaccagggaatccctttctggatgccttggactggccatggcaaaggccatcttggaatttgagggttccggaaggtattggcccgccccaaaaggggggggacccccagggtttttggaaggggggcaaaaaaacccccccggaaaaggggacccccttttttttttt

SEQ ID NO: 15600 - protein, 116 aa, Zea mays
  misc_feature: Ceres CLONE 1378541-F
  misc_feature (93)..(93): Xaa is any aa, unknown, or other
MPLPAPFRVFSPPSSAAASPAGAQRVLLYGRRAPFAGALLFFSIGAVSAAVAFRTGCAISHRRPPFLGARGLSSTRMESASTTVPSIVVYVTXPNREAGKKLSQSIISEKLGCCVI

SEQ ID NO: 15601 - DNA, 901 bp, Zea mays
  misc_feature: Ceres CLONE 1378552-R
caaattgggtaccgggccccccctcgaggtcgacggtatcgataagcttttttttttttttttttcggatgcacagtaaagtgctataatcttcaccgaatttagccgtaatatgcaggctcaacacacactggcaccttacaagtccagccgattactgccgagggcttcaacattctccaattttagtgtacagggtacagacaaggctgccaggcacctcattcggttcttgacaacacaagcagatacagtaaaagtaattttctagtgccattcacattccgatcagaacctatcccctatggagctctacagttcagatggcaactcctacaaaaaaaaaatgacaccctctctgtgtcaggcagtaaaagcaatagcattgatgcatgatcaccaccccttcccctgtcaagcgggtaaaagcaatagccgttgatgtatggatacaaatcttggcaatttcgggtggctagcaacattgatcgccagccccactgcacccactaattttatactggggcccattggctttaggtggcccccccattcacccaaactccacccccgggaggaatttgagtttcctcccaagtggccatccaaattggttcaaaagggcaccacttttcgggggagccattttcccaaattggggggcggaaaaaaaacccgtgggctgcaaagggaattggcccccggtaaaaaagtttccttccccaaaggaaccaaaagacaagccttggcccccggaaaaatgtgggggcaaaaaataatagtggccccccaacccagaaaacattttttaaccggggatattttgtaaacccctggccctacccaaaaatagggccttacccattatttgggccccccatatagcgaatggctttaaaga

SEQ ID NO: 15602 - DNA, 629 bp, Zea mays
  misc_feature: Ceres CLONE 1378555-F
  misc_feature: Encodes the peptide sequence at SEQ ID NO. 15603
aaagctggagctccccgcggtggcggccgctctagaactagtggatcccccgggctgcaggaattcgcacgagaccattacctagaacatcctaatcgaaaacacaaaaaccctaggtggccaccccttttttttcccttcaccccccctcttggccgccaccccctttttctccccctggctggatgccccctccccctatggcagccatcctccattgcttcctcccccaagatctccccctacgcagcaaggatcgagaaaaggaggggcacgttgaattgaagaggaagagaggatcaaggagatgttcttccccatctcctcttgaagatttcttggggaaaccctaggtggctacactccagatcatgtctagtacatttcttcttcttcgatgaaggtgcttgttgctcatcaaggggagtgggaagtagcagcacatccaccttcattctcataataatgctgcccagacgcagccatgatttaattagaaacttcttgtcaaaggatgtttgtttttaactagtcgtgcacactgattaattcagttcatgttgttatggttgtcttcccattgctagcagattattaatgtcttatatgttttcttaaaaaaaaaaaaa

SEQ ID NO: 15603 - protein, 50 aa, Zea mays
  misc_feature: Ceres CLONE 1378555-F
MAAILHCFLPQDLPLRSKDREKEGHVELKRKRGSRRCSSPSPLEDFLGKP

SEQ ID NO: 15604 - DNA, 666 bp, Zea mays
  misc_feature: Ceres CLONE 1378560-F
  misc_feature: Encodes the peptide sequence at SEQ ID NO. 15605
  misc_feature (462)..(462): n is a, c, t, g, unknown, or other
  misc_feature (584)..(584): n is a, c, t, g, unknown, or other
  misc_feature (626)..(626): n is a, c, t, g, unknown, or other
ggagctccccgcggtggcggccgctctagaactagtggatcccccgggctgcaggaattcgcacgagaccattacctagaacatcctaatcgaaaagtctgtctggctgcctccctccgctcacctcctctgcttcttctcgctttcttccatcttggtccagcctccactcttcctgctgagccatggcggctgccgaagaagggccagagccactcaggtatcagactctggccctgagggtgagcatccactgcgagggttgcaagaagaaggtgaagaaggtgctccacagcatagaaggggtgtacaagacggacatagacacgcagcagcagaaggtggtggtcataggcaacgtctctgcagacgcgctcgtcaagaagctcctcaagtccgggaagcacgcggagccgtggccggagcctgctccagccccaccggccgccgacagcccgcccngggcccgacgggatctcccggcagcgcagggcaagaagaagaaaaaagaagaagggcaacaagagcccccgaggcggcgaacaacaagcccgccgatccggcgccagcgcccgcgcccgggnccggcggaggggcaacggcggacccaaccccccggagcagcncgacaaggctgacggcggcgcctcgtgcgagaaggcatcg

SEQ ID NO: 15605 - protein, 150 aa, Zea mays
  misc_feature: Ceres CLONE 1378560-F
  misc_feature (17)..(77): Pfam Name: HMA Pfam Description: Heavy-metal-associated domain
  misc_feature (93)..(93): Xaa is any aa, unknown, or other
MAAAEEGPEPLRYQTLALRVSIHCEGCKKKVKKVLHSIEGVYKTDIDTQQQKVVVIGNVSADALVKKLLKSGKHAEPWPEPAPAPPAADSPPXARRDLPAAQGKKKKKEEGQQEPPRRRTTSPPIRRQRPRPGPAEGQRRTQPPGAARQG

SEQ ID NO: 15606 - DNA, 663 bp, Zea mays
  misc_feature: Ceres CLONE 1378571-F
  misc_feature: Encodes the peptide sequence at SEQ ID NO. 15607
  misc_feature (348)..(348): n is a, c, t, g, unknown, or other
  misc_feature (470)..(470): n is a, c, t, g, unknown, or other
aaagctggagctccccgcggtggcggccgctctagaactagtggatcccccgggctgcaggaattcgcacgagaccattacctagaacatcctaatcgaaaaaacccccctttcccgccacaccatctcctcgccgcttcccgccacctctctcccatggcggcgccgtcggcggccacgcgcaggaaactgcagcgcaagttccgcctacgaggcttcaccctcaaggtggacgccctcgaggaggccgccgccttcctcgaccgcttccccgacgccgaggacgacgcgctcgatctcctcctcgacgagctcgacaaggaaccgctgcagtcgtcgatactgganccgggacgcggtccaggcgcgtggtggcgctgcttgtcgaggccgaggagggcgctcgatgtggcgtcgccagcggccacaagcgcaaggtctggcgctggcgggtgggtggacgcgttctnccgtggccgcggttccactacgatccaatcaagaaagtattttacgagcacacaggcagattagctgtccatggagaagctggagataaagcttccctttatagggataggtatcaagtgctgctgcagagactgtctcgtgataaatatttctctaagccggcttttgacacagttgcgaccgaacactgga

SEQ ID NO: 15607 - protein, 125 aa, Zea mays
  misc_feature: Ceres CLONE 1378571-F
  misc_feature (64)..(64): Xaa is any aa, unknown, or other
  misc_feature (105)..(105): Xaa is any aa, unknown, or other
MAAPSAATRRKLQRKFRLRGFTLKVDALEEAAAFLDRFPDAEDDALDLLLDELDKEPLQSSILXPGRGPGAWWRCLSRPRRALDVASPAATSARSGAGGWVDAFXRGRGSTTIQSRKYFTSTQAD

SEQ ID NO: 15608 - DNA, 672 bp, Zea mays
  misc_feature: Ceres CLONE 1378574-F
  misc_feature (401)..(401): n is a, c, t, g, unknown, or other
  misc_feature (467)..(467): n is a, c, t, g, unknown, or other
  misc_feature (563)..(563): n is a, c, t, g, unknown, or other
  misc_feature (564)..(564): n is a, c, t, g, unknown, or other
  misc_feature (566)..(566): n is a, c, t, g, unknown, or other
  misc_feature (576)..(576): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccattacctagaacatcctaatcgaaaaactctcgctttcttctgtctcgcctcgccctcgcctttgttgatcttttcctttctcgcgttcccctcgccttcctcttcctcccccacacccaccggtcgccgcccccgtcgccccggcctcctcggtccagagacgagggggtccgcgccgttccgacgccacaccgcaaccgcatcacatcaccgcctgctcccaccgtccatccgccctccctcgatcgcgctcccccggatcgctggtacctccgcgcgcggctccgacctcatcttcctccatcgactggcatcggcagcggncggcgtgttcccggcaacccttcgaaagggtaatcaatcgccagacttttgggagctgtgggtggngggggacccggggtgaagagccaagttactgcagaggtaaccttttccgggtggtcgagtgatggcgcaaggcatcaacttccctgactcatcggnngncgtgggtggnccatgatgggtggctgggaattttggtgggaactttctgtggaatggccttctacagaagcttaggggagggcaccaaccttgtcggnccgacagc

SEQ ID NO: 15609 - DNA, 676 bp, Zea mays
  misc_feature: Ceres CLONE 1378576-F
  misc_feature: Encodes the peptide sequence at SEQ ID NO. 15610
tggagctccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagccggtagcaaggggaagaagggggcggccgggcgcaaggcaggcggccccaggaagaagtcggtgacgcggtccgtcaaggccgggctgcagttccccgtcggccggatcgggcgctacctcaagaagggccggtacccgcagcgcgtgggcactggcgcccccgtcaccctcgccgccgtcctggagtacctctccgtcgcttcagtcatggcaggaatgcaacctgagggttctcagttcgatgctaagcactatgattctaagatgcaggagctgctgagcaccggggaggactgaggagttcttcacttcatatggaggaagttttttgagagctttgatgatgagggccgtccgtgagaatcttcctgagagcgcttcattgccttatgggttttgagaaaacatctgccattcccgtaggaaaggcaattgctcccctttggcagacgccctgggcagaggccttcaacaa

SEQ ID NO: 15610 - protein, 104 aa, Zea mays
  misc_feature: Ceres CLONE 1378576-F
MDASGAGSKGKKGAAGRKAGGPRKKSVTRSVKAGLQFPVGRIGRYLKKGRYPQRVGTGAPVTLAAVLEYLSVASVMAGMQPEGSQFDAKHYDSKMQELLSTGED

SEQ ID NO: 15611 - DNA, 659 bp, Zea mays
  misc_feature: Ceres CLONE 1378579-F
  misc_feature: Translation starting site: 199
  misc_feature: Pfam Name: NMT Pfam Description: Myristoyl-CoA:protein N-myristoyltransferase, N-terminal domain
  misc_feature: SWISSPROT Homolog: EC 2.3.1.97 Glycylpeptide N-tetradecanoyltransferase
  misc_feature (221)..(221): n is a, c, t, g, unknown, or other
tccccgcggtggcggccgctctataactagtggatcccccgggctgcaggaattcgcacgagaccattacctagaacatcctaatcgaaaagatttcttcttcccatctcccgatccatcgtaacccaaaccctactccaggcagatctccgtctccgccgacgctgccggcgtgagcacagcatcagatccgctgtgatggcgttccgccgcatcctatncaccgcggtgcgccgccgctcggccgtggccgccgcggcggccgggaacgcgcgcgaggcctccacggccgtcgctgcggcgccaggtgtgctcgcccccgatgcgaccgcggtgcgcgctcccgtgatgccggatgaccgcatcggcgaggccgtcaacgccaggctccggcgggtcgagaacccagacccgcggttcctccgctacgccagccccgtgccgtcccacgcggaccacatgcccctccttgctggcgccagagacccgaggcaccactctgcccaacggactgcgactcgccacgcagtcttccctcgccgcaggaaggcgtaaacatggtgcgcttcatctactcgccggccttcctccgctgggagctccagccgccgtccttcttccgggcctggaacatcggcgttagcgccaaggaaaccgaa

SEQ ID NO: 15612 - DNA, 687 bp, Zea mays
  misc_feature: Ceres CLONE 1378596-F
  misc_feature: Encodes the peptide sequence at SEQ ID NO. 15613
aagctggagctccccgcggtggcggccgctctagaactagtggatcccccgggctgcaggaattcgcacgagaccattacctagaacatcctaatcgaaaaattatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttagtccccctccgtccgctctcacccaccgcttctatatcgccacctctctcgttgtagaagaagacactgaggatctggctttcttggaatccatttcccttgaaaatatttgggtgggaaaaaaaaaaaaaaagggccttgggggccttttttgggggccccccacaaaaaaagggggggggtttttttgaaacaagggggcctttttaaggggagacccttctcccgggggggggccacaaaagagggtaaaaaaaggggggggggggccccccccccaaaaaaaaaaaagaaggggggcggcgcttttt

SEQ ID NO: 15613 - protein, 124 aa, Zea mays
  misc_feature: Ceres CLONE 1378596-F
AGAPRGGGRSRTSGSPGLQEFARDHYLEHPNRKIISLTRLVLQISAATFTSTAPAHLCVSIVAASPPSDTTDLPLAPTKKTHRKKLTAKPHPDPVAALRRPHTERLVSSFGSGGQLHHPQLHLP

SEQ ID NO: 15614 - DNA, 700 bp, Zea mays
  misc_feature: Ceres CLONE 1378602-F
  misc_feature (201)..(201): n is a, c, t, g, unknown, or other
  misc_feature (237)..(237): n is a, c, t, g, unknown, or other
  misc_feature (279)..(279): n is a, c, t, g, unknown, or other
  misc_feature (418)..(418): n is a, c, t, g, unknown, or other
  misc_feature (419)..(419): n is a, c, t, g, unknown, or other
  misc_feature (440)..(440): n is a, c, t, g, unknown, or other
  misc_feature (443)..(443): n is a, c, t, g, unknown, or other
  misc_feature (444)..(444): n is a, c, t, g, unknown, or other
  misc_feature (449)..(449): n is a, c, t, g, unknown, or other
  misc_feature (458)..(458): n is a, c, t, g, unknown, or other
  misc_feature (459)..(459): n is a, c, t, g, unknown, or other
  misc_feature (462)..(462): n is a, c, t, g, unknown, or other
  misc_feature (471)..(471): n is a, c, t, g, unknown, or other
  misc_feature (560)..(560): n is a, c, t, g, unknown, or other
  misc_feature (561)..(561): n is a, c, t, g, unknown, or other
  misc_feature (679)..(679): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (700)..(700): n is a, c, t, g, unknown, or other
tggagctccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtnccaccggcgcaggaggccacgccgcggcgcctgcgngcagcccgggagtacgtgcactacccgaggctctcgcccagnaaggaggtggccccgcccccgcccccgccttatcacgccgccacccgccgcgcgtccgggcctacggaggcaacccctacatctactccccccgcccggcggcgccgcaccctccccgaaagaatacgatggactccgnntgaaggacgtgctcggaaganggnnggggnaagagggtnnggncgaggcggncccgcaagaccgagaccatcaccgggcaatttctggcagcactgtgagggcttttcgatttcggttgccgtatttcaccgaatcggggnnttccgaagttggttccctgtggggttttcatcaaattggttaatcgtgttgggcatttttcatgtacctttttgttattgaatatgaaaatttagggtggccggttaagttgtgcggnannnnnnnnnnnnnnnnnntn

SEQ ID NO: 15615 - DNA, 711 bp, Zea mays
  misc_feature: Ceres CLONE 1378611-F
  misc_feature: Translation starting site: 156
  misc_feature (251)..(251): n is a, c, t, g, unknown, or other
  misc_feature (322)..(322): n is a, c, t, g, unknown, or other
  misc_feature (324)..(324): n is a, c, t, g, unknown, or other
tggagctcccaccgcggtggcggccgctctagaactagtggatcccccgggctgcaggaattcgcacgagaccattacctagaacatcctaatcgaaaagcaatcaactctagtctctagccacaactcgaagtacgagtaactccggagtccggatggctgcagcgatggacgtcgacgaagccggcggcgaggagaggcgaccgtcagagaaagagctctttccgcgcgctggagtcggcggacgccgncgggtttggcttccttcgccccggcgaactttccttggggaaggaggaacggcgggtccctcttcaaggtngncggcgggtggccggggattccccagggtggggtttccgccttggccaaatggggggggggaaacccccggctttaagtggtttaatttggcaaagaacaaagaggggggtggggggcccgaatttactctccgcggcggggtttccgggaaatttctaaaatagtcgaacaatcttgttttgggggaggggggggggggtgtaaacccgggtaaatgatgggggggggggaaaaaaggtcttccctttattttggcgggggaaaaggggggggtttttcataatattggagaaaaaaataaacccccggggggggtttttgggtcccaaaaaaaaaaaaatttgttggtggggccaccctttttttaaaaagaagttggaaaactgg

SEQ ID NO: 15616 - DNA, 616 bp, Zea mays
  misc_feature: Ceres CLONE 1378613-F
  misc_feature: Encodes the peptide sequence at SEQ ID NO. 15617
  misc_feature (281)..(281): n is a, c, t, g, unknown, or other
  misc_feature (282)..(282): n is a, c, t, g, unknown, or other
  misc_feature (293)..(293): n is a, c, t, g, unknown, or other
tggagctccccgcggtggcggccgctctagaactagtggatcccccgggctgcaggaattcgcacgagaccattacctagaacatcctaatcgaaaaaaatgtacagtctacacagctgaccagagagctagtgcaagcgatctagcaagttttaatcttggaagaagccagctaggcgcgtgaatatggatcgcctcactgtgatggcgccgccgctgctcgtcctcctcctgctgctcctctcgcggtggctcggcggcggcgtccacgccgcgggggnnggcctggtggnaggagggccaaggggaagtggaagcccaaacgaagaagaaaaaaaggcaaaagggaaaggggagggggccgctccccctccccgggggggggggaatttcttaaatctaaaggggggccaagggcccgggggggcgggccacccggggggcccccgggacccttcccccgcccgggggggggtttagggaacacgggttttttcccccgaggggcccccaaaactttgttttggggcgcggaaaaaaacccctagccccgccagaaatccccctccttttcttcttaaggggggggggagaaaaaaaaaaattggcgggtctt

SEQ ID NO: 15617 - protein, 97 aa, Zea mays
  misc_feature: Ceres CLONE 1378613-F
  misc_feature (32)..(32): Xaa is any aa, unknown, or other
  misc_feature (36)..(36): Xaa is any aa, unknown, or other
MDRLTVMAPPLLVLLLLLLSRWLGGGVHAAGXGLVXGGPRGSGSPNEEEKKAKGKGEGAAPPPRGGGNFLNLKGGQGPGGAGHPGGPRDPSPARGGV

SEQ ID NO: 15618 - DNA, 676 bp, Zea mays
  misc_feature: Ceres CLONE 1378621-F
  misc_feature: Encodes the peptide sequence at SEQ ID NO. 15619
gctctagaactagtggatcccccgggctgcaggaattcgcacgagaccattacctagaacatcctaatcgaaaaagcagagggccatcttctactcttctctcccagccaacccccttgtccaacggttcagcctgctcaattttagtgaccagttacggcaaatgcagccctcggcggacagcaggaagaagagcgggcggcggcggaggaggaggaggctggcggcatgctactcatcgagacctgctgccggcgccgctcaaggccagtgtcagtgcggctcctctagccccggtggcggcggaggaagcggcagcctcgtggcaagaacaccgcgcgcggtctcgagctgctccagctacgccgcctcgtccgcctgcgcgccggaggtggtcgtccatctcggcacccagcacaagttgacggggctcctcgacgagctcgcgctcccacctccgtctcctcgcccactccctcctgttagtccgtcccgttgcggccaatcccgatggcattacgcacgacgataccactctaacgcgcgggtcgaacggtccttgaaccgcccttaagtatatcgccccacacgcaccgcggcatgccgccgccccgagacagggccggggcaagtgagactacggccctccccatctcccctctacctccccatccgg

SEQ ID NO: 15619 - protein, 136 aa, Zea mays
  misc_feature: Ceres CLONE 1378621-F
MQPSADSRKKSGRRRRRRRLAACYSSRPAAGAAQGQCQCGSSSPGGGGGSGSLVARTPRAVSSCSSYAASSACAPEVVVHLGTQHKLTGLLDELALPPPSPRPLPPVSPSRCGQSRWHYARRYHSNARVERSLNRP

SEQ ID NO: 15620 - DNA, 720 bp, Zea mays
  misc_feature: Ceres CLONE 1378622-F
  misc_feature: Encodes the peptide sequence at SEQ ID NO. 15621
tggagctccccgcggtggcggccgctctagaactagtggatcccccgggctgcaggaattcgcacgagaccattacctagaacatcctaatcgaaaaaccgcagccgcagtacaatcgcctcgccttcccttccccaccagaccgtctctctcttctctctgtctctcttctcggaggcgcgaccacctcgcagcagcaagcaagcgcgaccaaatggtgcctctaggagacggaggagctgctgccgcggcgatgtccaacaacctgggggtgacgttcggcgagatgctgatcgacttcgtccccgacgtggacgggctgtcgctggccgagtcggggggcttcttcaaggcccccggcggcgcgcccggcaacgtcgcctgcgccatcgccaagctcggtggatcctccgccttcgtcggcaagttcggcgacgacgagttcgggcacatgtgggtgaacatcctgaagcagaacaacgtgaacgcggaggggtgcctgatcgacaagcacgcgcggacggcgctggacttcgtgaccctcaagcacgacggagagcgcgagttcatgttctacaggaacccgagcgcgaacatgctgctgacgtaggcggagcttgtactgagcctggtgcgtcgcgccagggtgttccactacggcgtcatctcgctcatctcagagccgtgccgctcggcgcacatgtccgccatgcgcgcagc

SEQ ID NO: 15621 - protein, 131 aa, Zea mays
  misc_feature: Ceres CLONE 1378622-F
  misc_feature: SWISSPROT Homolog: EC 2.7.1.4 Fructokinase
MVPLGDGGAAAAAMSNNLGVTFGEMLIDFVPDVDGLSLAESGGFFKAPGGAPGNVACAIAKLGGSSAFVGKFGDDEFGHMWVNILKQNNVNAEGCLIDKHARTALDFVTLKHDGEREFMFYRNPSANMLLT

SEQ ID NO: 15622 - DNA, 681 bp, Zea mays
  misc_feature: Ceres CLONE 1378623-F
  misc_feature: Encodes the peptide sequence at SEQ ID NO. 15623
  misc_feature (478)..(478): n is a, c, t, g, unknown, or other
  misc_feature (483)..(483): n is a, c, t, g, unknown, or other
  misc_feature (517)..(517): n is a, c, t, g, unknown, or other
  misc_feature (518)..(518): n is a, c, t, g, unknown, or other
  misc_feature (612)..(612): n is a, c, t, g, unknown, or other
  misc_feature (622)..(622): n is a, c, t, g, unknown, or other
tccccgcggtggcggccgctctagaactagtggatcccccgggctgcaggaattcgcacgagaccattacctagaacatcctaatcgaaaaaactacggtaactcgtctgctcgcatttcctcccaatccatcccgcctccaaacccgaactccaagtcgccccgcatcgatggcgcccaaggccgagaagaagcccgcggcgaagaagccggcggaggaggagcccgcggccgagaaggcgccggccgggaagaagcccaaggcggagaagcgtgtcccagcgggcaagtccgccggcaaggagggcggtgagggaaagaggggccggaagaagggcaagaagagcgtggagacttacaagatctacattttcaaggtgctgaagcaagtgcacccggacatcggcatttcctccaaggccatgtccatcatgaactccttcatcaacgacatcttcgagaagctcgctgccgaggncgcanggctcgcgcggtacaacaagaagcccacatcacnntcccgcgagatccagacttccgtgcgctcgtccctcccccggggagctcgccaagcacgcccgtctccgagggcaaccaggcccggtcacaagntccactccgntcctaaggtggcgaggcctccgggtggaagctttctctcggaggtccgggcggcttggg

SEQ ID NO: 15623 - protein, 170 aa, Zea mays
  misc_feature: Ceres CLONE 1378623-F
  misc_feature (57)..(127): Pfam Name: Histone Pfam Description: Core histone H2A/H2B/H3/H4
  misc_feature (103)..(103): Xaa is any aa, unknown, or other
  misc_feature (105)..(105): Xaa is any aa, unknown, or other
  misc_feature (116)..(116): Xaa is any aa, unknown, or other
  misc_feature (148)..(148): Xaa is any aa, unknown, or other
  misc_feature (151)..(151): Xaa is any aa, unknown, or other
MAPKAEKKPAAKKPAEEEPAAEKAPAGKKPKAEKRVPAGKSAGKEGGEGKRGRKKGKKSVETYKIYIFKVLKQVHPDIGISSKAMSIMNSFINDIFEKLAAEXAXLARYNKKPTSXSREIQTSVRSSLPRGARQARPSPRATRPGHKXHSXPKVARPPGGSFLSEVRAAW

SEQ ID NO: 15624 - DNA, 807 bp, Zea mays
  misc_feature: Ceres CLONE 1378630-F
  misc_feature: Encodes the peptide sequence at SEQ ID NO. 15625
  misc_feature (37)..(37): n is a, c, t, g, unknown, or other
cctcgcctatcttattttccgctctttacccccccgncgggcccctgtacaaactgggactccccgcggtggcggccgctctataactagtggatcccccgggctgcaggaattcgcacgagaccattacctagaacatcctaatcgaaaaacggaccacgggtatgttccactccaggtggaggctgcagccccggattcgcaagccgcgccgtggtttgcttgcccacaggcggccaaaccgcaccctccttcccgctcatctcgctttggatcgattggcttcgtaactggtgagggactgagggcctcggagcggattgatttgggattcctgttcgaagatttgcggagggcggcaatggcgaccgcggggaaggtgatcaagtgcaaagctgcggcgccatgccgagccggtaagccactgtcgatcgaggaggtgcagatatcgcctccccaggtcatggaggcgcgcgtcaagatccctcttcacctcgctcctgccacaccgacggctacttctgggaggcccagggggcaagactcccgtgttccctcggatcttcgggccccaggcgtggaggcatccataacgagaagcgtccggcaagggtgtcgactggacccacctcccggcgcgaccatgccccttcctgaggaccccctggccgagcggcaaaggtcgtggtccccacctggcaagtcggcccccacaggaaacatggcgggggacctggcttccaggacctagaagccccctccgcccaatgtcgacacgaattgccccaaatggtcaaaagtcctcgg

SEQ ID NO: 15625 - protein, 129 aa, Zea mays
  misc_feature: Ceres CLONE 1378630-F
  misc_feature: SWISSPROT Homolog: EC 1.1.1.1 Alcohol dehydrogenase
MATAGKVIKCKAAAPCRAGKPLSIEEVQISPPQVMEARVKIPLHLAPATPTATSGRPRGQDSRVPSDLRAPGVEASITRSVRQGCRLDPPPGATMPLPEDPLAERQRSWSPPGKSAPTGNMAGDLASRT

SEQ ID NO: 15626 - DNA, 656 bp, Zea mays
  misc_feature: Ceres CLONE 1378638-F
  misc_feature: Encodes the peptide sequence at SEQ ID NO. 15627
ggagctccccgcggtggcggccgctctataactagtggatcccccgggctgcaggaattcgcacgagaccattacctagaacatcctaatcgaaaaatcgccaacgccacgccaatagcgggcgcgcacccgacagccttgaagcccgctcgctcgctcgaccaggcgagagagacgagatccgctccggaccggcggcgagaaggatcgccggaggccgggcgatgccggtgacggaccaccagagctcatctccctcgcccttctccttcggacgctcgctgctctcgctgcgcagggaccccaccgccatgccgtcgggcgaggaggccgacctcgaggcgttccagcgccacgtggcgtcgacgctcgcggagcttctgcccgcggcggaggccgggggccgtggtagcgacgccaccgccggggcgggcgaggaggtcctctccgccgcggggaatcgccgcctggtcgaggccttcctgctgtgccaggaggaggttcgggggcttcttcgcccaggcgcgcccccgggctgggggcgctgccccggggcggcccgataaaacgggcggccgaggctccccgaagggcggccgccaccggggccctcaacgtcttggcaaccgtcgcggcgtgggacggggggtcggacc

SEQ ID NO: 15627 - protein, 113 aa, Zea mays
  misc_feature: Ceres CLONE 1378638-F
MPVTDHQSSSPSPFSFGRSLLSLRRDPTAMPSGEEADLEAFQRHVASTLAELLPAAEAGGRGSDATAGAGEEVLSAAGNRRLVEAFLLCQEEVRGLLRPGAPPGWGRCPGAAR

SEQ ID NO: 15628 - DNA, 659 bp, Zea mays
  misc_feature: Ceres CLONE 1378640-F
  misc_feature: Encodes the peptide sequence at SEQ ID NO. 15629
  misc_feature (414)..(414): n is a, c, t, g, unknown, or other
  misc_feature (505)..(505): n is a, c, t, g, unknown, or other
  misc_feature (534)..(534): n is a, c, t, g, unknown, or other
  misc_feature (543)..(543): n is a, c, t, g, unknown, or other
  misc_feature (593)..(593): n is a, c, t, g, unknown, or other
aaagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggncgaggcccccgcgtacctgcaccgcgacgacttcgcgcggtacctggacgggtacgccgcgcggttcgccgtccgcccgcgcctcccgcgngaggtccggtcggcgcggtacgacccgcnagcgcgcgntggaaggtgaagcccgtgaacctcggcacgggccaggccgagcggtacgncgcgaggttccctggtggtcgcgtccggggagaacgccgagaagtccctgccggaggtgcctgggc

SEQ ID NO: 15629 - protein, 116 aa, Zea mays
  misc_feature: Ceres CLONE 1378640-F
  misc_feature (71)..(71): Xaa is any aa, unknown, or other
  misc_feature (111)..(111): Xaa is any aa, unknown, or other
  misc_feature (114)..(114): Xaa is any aa, unknown, or other
MAAVAEEEVIVVGAGQSGLAVAACLSLRGVRALVLERDDCVGSLWRKRAYDRLHLHLTKKYCALPHAPHPXEAPAYLHRDDFARYLDGYAARFAVRPRLPREVRSARYDPXARXGR

SEQ ID NO: 15630 - DNA, 734 bp, Zea mays
  misc_feature: Ceres CLONE 1378643-F
  misc_feature: Encodes the peptide sequence at SEQ ID NO. 15631
aagctggagctccccgcggtggcggccgctctataactagtggatcccccgggctgcaggaattcgcacgagaccattacctagaacatcctaatcgaaaagtcacccacgagcccaacaaaccactcccacccggtggctcggcctcggacgccaagccactccgcgccccaatccggaagcgccgccgccgccgatcgaccggccgtcgacccatgctccgctcggcgctcttccgctcagcccccgggctccgccggtctccggggacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgaagcatgaggtggtgtcccggatcccgctcaacacggacgatgagttcaaagctgccgtcgatgccgccaggactgccttccccggctggcggaacacgcccgtcacgacgcggcatggcgtcatgttcaaggtccaggagctcatccgggctaacatggacaagcttgcagagaacatcactacggagcatggtaagacgctaggagatgcttggggcgacgtggtccgcggcctataggtggtggatcatgcttgtggcatgggaacactgcaaatgggcgaatatgtatcaaatgtttctaatgggaatgacacc

SEQ ID NO: 15631 - protein, 146 aa, Zea mays
  misc_feature: Ceres CLONE 1378643-F
  misc_feature: SWISSPROT Homolog: EC 1.2.1.27 Methylmalonate-semialdehyde dehydrogenase (acylating)
MLRSALFRSAPGLRRSPGTAHLSTAAAAAAAWLSNGPASAPSRVRLLIGGEFVESRADEHVDVTNPAKHEVVSRIPLNTDDEFKAAVDAARTAFPGWRNTPVTTRHGVMFKVQELIRANMDKLAENITTEHGKTLGDAWGDVVRGL

SEQ ID NO: 15632 - DNA, 660 bp, Zea mays
  misc_feature: Ceres CLONE 1378650-F
  misc_feature: Encodes the peptide sequence at SEQ ID NO. 15633
gctctagaactagtggatcccccgggctgcaggaattcgcacgagaccattacctagaacatcctaatcaaaaaaccatcaccgcctcgtgtgcagcgtgctcgcccacctcctctgtcgacactcagggtactgacgcaccaccccgaagccctcccgccgcgctcgcagggtgttcgacccttcgcccgcgcgccctcacgacatgcctcctccgtctccgccgccgccaagggccgccgcggcgttcgcgcacaaggtccaagaaggagctggccgcgccggcgcagcgccgcgcggctttgacccgccggacaagtccgtgcatagtgtgcgggcgcccgtcggtccggcccgccccctttctaccacccagctcgcccaaccaacccgcatatacgatcctccgcacatacactggcttgttctccaccaccccacccttccccccgccacaccacttcaccccatcctctagacttccctcaccccccggaaccacggccccccccccgcccaccgccgccatccgcgccccacgtacgccccccgcgccgcctcacccacgccgcttccctccccaacatccacctcccccctacactctcccccacggtcacacccccccgcgccccccgccctcgccgcacaccccccgcc

SEQ ID NO: 15633 - protein, 219 aa, Zea mays
  misc_feature: Ceres CLONE 1378650-F
SRTSGSPGLQEFARDHYLEHPNQKTITASCAACSPTSSVDTQGTDAPPRSPPAALAGCSTLRPRALTTCLLRLRRRQGPPRRSRTRSKKELAAPAQRRAALTRRTSPCIVCGRPSVRPAPFLPPSSPNQPAYTILRTYTGLFSTTPPFPPPHHFTPSSRLPSPPGTTAPPPPTAAIRAPRTPPAPPHPRRFPPQHPPPPYTLPHGHTPPRPPPSPHTPR

SEQ ID NO: 15634 - DNA, 714 bp, Zea mays
  misc_feature: Ceres CLONE 1378653-F
  misc_feature: Translation starting site: 209
  misc_feature (450)..(450): n is a, c, t, g, unknown, or other
  misc_feature (459)..(459): n is a, c, t, g, unknown, or other
tccccgcggtggcggccgctctagaactagtggatcccccgggctgcaggaattcgcacgagaccattacctagaacatcctaatcgaaaactaatcgagcatcgcagagataggcgtcttcgtactcgcctacctccgggggtcagacctttcccccttctcccaattccctccgacgggcgccgctccatcccgtacgacgacaccatgagggagtgcatttcgatccacgtcggccaggacggtatccaggccgcaaacgcgtgctgggagctgtactgccttgagcatgcgattcgagctgacggtcagatgcccggtgacaagaccattggtggaggcgatgatgctttcaacaccttcttcagtgagactgatggctggaagcacgtgccccgcgctgtttttgatgacgttgatccactgtcatcgatgaggtgaggactggnacctaccgncaggctctacagcctgagcagctcatcagtggaaaggaggatgcataccacaactttggccgtggacactactacattggcacggacataggtgacctatgccctgatcggcatagggagcttgccaacaactgacaggggttcaggggttcctccgcctaaacggttttggtgggaggaccgggtttgggcctggttcccccccccaaaagggcctgacttgggaaaaggggaaaaaaccagggtggggacacg

SEQ ID NO: 15635 - DNA, 749 bp, Zea mays
  misc_feature: Ceres CLONE 1378654-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (19)..(19): n is a, c, t, g, unknown, or other
  misc_feature (20)..(20): n is a, c, t, g, unknown, or other
  misc_feature (45)..(45): n is a, c, t, g, unknown, or other
  misc_feature (749)..(749): n is a, c, t, g, unknown, or other
nnnttttgggnnnnncccnnccatctcccctcccccctccccgcnccccctctacaggggggaaaagatggcgctccacgcggtggcggccgctctagaactagtggatcccccgggctgcaggaattcgcacgagaccattacctagaacatcctaatcgaaaaaattcgaagccttcccggttaccccttcggcctccacctatcaccacccgggacgtcttccatggcctcctcgtagtagaatagctctatctcaccgcaacaactcctcattacatcctttatgagaggctgatcgattggtagatacgtactcgcggtggagcagaacaacgagagacatggcgaccgacggacgcgtgttgccgccaccggccgccggcggtgctgcttggttcgtggcggtgccccgcggaccgggggacggcgtcgccggacgcggggggaaggagggggtttgccaagcgcaccgagcgcgcgggggagcgggggggggcggagggatcagagcagggggaggggcgggcgcaggtggatagcggggcccatcccgccgttccgcatccacgcggcgcacgaaatggcgcagagcacgcgggcgccttcccgcggccagaaccagcgcacgcatacacggcaggctggcgatctgcaacgataatttatttgtgattcagagcccacgaacgcgcacaaatgaaccaccccactgcggcgctccaccctacgacgcgccctggcgtcgn

SEQ ID NO: 15636 - DNA, 640 bp, Zea mays
  misc_feature: Ceres CLONE 1378678-F
  misc_feature: Encodes the peptide sequence at SEQ ID NO. 15637
tccccgcggtggcggccgctctagaactagtggatcccccgggctgcaggaattcgcacgagaccattacctagaacatcctaatcgaaaatcactccaaccaccaaccagaacgcccgacggccgtgccggttccctgcctccgccgcgccgcgtcgccacctcgcgcgcactaatccttgccattgctctgcgtggcaacattcaaatggatacgggaagcgggcccggcctccagtaccttctgtgcctcgcctgggtcgcggccaccctccccatcgccgctgccgcgctgccgatccccagggccgccggcggccgtttcatccatggcctgctctgcgccttttcatcccgcgggaagacagtcaggccttcgtcctcgtcctcgtccaaggcaaggttcaccgttccacaaaaattcttcttccatttttatgtgggccgggggtggttgtgacgactagcttgctacttgcaaaatggttctatgcatacatgaaaatgacacctttgattccagaaccatcaagttattactccacaattgctagccttcctggtttgggggttcaaaattatttctctttgacaaatttctggggtgcaacgccccatgaaacacaaaaaatcaaggcgg

SEQ ID NO: 15637 - protein, 83 aa, Zea mays
  misc_feature: Ceres CLONE 1378678-F
MDTGSGPGLQYLLCLAWVAATLPIAAAALPIPRAAGGRFIHGLLCAFSSRGKTVRPSSSSSSKARFTVPQKFFFHFYVGRGWL

SEQ ID NO: 15638 - DNA, 680 bp, Zea mays
  misc_feature: Ceres CLONE 1378681-F
  misc_feature (268)..(268): n is a, c, t, g, unknown, or other
  misc_feature (680)..(680): n is a, c, t, g, unknown, or other
gctctagaactagtggatcccccgggctgcaggaattcgcacgagaccattacctagaacatcctaatcgaaaaaccctcccccaccgccattgctcagcagcagtagtaaagccacgcctgacagacagctggttcatttctggttgctgccttgctggtggtagccctcggcgcaggcagccaagaacagagagagcgagatggatgtgaacgacgtgctgctagtggtgctggcggcggcgctggctgccatgtggtggcgtcgntgctccaagaccgggggtgtgaacggccagccggcggggcctcgggagcagacgatgctcggcgaaaaccgccccccccgacccgcccccgcccgcggcccccccatcttccgctgccccccccccccaccgcaagtccccgcgggggggctactcccctcccccaacaggcccccagccgcccccgcccgccgcgcccccgccaccccgcggccgggggacgggggtcgggcgccgcggcgacgcggcccccccgcagcggcaccgcgcgcgcggctgcggtttggtggttcccttctcttttctcggcctgcccccctgggcgccccacccacaggacacagttctcacaccccccgccgcgctcatgctctcgggtcgcgcgcgcgtccacgcctcgcccccgtacccn

SEQ ID NO: 15639 - DNA, 632 bp, Zea mays
  misc_feature: Ceres CLONE 1378683-F
  misc_feature: Encodes the peptide sequence at SEQ ID NO. 15640
  misc_feature (391)..(391): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaaaaccaactcatgctcgacggaccacctcgtcggagcttcgcatttatcgtgccgtccatgtccatgcaacagccgacgaacgccgcaagccaacttcacgccgcgatggaagcgccattgtcgctctcgtcactgcagctcgccttcacggcggtcgcggcgatcgcggcgctggccgtcgcggtggccgtcacgaggtacaaccggagatacatgggcctgaggctgcctccgggcccgcccgggtggccccgtcgtcggcaacctggttccaggtggcgttctccgncaagctcttcatccactacatccgcgagctccgcaaggagtancgcccccatcctgacgctgcgcatgggggagcgcacgctcgtgatcatcagcagcgccgagctcgcgcacaaggcgctggtggagaaaggggcggaagttcccgaagccgcccccgggaagaccacacggcgcaacatcttcttcgtcaacaaggttcacggggaaactccgcggggaacgggcccccagtgggcggc

SEQ ID NO: 15640 - protein, 141 aa, Zea mays
  misc_feature: Ceres CLONE 1378683-F
  misc_feature: SWISSPROT Homolog: EC 1.14.13.11 Trans-cinnamate 4-monooxygenase
  misc_feature (62)..(62): Xaa is any aa, unknown, or other
  misc_feature (76)..(76): Xaa is any aa, unknown, or other
MEAPLSLSSLQLAFTAVAAIAALAVAVAVTRYNRRYMGLRLPPGPPGWPRRRQPGSRWRSPXSSSSTTSASSARSXAPILTLRMGERTLVIISSAELAHKALVEKGAEVPEAAPGKTTRRNIFFVNKVHGETPRGTGPQWA

SEQ ID NO: 15641 - DNA, 669 bp, Zea mays
  misc_feature: Ceres CLONE 1378694-F
  misc_feature: SWISSPROT Homolog: EC 3.4.21.92 Endopeptidase Clp
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (524)..(524): n is a, c, t, g, unknown, or other
  misc_feature (610)..(610): n is a, c, t, g, unknown, or other
aagctggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggccccctcgcagcgaccgcagcaaggggcactcgtcagcctcaagccttgcgcctcactggcaccacaagctcctctgtggcgcgcggagtcggatggccgcgnngnngtggtgcccggcgccggcgatgtcatgggcctccctcctccgggagcgcatagtcttccctcggcacgagatcgaggacttcctcgcgggacgccgtcgtcagccagctcctcctccnttgacgcatcgacccggactctgacatcccgctcttcgtcactccaaccagggggatcccttagcgcaacatggccatctatgatntaatgcagcttgtgagggcagacgtgtcacctattggatggggcatagctggatcacag

SEQ ID NO: 15642 - DNA, 661 bp, Zea mays
  misc_feature: Ceres CLONE 1378702-F
  misc_feature: Encodes the peptide sequence at SEQ ID NO. 15643
aaagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaggaccacgggcggcgtgcacgacgggcacgccgtcgtggcttctgggagtggtgcaagggcgagaaccagagctgaa

SEQ ID NO: 15643 - protein, 167 aa, Zea mays
  misc_feature: Ceres CLONE 1378702-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDRTTGGVHDGHAVVASGSGARARTRAE

SEQ ID NO: 15644 - DNA, 597 bp, Zea mays
  misc_feature: Ceres CLONE 1378703-F
  misc_feature: Encodes the peptide sequence at SEQ ID NO. 15645
tggagctccccgcggtggcggccgctctagaactagtggatcccccgggctgcaggaattcgcacgagaccattacctagaacatcctaatcgaaaaatttttaccctttcctcgcccctacccccgccaccgccgccgccgtcgccgcagccatggcgtcgcggcgctgtctcctccgcttcctctcgatccggctcggtcctcagagatctcaacctctttgggcgatctcgactgcgacccggaccctaccctctttgtcggaggcctccggtccccagttccccgggccctcgcctcccccccgggtgtaataccccctcgggttgcaccttttggaacccgctccctccgggaccggggcccacgggaaaaaagcgaaaaaacccctccccccttttggggggccccttgggaaaaggggggaacaaaaaaaggggggggggggggggaaaaaaaacccggggggaaacccccaaaaggaaaagtttcggggggggcggggaaaaaccctcaaaagggttggggacccccccgcgggtaaaaaaaaaaaacctttttgacccccaaaaacccccttttctccccgaaaaaaa

SEQ ID NO: 15645 - protein, 53 aa, Zea mays
  misc_feature: Ceres CLONE 1378703-F
MASRRCLLRFLSIRLGPQRSQPLWAISTATRTLPSLSEASGPQFPGPSPPPRV

SEQ ID NO: 15646 - DNA, 655 bp, Zea mays
  misc_feature: Ceres CLONE 1378715-F
  misc_feature: Encodes the peptide sequence at SEQ ID NO. 15647
aaagctggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagataattgcactggtctccagggcttcctcgtcttcaacgctgttggtgg

SEQ ID NO: 15647 - protein, 142 aa, Zea mays
  misc_feature: Ceres CLONE 1378715-F
  misc_feature (49)..(142): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADNCTGLQGFLVFNAVG

SEQ ID NO: 15648 - DNA, 718 bp, Zea mays
  misc_feature: Ceres CLONE 1378730-F
gctctagaactagtggatcccccgggctgcaggaattcgcacgagaccattacctagaacatcctaatcgaaaaacccgatccggacaccgctccaggctccacctctctcccatctcacgccaacgctcactggaccattcctccgtgctggggagcggcggagagctatccacctcgtctcaggcaccctctggcgtccccctccccccgccgcgtgccggcgagccgcggagatccggggttctggactcgcctccttctgctgactggtgaacgagcaggatcatagttcagttttggaacaggtcatcgaaaaaaataagagttggacccccaggacgggggggggggggttcctcccatcaaacaacaatgggaaggcccctttgccactggcccctttcaaatttccccgggggaaaaatggtccaccatttggggggggggaaaaggccccattccccaggggtccttggaaaacggtaaaggggggccccaaaggggcccctgggggggcgaaggcttacgttgggacccccccgaagagggaggggggagaaaactttggactcgggggaagaattattggcgcccccgggcttttgagtgggggaggggcggcgcgcctgtggcatgatattggcggagatcgcgtttggtctggggggcagaagacgttgggggggggggtgtgggggttcgacgccgcccacagg

SEQ ID NO: 15649 - DNA, 635 bp, Zea mays
  misc_feature: Ceres CLONE 1378739-F
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (455)..(455): n is a, c, t, g, unknown, or other
  misc_feature (456)..(456): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatcgaaaaaaattatttcttggcacctcagatcagcatattccatctccaatcccccgccgcgttcccccgcacgctttgacccataaagtcgatccatctccgagcaccaagttgaacacgcgatcccattcccattctcttgctcaatacaacctccggctccagcaagccgcagcgccaagcctagaagcggagcgcggaacacacgaggccaggaagaggaggtgctgccgtccccgcgccgccgctgtgggagtgcggggaatggggcggcacggcgtggaccagatcggcgctgtggcagcgttcgtctgggtcaccctccttcccttgctgctggnnngcgtccgtggtggccgnncgcccaggccggccatacaagcgagtaccggcgccaactcggctccgccatcgacatgcacccnnnnacgccgatgtctttccggcctcccccgggctacatgccgcccgagcaggttcacatcacacaaggncaatcatgatggcacagccatgatatttctcatgggtgacaacaaa

SEQ ID NO: 15650 - DNA, 659 bp, Zea mays
  misc_feature: Ceres CLONE 1378743-F
  misc_feature: Encodes the peptide sequence at SEQ ID NO. 15651
  misc_feature (306)..(306): n is a, c, t, g, unknown, or other
  misc_feature (351)..(351): n is a, c, t, g, unknown, or other
  misc_feature (391)..(391): n is a, c, t, g, unknown, or other
  misc_feature (659)..(659): n is a, c, t, g, unknown, or other
tccccgcggtggcggccgctctagaactagtggatcccccgggctgcaggaattcgcacgagaccattacctagaacatcctaatcgaaaaagcaaaactagcggcgcagtgacaaaagcccacagcttcttccccctcctccttctccgtcatccgtttcgctctctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcntcgctcttcggccacgtcgagcaggcgcccaaggaccccatcctncgcgtcaccgaggctttcctcgccgacccctcgtccgacnaagtgaacgtcggcgtcggcgcctaccgggacgacacggcccagcccgtcgtgctcagctgcgtgcgcgaggcgagcgccggatcgcggccacctcaacatggagacccttccgagggggggagcaccaagatgattgagagtccctgaactgggggacggaaaaaattctgctttctccaaaaaaaagggtaggggggggggaggggttttcaggacggggggggggcgggtctttggggtttacaaaggggttttttgggcgattn

SEQ ID NO: 15651 - protein, 107 aa, Zea mays
  misc_feature: Ceres CLONE 1378743-F
  misc_feature: SWISSPROT Homolog: EC 2.6.1.1 Aspartate transaminase
  misc_feature (59)..(59): Xaa is any aa, unknown, or other
MAMLSRAASSAARRPLLPPPRLLAVRAMASSLFGHVEQAPKDPILRVTEAFLADPSSDXVNVGVGAYRDDTAQPVVLSCVREASAGSRPPQHGDPSEGGSTKMIESP

SEQ ID NO: 15652 - DNA, 655 bp, Zea mays
  misc_feature: Ceres CLONE 1378755-F
  misc_feature: Encodes the peptide sequence at SEQ ID NO. 15653
  misc_feature (337)..(337): n is a, c, t, g, unknown, or other
  misc_feature (338)..(338): n is a, c, t, g, unknown, or other
  misc_feature (400)..(400): n is a, c, t, g, unknown, or other
  misc_feature (420)..(420): n is a, c, t, g, unknown, or other
  misc_feature (443)..(443): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaacctccgaatttagtgatccatccatctccatctccatccccatcccgtgacccgtgcacgccgccgccgcttcaagtcctaacaagccgcatcgcatcgcatgcgtgtgctgtccgaccgccatctccgcagccggctggcctagctacctcacctcactgcacgcaggcacacacaccacacccatgggtggtggcggcgatgcggcggccgtgcgctgtgccagcgctgctnnggtggcggcggcgacggcgacgctagcgcttctgctgctgctgtcaccgtcgagcgcgcagnccgatgccgtcgtccccggncggcggcgccggggccccgcggngcgggaccgggaatcgactcggcgtgcctgaactcgctgctcaacatgtcggactgcctcccgtacgtgagccaggggagcacggcgcggcgccccgacgcgccctgtggccgggagctggcgggcctcgtcggctccaaccccgtctgcctctgcgagctcctctccggcgccgccgactccaacggnatcgccgtcgactacggccgcgc

SEQ ID NO: 15653 - protein, 55 aa, Zea mays
  misc_feature: Ceres CLONE 1378755-F
MSDCLPYVSQGSTARRPDAPCGRELAGLVGSNPVCLCELLSGAADSNGIAVDYGR

SEQ ID NO: 15654 - DNA, 634 bp, Zea mays
  misc_feature: Ceres CLONE 1378761-F
  misc_feature: Encodes the peptide sequence at SEQ ID NO. 15655
  misc_feature (266)..(266): n is a, c, t, g, unknown, or other
  misc_feature (271)..(271): n is a, c, t, g, unknown, or other
  misc_feature (299)..(299): n is a, c, t, g, unknown, or other
  misc_feature (314)..(314): n is a, c, t, g, unknown, or other
aagctggagctccccgcggtggcggccgctctagaactagtggatcccccgggctgcaggaattcgcacgagaccattacctagaacatcctaatcgaaaaaaatcgtcctacgcttctgcctcctcctccacgaggtgaggaaaccctagcgactgaccatggcgttgctcccgcgcaccgcacggttggccttcctctctaccccgcggtcgtactccgccgccgccgctggcgcttgcggcgcctccccgaccctcccagcgncatancggggcgcgccccccaccggcgatgtcnaaacacggcccgagnttcctgggcctccaaaggttaatgacctgagaactgggccgggtaagggttccattttggccatgacctttggggtcccctggttgggggtcaaaataattaaccccgggggtcccgttaaaatttaaacgggtggggggaatttttgggccctcccgggcaaaataaattttgaattgttcccggaactttcccaaaaaaaaggggtcccccccccccaaggggttttaacccaaagccggggcccaaaagagggtttttttaaggggggccctttccccccccgggggggggaaaaccccacattcccccccgggggg

SEQ ID NO: 15655 - protein, 93 aa, Zea mays
  misc_feature: Ceres CLONE 1378761-F
  misc_feature (36)..(36): Xaa is any aa, unknown, or other
  misc_feature (37)..(37): Xaa is any aa, unknown, or other
  misc_feature (47)..(47): Xaa is any aa, unknown, or other
  misc_feature (52)..(52): Xaa is any aa, unknown, or other
MALLPRTARLAFLSTPRSYSAAAAGACGASPTLPAXXRGAPPTGDVXTRPEXPGPPKVNDLRTGPGKGSILAMTFGVPWLGVKIINPGGPVKI

SEQ ID NO: 15656 - DNA, 662 bp, Zea mays
  misc_feature: Ceres CLONE 1378765-F
  misc_feature: Encodes the peptide sequence at SEQ ID NO. 15657
  misc_feature (566)..(566): n is a, c, t, g, unknown, or other
  misc_feature (583)..(583): n is a, c, t, g, unknown, or other
  misc_feature (608)..(608): n is a, c, t, g, unknown, or other
  misc_feature (609)..(609): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (634)..(634): n is a, c, t, g, unknown, or other
  misc_feature (635)..(635): n is a, c, t, g, unknown, or other
  misc_feature (662)..(662): n is a, c, t, g, unknown, or other
aaagctggagctccccgcggtggcggccgctctagaactagtggatcccccgggctgcaggaattcgcacgagaccattacctagaacatcctaatcgaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaagccgccgcgccggcagcagagaaacgagctgctgctgccccggntcgagctgctgagccgnagatagcccgcgagaccaaaagagnntgcgctgtnnnaggctaaacgaganngaggagaggcagcgcctgctgttgctn

SEQ ID NO: 15657 - protein, 129 aa, Zea mays
  misc_feature: Ceres CLONE 1378765-F
  misc_feature (110)..(110): Xaa is any aa, unknown, or other
  misc_feature (116)..(116): Xaa is any aa, unknown, or other
  misc_feature (124)..(124): Xaa is any aa, unknown, or other
  misc_feature (128)..(128): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAEKRAAAAPXRAAEPXIARETKRXCAVXG

SEQ ID NO: 15658 - DNA, 702 bp, Zea mays
  misc_feature: Ceres CLONE 1378767-F
  misc_feature: Encodes the peptide sequence at SEQ ID NO. 15659
  misc_feature (573)..(573): n is a, c, t, g, unknown, or other
  misc_feature (677)..(677): n is a, c, t, g, unknown, or other
  misc_feature (678)..(678): n is a, c, t, g, unknown, or other
tacccgcggtggcggccgctctagaactagtggatcccccgggctgcaggaattcgcacgagaccattacctagaacatcctaatcgaaaaatccgcgtcactcaccagtctcctcccctaatcccactccgccgccgccagcttgcccatggcggcgacaacccacgccgcctccatgtcgttcctcctctctcacccccagtcgcgctctgccaccccaagccgccacctcccgctccgtccggcagcccgccgcgtccagtgcgccaccgacgccgccgccctttccccggcggtcaccaccaagcaccggcgcgcggcggatgagaacatccgcgaggaggcggcgcggcacccggccccgaagcagggcctgtcggcgtggtacgagcccttcccgccggccccgaacggcgaccccaacgagcgctactccctggacgagatcgtgtaccggtccagctcggggggcctcctcgacgtgcggcacgacatgggaggcgctgtccccgcttctcgggcgcctactggcgcgacctcttcgactcccgcatcgggcgaccacctggcgnacggggtcccggcgtgtggcccaggaaaggagttcgggctccccgagatcgagcccgaccacatcgtctcccctgttcgagggcaactcgaacctgttctgggnncgaagcggctggggcgcgcccacc

SEQ ID NO: 15659 - protein, 184 aa, Zea mays
  misc_feature: Ceres CLONE 1378767-F
  misc_feature: SWISSPROT Homolog: EC 4.2.3.1 Threonine synthase
  misc_feature (142)..(142): Xaa is any aa, unknown, or other
  misc_feature (177)..(177): Xaa is any aa, unknown, or other
MAATTHAASMSFLLSHPQSRSATPSRHLPLRPAARRVQCATDAAALSPAVTTKHRRAADENIREEAARHPAPKQGLSAWYEPFPPAPNGDPNERYSLDEIVYRSSSGGLLDVRHDMGGAVPASRAPTGATSSTPASGDHLAXGVPACGPGKEFGLPEIEPDHIVSPVRGQLEPVLGXKRLGRAH

SEQ ID NO: 15660 - DNA, 644 bp, Zea mays
  misc_feature: Ceres CLONE 1378773-F
  misc_feature: Encodes the peptide sequence at SEQ ID NO. 15661
  misc_feature (162)..(162): n is a, c, t, g, unknown, or other
  misc_feature (507)..(507): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatngaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagacgagcgccatgtaccagccgctccggcaacagtgctgccagcagcagatgaggatgatggacgtgcagtccgtcgcgcagcagctggagataatgatgcagcttgagcgtgccgctgccgncagcagcagcctgtacgagccagctctgatgcagcagcagcagcagctgctggcagcccaggntctcaacccatggccatgatgatggcgcaaaaatgcccgccatgggtggactctaccagtacagtaacagctgg

SEQ ID NO: 15661 - protein, 140 aa, Zea mays
  misc_feature: Ceres CLONE 1378773-F
  misc_feature (114)..(114): Xaa is any aa, unknown, or other
  misc_feature (135)..(135): Xaa is any aa, unknown, or other
MVIVLVVCLALSAASASAMQMPCPCAGLQGLYGAGAGLTTMMGAGGLYPYAEYLRQPQCSPLAAAPYYAGCGQTSAMYQPLRQQCCQQQMRMMDVQSVAQQLEIMMQLERAAAXSSSLYEPALMQQQQQLLAAQXLNPWP

SEQ ID NO: 15662 - DNA, 703 bp, Zea mays
  misc_feature: Ceres CLONE 1378779-F
  misc_feature: Encodes the peptide sequence at SEQ ID NO. 15663
  misc_feature (590)..(590): n is a, c, t, g, unknown, or other
tggagctccccgcggtggcggccgctctagaactagtggatcccccgggctgcaggaattcgcacgagaccattaagtagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctcttccagctccgctcccaccgcgcgctgctggccgccaacggnctcccgctctccacgccgcccacggcgcccgcgcccgtgccgctgcgggtccgcctgccctgcctctgctcggggggcgccggggccacgttccagcgtgccacgtacccggg

SEQ ID NO: 15663 - protein, 117 aa, Zea mays
  misc_feature: Ceres CLONE 1378779-F
MAPLPASLTPCLWLFLCLLAAPCPAARAARFACNATAPRASTCQALVSYAPPNGTATPTLAAVRALFQLRSHRALLAANGLPLSTPPTAPAPVPLRVRLPCLCSGGAGATFQRATYP

SEQ ID NO: 15664 - DNA, 727 bp, Zea mays
  misc_feature: Ceres CLONE 1378780-F
  misc_feature: Encodes the peptide sequence at SEQ ID NO. 15665
  misc_feature (574)..(574): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcatcagggaggaggcgggcgcccgatgggtgagcaggtgaagggcatgctccacgacaaggggccgacggcgtcgcaggcgctgacggtggcgacgctgttcccgctgggcgggctgctgctggagctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcggaggactgtcctcgctcacgtgcctcgccaacacggngcggcaggctgtccagcgcaccccggactacgtggaggaagcgcaccgcaggatggcggaggccgcggcgcacgcgcgccacaagaccgcgcaagcaggccaggccatccagggatgcgnnnaagcagggcggcgccccggggaagtgcaggg

SEQ ID NO: 15665 - protein, 175 aa, Zea mays
  misc_feature: Ceres CLONE 1378780-F
  misc_feature (44)..(161): Pfam Name: Oleosin Pfam Description: Oleosin
  misc_feature (125)..(125): Xaa is any aa, unknown, or other
  misc_feature (165)..(165): Xaa is any aa, unknown, or other
  misc_feature (166)..(166): Xaa is any aa, unknown, or other
MADRDRSGIYGGAHATYGQQQHQGGGGRPMGEQVKGMLHDKGPTASQALTVATLFPLGGLLLELSGLALTASVVGLAVATPVFLIFSPVLVPAALLIGTAVMGFLTSGALGLGGLSSLTCLANTXRQAVQRTPDYVEEAHRRMAEAAAHARHKTAQAGQAIQGCXXAGRRPGEVQ

SEQ ID NO: 15666 - DNA, 668 bp, Zea mays
  misc_feature: Ceres CLONE 1378783-F
  misc_feature: Encodes the peptide sequence at SEQ ID NO. 15667
  misc_feature (51)..(51): n is a, c, t, g, unknown, or other
  misc_feature (392)..(392): n is a, c, t, g, unknown, or other
  misc_feature (441)..(441): n is a, c, t, g, unknown, or other
aagctggagctccccgcggtggcggccgctctagaactagtggatcccccngggctgcaggaattcgcacgagaccattacctagaacatcctaatcgaaaaagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggagcgcctctcctcgctcgcgggcctgccccgcctcccggcgctccggngcctctccctcaccgacaaccgcctctcgggggccgccgccctcgccgncgtcgtcgaaggcatgctggcgccacgctgcgccacctcgacctagggacaaccgtttcgcggaggtccaggagctcgcgccactcgccgggggtccgggtcgagtcgctcgacctgttcagtgacccgtccaccagggtcagggggaacgggatggaggcttccagctgattccagccttcagtaccctccaggagcttgaccctgagggaaacaagggtttggga

SEQ ID NO: 15667 - protein, 110 aa, Zea mays
  misc_feature: Ceres CLONE 1378783-F
  misc_feature (80)..(80): Xaa is any aa, unknown, or other
  misc_feature (96)..(96): Xaa is any aa, unknown, or other
MAAAAAGEDDAAWERAISAATKSTSAPKTLTLDGAVKSSTGGLPSAALLERFAASLEELSVAGERLSSLAGLPRLPALRXLSLTDNRLSGAAALAXVVEGMLAPRCATST

SEQ ID NO: 15668 - DNA, 643 bp, Zea mays
  misc_feature: Ceres CLONE 1378789-F
  misc_feature: Encodes the peptide sequence at SEQ ID NO. 15669
  misc_feature (479)..(479): n is a, c, t, g, unknown, or other
  misc_feature (482)..(482): n is a, c, t, g, unknown, or other
  misc_feature (505)..(505): n is a, c, t, g, unknown, or other
agagctggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctcagtacatcagcggtgtgatcctcttcgaggagaccctgtaccagaggaccaggatggcaagcctttttgtgatgtcctcagggagggaggcgtctccctggcatcanggntgacagggcaccattgaggttgntggcactgattaggaaacaccacccaggccatgacgacctgggaaagcttgccccagtactaccaaggcagtgcccgctttgccaaggggcccttgttctcaagatgggccctaatggccatacacggtttgcctcag

SEQ ID NO: 15669 - protein, 71 aa, Zea mays
  misc_feature: Ceres CLONE 1378789-F
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALSTSAV

SEQ ID NO: 15670 - DNA, 646 bp, Zea mays
  misc_feature: Ceres CLONE 1378791-F
  misc_feature: Encodes the peptide sequence at SEQ ID NO. 15671
  misc_feature (96)..(96): n is a, c, t, g, unknown, or other
  misc_feature (120)..(120): n is a, c, t, g, unknown, or other
  misc_feature (136)..(136): n is a, c, t, g, unknown, or other
  misc_feature (151)..(151): n is a, c, t, g, unknown, or other
  misc_feature (159)..(159): n is a, c, t, g, unknown, or other
  misc_feature (160)..(160): n is a, c, t, g, unknown, or other
  misc_feature (172)..(172): n is a, c, t, g, unknown, or other
  misc_feature (174)..(174): n is a, c, t, g, unknown, or other
  misc_feature (175)..(175): n is a, c, t, g, unknown, or other
  misc_feature (404)..(404): n is a, c, t, g, unknown, or other
  misc_feature (410)..(410): n is a, c, t, g, unknown, or other
aaagctggagctccccgcggtggcggccgctctagaactagtggatcccccgggctgcaggaattcgcacgagaccattacctagaacatcctaantcgaaaaatctggatgccgtaacnacaaggcttgaatttnttggttcggtctagnccgacccnngacgatggcgtncnncagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaaagcagcgaagcagcacatgtgcacgttcgcgctgtacgcgcacgacccgaagcggcaggtggagacgcaccactacgtctcccgnctcaancaggacttcctccagtggcgcgtctatgactccgacaaagccgacgcgcgtctcatcgggggggaggacatccgtgtcgaagaagatcttcgactcgctgcccgcggaagaagcaccgctttgtgcactcgcacgcgcacgaaaatcaatcaggccctgggacgagcccccacggtggcgggcttgctggaaaaagggggaattggacccatgggccgccaccttgggaaaatttt

SEQ ID NO: 15671 - protein, 160 aa, Zea mays
  misc_feature: Ceres CLONE 1378791-F
  misc_feature (27)..(152): Pfam Name: DUF1264 Pfam Description: Protein of unknown function (DUF1264)
  misc_feature (3)..(3): Xaa is any aa, unknown, or other
  misc_feature (4)..(4): Xaa is any aa, unknown, or other
  misc_feature (82)..(82): Xaa is any aa, unknown, or other
MAXXSDGKPLPTPASVGGGGGSSTAPPGQPTTVASKVLDMGAAAMQSLRPVKAAKQHMCTFALYAHDPKRQVETHHYVSRLXQDFLQWRVYDSDKADARLIGGEDIRVEEDLRLAARGRSTALCTRTRTKINQALGRAPTVAGLLEKGGIGPMGRHLGKI

SEQ ID NO: 15672 - DNA, 652 bp, Zea mays
  misc_feature: Ceres CLONE 1378800-F
  misc_feature: Translation starting site: 412
  misc_feature: SWISSPROT Homolog: EC 3.5.1.52 Peptide-N(4)-(N-acetyl-beta-glucosaminyl)asparagine amidase
tggagctccccgcggtggcggccgctctagaactagtggatcccccgggctgcaggaattcgcacgagaccattacctagaacatcctaatcgaaaaaccaaaggtatcttgtaatcacgacgaacaaaagctctcgatctcaccgacaccgaggaagaagagatcaatggcgtccgagcagggagtcgtgatcgtgtgccacagcaaggctgagttcgacgcccacatgaccaaggcccaggaagccggcaagctggtggtcatcgacttcactgccgcctggtgcggtccatgccgcgtccatcgccccactgttcgtcgaacacgccaagaagttcactcaggtcgtcttcctgaaggtgcacgtggacgaagtgaaggaagtcaccgcggtctacgaggtcgaggtgatgacgaccttccacttcgtcaagaacggcaagacggtcgcgaccatcgtgggtgccaagaacgacgagctcctggccctgatcgagaagcatgacgcgcctgcgcctgcgtctgcgtctgcctaaaggagatcagatcagtcgtcgccgtcaataagggtcagcacgcatgggctgaagatgttgtcgttatcaggtctggctttggcatttgtgggcgattgtgacctaggaggatgtt

SEQ ID NO: 15673 - DNA, 619 bp, Zea mays
  misc_feature: Ceres CLONE 1378803-F
  misc_feature: Encodes the peptide sequence at SEQ ID NO. 15674
gctctgaactagtggatcccccgggctgcaggaattcgcacgagaccattacctagaacatcctaatcgaaaaatcctccacatctccaccgcatcggaactaggaaggcgaagccgaaggcgcggcgcggcgcggcacggatcgagcgatggcggtggcccctcctacggcggcggcgctggagcagctaagcagcagcaagatgttcgacggcttcaatctccgcttccggcaccagagcgccacccttgggctgcgccatgactttctcccatctacctggccccccggtccccgggggcccaaacctttcccggggggtggaatggggttccccgggggtcccccccgcgcccccgcgggggatggttgatcataaaggtcggggggcccaaagggggccccgccttggcccccggattttccccccggggggccccggaaccccccccccggggggggtaaaattttgtgggggggggggcgcccccctcttgctttctttgggggggggggggcgcccccccttttttttttttttgggaggccccccaaacggaagaggggggaaaaaagggggggggcgggggggacaaacacggtgggggaggagagccc

SEQ ID NO: 15674 - protein, 74 aa, Zea mays
  misc_feature: Ceres CLONE 1378803-F
  misc_feature: SWISSPROT Homolog: EC 3.1.2.12 S-formylglutathione hydrolase
MAVAPPTAAALEQLSSSKMFDGFNLRFRHQSATLGLRHDFLPSTWPPGPRGPKPFPGGGMGFPGGPPRAPAGDG

SEQ ID NO: 15675 - DNA, 616 bp, Zea mays
  misc_feature: Ceres CLONE 1378805-F
  misc_feature: Encodes the peptide sequence at SEQ ID NO. 15676
  misc_feature (261)..(261): n is a, c, t, g, unknown, or other
tggagctccccgcggtggcggccgctctagaactagtggatcccccgggctgcaggaattcgcacgagaccattacctagaacatcctaatcgaaaaacaacatctgtcaccgtgaaatctcggctacctccttctgacttctggtacctcgccgccggggacccaactccgatccccaccccaccataccaaagccaccgcggctgcggctgcggcttccgcatcatcaatggtgctgatcactctcgtccgcgactacntcgaccgcatgctccacgacatccctggcatggaggtcctcggcctcgacccccaaaccgttgggatggtgagcgtggtggacagccaggccgatctgctgcggaaggaggtcttcctcgtccagacatggacaacggcctccggtccagggagttcatgggggaacttaagggcgtctaatttcttcgaaccttcggtaacaacggccagaagcttcggagggaactccgcatggcggggtttcggcgaggaccactaatcctcttcaggaaatgggagggccccgaagatccaatacttgctgacctcgatgaaacaggagttgtgcagcaaggtcaagagttctatgctgat

SEQ ID NO: 15676 - protein, 96 aa, Zea mays
  misc_feature: Ceres CLONE 1378805-F
  misc_feature (11)..(11): Xaa is any aa, unknown, or other
MVLITLVRDYXDRMLHDIPGMEVLGLDPQTVGMVSVVDSQADLLRKEVFLVQTWTTASGPGSSWGNLRASNFFEPSVTTARSFGGNSAWRGFGEDH

SEQ ID NO: 15677 - DNA, 603 bp, Zea mays
  misc_feature: Ceres CLONE 1378809-R
  misc_feature: Translation starting site: 260
  misc_feature: Pfam Name: Orn_DAP_Arg_deC Pfam Description: Pyridoxal-dependent decarboxylase, C-terminal sheet domain
  misc_feature: SWISSPROT Homolog: EC 4.1.1.20 Diaminopimelate decarboxylase
  misc_feature (603)..(603): n is a, c, t, g, unknown, or other
cgattgggtaccgggccccccctcgaggtcgacggtatcgataagcttttttttttttttttttggaaaggaagttgaggatgcaccaactagctatccagtatccagtaacattacataacccccagaaagcaaaaatgagcttgacaaagaaaatccaattatccccaagaaaacatcgtccgtagcaggcgcagataataaacatctaagcgggaagaccatcaaagaacttcatggggtcatcaagcttctctccatgcctgatcttaacgatcgaaccgtccgcttccacccagtattccgggggcctcaacttcagggtgtacgtggaagccatgctcatgcagaaggcacctgcgtcatgaacaaccagtccagctccctcatcaggtgctggaagttccctatcttttccaaggaaatctgcagactcacaaactggtccaacaatatcgaacgtcgctgcttcagcaccaggagtggggtgagagacccagtcgatatgctggtatgctccgtacagactacgtctgatgagttctgccatggtgccatcaacaacaatgaaaatcctttggaccgttagatttaacgcccgtn

SEQ ID NO: 15678 - DNA, 655 bp, Zea mays
  misc_feature: Ceres CLONE 1378809-F
  misc_feature: Encodes the peptide sequence at SEQ ID NO. 15679
  misc_feature (328)..(328): n is a, c, t, g, unknown, or other
  misc_feature (517)..(517): n is a, c, t, g, unknown, or other
  misc_feature (536)..(536): n is a, c, t, g, unknown, or other
  misc_feature (554)..(554): n is a, c, t, g, unknown, or other
  misc_feature (589)..(589): n is a, c, t, g, unknown, or other
aagctggagctccccgcggtggcggccgctctagaactagtggatcccccgggctgcaggaattcgcacgagaccattacctagaacatcctaatagaaaaaaagtatgaatggcgacggtgagtatgttcgtgcgctcgcttctcagcactacaaaccttatccaaacgagtcacccgaaccgccagtggcgccgctgtcgtctccttctcccgccgccaccgccggctgtccgtgtgcgcctccgtctccaaggcctccacttcgctaccgccacagcccgcggcggcggctgccgtgcgtgccgatacactgcttctgcggcggngccgatgcctacgtgtactgcgaggcagtgcggatgcagcactcgatgacggttggcgagggcatccgcctctacctctagagaaatgcacatatcgttcgaaacttcgccgcactacgcgaggctctacagggcgtcgggtcatcatggcgcatcgcgagaaggtcaaatacacctcctcgtgctacnagtcctgcgtgaggtgggnttgcggagtcgtcccggntatcggaggcgagctcctatcgccctaccagggangactcgaccccggctggtgcatatttacgggacaagggaagaccctccacatcttaaattagctgg

SEQ ID NO: 15679 - protein, 100 aa, Zea mays
  misc_feature: Ceres CLONE 1378809-F
MNGDGEYVRALASQHYKPYPNESPEPPVAPLSSPSPAATAGCPCAPPSPRPPLRYRHSPRRRLPCVPIHCFCGGADAYVYCEAVRMQHSMTVGEGIRLYL

SEQ ID NO: 15680 - DNA, 632 bp, Zea mays
  misc_feature: Ceres CLONE 1378810-F
  misc_feature: Encodes the peptide sequence at SEQ ID NO. 15681
caagctggagctccccgcggtggcggccgctctagaactagtggatcccccgggctgcaggaattcgcacgagaccattacctagaacatcctaatcgaaaaatctctactcgagtctctgcgaatccgttgccggtagcctctctgcggtgagagttccgctgccgcctgctggagatgatggacgacggaggaggagggttgcagtcgcagggcgtcaacccggactgccccaacgccgccaaccccttccaccgctgcgccgcgtactgccccgtccccgccccggcccccaccaaagccgccgccgccgccgccgtgcgcagtaagccgtctccgcctcgtccgagggcaacggcggtggcagcgcagaacgggacagccaagcacggagacggcgctgcgcgtgtcgctcccgcctccgacgcggaggacgacgacgacgacggaggcgagagggaggagtcccggcctgtcaacccgggctacccggggtctccgcctcgtccggggtcgaagccgacccacgcggcgcagaacgccacccccccgccccacgaggtttgcggaggagtgcaaaatcacccgccgttcgcccagtccgaggcacaacggagaaaaaccgtcgagta

SEQ ID NO: 15681 - protein, 151 aa, Zea mays
  misc_feature: Ceres CLONE 1378810-F
MMDDGGGGLQSQGVNPDCPNAANPFHRCAAYCPVPAPAPTKAAAAAAVRSKPSPPRPRATAVAAQNGTAKHGDGAARVAPASDAEDDDDDGGEREESRPVNPGYPGSPPRPGSKPTHAAQNATPPPHEVCGGVQNHPPFAQSEAQRRKTVE

SEQ ID NO: 15682 - DNA, 630 bp, Zea mays
  misc_feature: Ceres CLONE 1378818-F
  misc_feature: Translation starting site: 187
  misc_feature (192)..(192): n is a, c, t, g, unknown, or other
  misc_feature (229)..(229): n is a, c, t, g, unknown, or other
  misc_feature (234)..(234): n is a, c, t, g, unknown, or other
  misc_feature (238)..(238): n is a, c, t, g, unknown, or other
  misc_feature (600)..(600): n is a, c, t, g, unknown, or other
tccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgncgcggcgcgatccttgccaaccttcgcgaggcggcgncgcgncggntcacagagcgggacatctggcagcagaaaaagaagctcaagaagggcggcggcggcggaaagcgcttcgtcgcgggggaggacgatgaggacttccaggccgacttgaaggcttccaaggcgaatccggggagttaaaattggaggtcagggaggggacttgagaacacaccctccaaaataaaacccctactggcagaagggtttctccccgggaggggtttaagacctggataatggtggaagcaagggcccccccgaggaaaaaaaaaaatctttttggggggatccccccacgggcttttggaaaaagggggtgttttaaataaaaacctccaaggggggggggggggttgttttttngcgtccccaaggggggaggggggggggggg

SEQ ID NO: 15683 - DNA, 657 bp, Zea mays
  misc_feature: Ceres CLONE 1378822-F
  misc_feature: Encodes the peptide sequence at SEQ ID NO. 15684
  misc_feature (428)..(428): n is a, c, t, g, unknown, or other
  misc_feature (458)..(458): n is a, c, t, g, unknown, or other
  misc_feature (521)..(521): n is a, c, t, g, unknown, or other
  misc_feature (548)..(548): n is a, c, t, g, unknown, or other
  misc_feature (606)..(606): n is a, c, t, g, unknown, or other
  misc_feature (621)..(621): n is a, c, t, g, unknown, or other
ggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccactggccgccgccggtccacctgccaccgccgggtcatgtgccgccgccggttcatctgccgccgccaccatggcactaccctactncaccgccccggcctcagcctcatccccagncacaccccatgcccgtggcaacagccgcatccaagcccgtgccagctgcaggaaaccttgcgncgttgcagcaccccgatcctgggcagntgggtcgagtttctggagcatcagtggagccggacggcgacgcctactggtcgctcangggcagtcgttgcgncaacagggttgcacagctcagggaggggaggcgcag

SEQ ID NO: 15684 - protein, 63 aa, Zea mays
  misc_feature: Ceres CLONE 1378822-F
  misc_feature (19)..(19): Xaa is any aa, unknown, or other
  misc_feature (28)..(28): Xaa is any aa, unknown, or other
  misc_feature (47)..(47): Xaa is any aa, unknown, or other
  misc_feature (52)..(52): Xaa is any aa, unknown, or other
MPVATAASKPVPAAGNLAXLQHPDPGQXGRVSGASVEPDGDAYWSLXGSRCXNRVAQLREGRR

SEQ ID NO: 15685 - DNA, 761 bp, Zea mays
  misc_feature: Ceres CLONE 1378827-F
  misc_feature: Encodes the peptide sequence at SEQ ID NO. 15686
  misc_feature (1)..(1): n is a, c, t, g, unknown, or other
  misc_feature (451)..(451): n is a, c, t, g, unknown, or other
nccccccccccaccccccccccccccaaaaaaaaaggatagggacttttcctaaaagtggggctccccgcggtggcggccgctctagaactagtggatcccccgggctgcaggaattcgcacgagaccattacctagaacatcctaatcaaaaacatccgccagccccaggcttctagcctctgtcccagccggcagcccaccacccgcgaggccgcgaccggcgaccgcccgcccctgacgcggtgactgcgtcctcctccgctctccgtgcgccaccctgaagcggtgaggcggcgacctccaggcacctccctcccccggttcggcggctccctcgaggccttcctccccacgggttcagcagctcccgatccacacggccaaaggccgattcgcgctcctccagccttcctcggcgtccaacagcaagtgaaaaacttcaacccagnaaatggcgatgtcttggacaagagggtaaagccatgggtgttgttccgaggaatgccgctcaattggtagagagcaaaagccttgcaattgcaagcaaggccgaagaaacggctgggaaaggcctgatgctggaaaaacctcctggctctcagccaagagctcgaagcgcaccacgcgggttccggccaaacctccctcccagggaaggagctcaggaaggcgaaaattcacacgagaacccctgaggcaaccctggcagggacaggggcaatagcggatcgaacgaagcgaaacccatacatatctcgg

SEQ ID NO: 15686 - protein, 70 aa, Zea mays
  misc_feature: Ceres CLONE 1378827-F
MGVVPRNAAQLVESKSLAIASKAEETAGKGLMLEKPPGSQPRARSAPRGFRPNLPPREGAQEGENSHENP

SEQ ID NO: 15687 - DNA, 733 bp, Zea mays
  misc_feature: Ceres CLONE 1378830-F
  misc_feature: Encodes the peptide sequence at SEQ ID NO. 15688
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (18)..(18): n is a, c, t, g, unknown, or other
  misc_feature (56)..(56): n is a, c, t, g, unknown, or other
nnnnncccccccctcccncgcccccccccccccacccccccccccacaaggagganccctccgcgggctgcgcgcggtggcggccgctctagaactagtggatcccccgggctgcaggaattcgcacgagaccattacctagaacatcctaatcgaaaaatcgcacatattattgagaccaactagcaacatagaaagcacaatattgtaccaataatggcagccaaaatattttgcctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggtatcttacctttatcaccccttgttcctccaacaatcatcagcccctattacagcagttaacctttggggcgattttatggggacaaaaaatcaggggagcaacactaccaccaccccgggtaaggaaacctttggtggccaacctcccgggaacggggggttaccttttggggggcttctggtgggcaccaaataaattcggggggcacaacaacttcaacaacaaactccgggggcataagaaaacccttgggggggcccaattcccccggggaaggaaaaagggggttttggggcgcttttctgcccaccgattaggggg

SEQ ID NO: 15688 - protein, 84 aa, Zea mays
  misc_feature: Ceres CLONE 1378830-F
MAAKIFCLIMLLGLSASAATASIFPQCSQAPIASLLPPYLSPAMSSVCENPILLPYRIQQAIAAGILPLSPLVPPTIISPYYSS

SEQ ID NO: 15689 - DNA, 664 bp, Zea mays
  misc_feature: Ceres CLONE 1378832-F
  misc_feature: Encodes the peptide sequence at SEQ ID NO. 15690
  misc_feature (408)..(408): n is a, c, t, g, unknown, or other
tggcggccgctctatgaactagtggatcccccgggctgcaggaattcgcacgagaccattacctagaacatcctaatcgaaaaaccagatctcgaggcagcggagtccggggacgccgttctttccgttgtgcttcctttgcctcttgctgccggtggccggtgattttcccgaggtctgtttgggcggcaggtagaggctattttcttggcggctggtgggatggatagccacgccgccgggtcgagctccggcgggtccggggatggcggcgcgcagcccaggaggagctccaggaaacccacgtattccaagtttactcagcaggagcttccagcttgcaagccgattcttactccaggatgggttatttcagtattcgttcttgttgccgtgatttttgtctcngattggtattgtttcgctgcgagcttcacgacaggttggtcgagatcgttgatcggtatgatggatgcatgtggcccctgcctggggtgactgacaagcttgcttacatccggaatgatagtatacccaacaggctgcccggggaatctgaccgttacccagggatatggagcccgcccgttttttgtggattaatcgggtgggaggggctttcaccccaatccttgcggggcctggtccacgacccccactggcg

SEQ ID NO: 15690 - protein, 91 aa, Zea mays
  misc_feature: Ceres CLONE 1378832-F
MDSHAAGSSSGGSGDGGAQPRRSSRKPTYSKFTQQELPACKPILTPGWVISVFVLVAVIFVSDWYCFAASFTTGWSRSLIGMMDACGPCLG

SEQ ID NO: 15691 - DNA, 721 bp, Zea mays
  misc_feature: Ceres CLONE 1378834-F
  misc_feature: Encodes the peptide sequence at SEQ ID NO. 15692
tccccgcggtggcggccgctctagaactagtggatcccccgggctgcaggaattcgcacgagaccattacctagaacatcctaatcgaaaagttccgcaccccacggcaggcgcttgagagtacttgactactaccctccgacctgcgagactgcaacgccgttgcttcagctcgactccagcgtccctcgtccccgtatcaccgcgccgccgacactccgctcgctttcactcccgagacccgggcctgccgagccgccgtcatggacgaggagtacgacgtgatcgtcctgcctacggggctcaaggagtgcatcctcagcgtccccctctctgtcgacggcctcagggttctaccgagggatgggagtgattactacggaggacattcccccctccctaaacgtgaaccagcttctggaagaggtttaaggggggaagacaagcctcccggggcatctagggggaaagaagaagattacaaggtaggacggggaccccaaagggggaggaggggcagacggggggcttgtttttccgaagcctctcatgtgcgacggatgtggaccagaatagggggggacttcccgaaaggggcggaaccgcaacccccagccgcctccacccaggcgggaggaagcgccgcacagggttccctgggcgccgcgggtgctgcgcgggctccgcccacagccccccgccccccccccccccccccccc

SEQ ID NO: 15692 - protein, 152 aa, Zea mays
  misc_feature: Ceres CLONE 1378834-F
MDEEYDVIVLPTGLKECILSVPLSVDGLRVLPRDGSDYYGGHSPLPKREPASGRGLRGEDKPPGASRGKEEDYKVGRGPQRGRRGRRGACFSEASHVRRMWTRIGGDFPKGAEPQPPAASTQAGGSAAQGSLGAAGAARAPPTAPRPPPPPP

SEQ ID NO: 15693 - DNA, 651 bp, Zea mays
  misc_feature: Ceres CLONE 1378835-F
  misc_feature: Encodes the peptide sequence at SEQ ID NO. 15694
  misc_feature (13)..(13): n is a, c, t, g, unknown, or other
  misc_feature (14)..(14): n is a, c, t, g, unknown, or other
  misc_feature (19)..(19): n is a, c, t, g, unknown, or other
  misc_feature (51)..(51): n is a, c, t, g, unknown, or other
  misc_feature (111)..(111): n is a, c, t, g, unknown, or other
  misc_feature (269)..(269): n is a, c, t, g, unknown, or other
  misc_feature (319)..(319): n is a, c, t, g, unknown, or other
  misc_feature (391)..(391): n is a, c, t, g, unknown, or other
tccccaacccggnncgggntggcggccgctctagaactagtggatcccccngggctgcaggaattcgcacgagaccattacctagaacatcctaatcgaaaaacacatacnagtgtcacgtccccggtccctcgcgaaccctagagccgcagcagcacactcccgcagtagcagcagccgccgccgccgccgcccagccgcaggaaacaggaggaagatgccggcggggcacgggcttcggtcgcgaacccgcgacctgttcgcgcggncgttccgcaagaaggggtacatcccgctcacacgtacctgcgcacctacnagatcggcgactacgtcgacgtcaagggtgacggcggcgtgcacagggcatggcgcacaagttctacacggncgcaccggtcgggtcttggaagtccccaagggggcctcggggttgaaatcacaagggggttaagggccccttccttcggaaacgtatcccttgcccggggggagaagtggcaacccctcccggttggcaaaaaggagtttcccttttgggggaaagccaaaaaaacgctccctttccaggggtttggccccaagagccccgggggggggggggggttccccccccccaaggggggccccctgggggggaacccccacccc

SEQ ID NO: 15694 - protein, 78 aa, Zea mays
  misc_feature: Ceres CLONE 1378835-F
  misc_feature (18)..(18): Xaa is any aa, unknown, or other
MPAGHGLRSRTRDLFARXFRKKGYIPLTRTCAPTRSATTSTSRVTAACTGHGAQVLHGRTGRVLEVPKGASGLKSQGG

SEQ ID NO: 15695 - DNA, 702 bp, Zea mays
  misc_feature: Ceres CLONE 1378836-F
  misc_feature: Encodes the peptide sequence at SEQ ID NO. 15696
ccccgcggtggcggccgctctagaactagtggatcccccgggctgcaggaattcgcacgagaccattacctagaacatcctaatcgaaaaactaaactagtgcggggtataaagctctctccctccgcgcttccgaacagttcacgacgactccaggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaggtgaagaaggtgctccagaacatcagcggcgtgtaccgatgcgaaatcgatgcccggagcaacaaggtcgtggcgacggtctcgacggagctcgacccctacatgctggtcgccaagctgcgcaagtccggcagcaggcggagctgtggccggagcagcggtgcagcagcaggagcagccggcaccaccagctgagagccaagggcagaggagcccaagacaaccagcctgcggagcgggcagacccagcgaactggcgaggagggggcgccccccccgaaaggccagaggccccggggggaaccaaaaaaccgaaccttccccggcggagccaagccaagggccggggaaaagccccaaatccggggcccagaaaaaaaaaaaaccccgccccataaacctcgggggg

SEQ ID NO: 15696 - protein, 90 aa, Zea mays
  misc_feature: Ceres CLONE 1378836-F
  misc_feature (13)..(81): Pfam Name: HMA Pfam Description: Heavy-metal-associated domain
MASSEPIECQVVALRVSIHCQGCKKKVKKVLQNISGVYRCEIDARSNKVVATVSTELDPYMLVAKLRKSGSRRSCGRSSGAAAGAAGTTS

SEQ ID NO: 15697 - DNA, 733 bp, Zea mays
  misc_feature: Ceres CLONE 1378839-F
  misc_feature (246)..(246): n is a, c, t, g, unknown, or other
  misc_feature (683)..(683): n is a, c, t, g, unknown, or other
gctctagaactagtggatcccccgggctgcaggaattcgcacgagaccattacctagaacatcctaatcgaaaaaccgcagccgcagcacaatcgcctcgccttcccttccccaccagcccgtctctctcttctctctgtctctcttctcgtagccgcgtccacctcgcagcagcaagcaagcgcgaccaaatggcgcctctaggagacggcggagctgctgccgcggcggcgtccaaaacctggntggtgtcgttcggcggaggatgctgatcgacttcgtccccaacgtggccgggctgtcccttggccccaaaaattttttttatataatacgcgacagtgtaacgcccctgggagagcggcaaagacgcacgggccccgccggcggtgatagagcggggcagccgtcgccatactgggggtgtcatgttccatatagacatctcgaaaaaaaggggcgcccccccccccgggggggggggagaaaccgcatacagagcgcgaccccggcggggcgaacaaaaaggagtgggtggccgcccgcaccctgtggggggggggggacacacaaaacattgtgcctccgacacaaaagaaaggtttttttgcgcgggggcggaggaaataatattgattcgtgcggggggcgcctgtttttttttggggatgtgtgtcagagcnagctataaaagagaaggtattcggccgggggagagaaacaacaacaaaaa

SEQ ID NO: 15698 - DNA, 743 bp, Zea mays
  misc_feature: Ceres CLONE 1378843-F
  misc_feature: Translation starting site: 471
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcgttggcagcaccccgatcctggggcagtgcgtcgagttcctgaggcatcagtgcagcccgacggcgacgccctactgctcgcctcagtgccagtcgttgcggcagcagtgtttgcagcagctcaggaaggtggagccccagcaccggtaccaggcgatcttcggttggggcctccaagccatcctggcagcagaagccgcaaaggggccaggtcccgg

SEQ ID NO: 15699 - DNA, 736 bp, Zea mays
  misc_feature: Ceres CLONE 1378851-F
  misc_feature: Translation starting site: 226
  misc_feature: SWISSPROT Homolog: EC 2.4.1.207 Xyloglucan:xyloglucosyl transferase
  misc_feature (524)..(524): n is a, c, t, g, unknown, or other
  misc_feature (525)..(525): n is a, c, t, g, unknown, or other
  misc_feature (538)..(538): n is a, c, t, g, unknown, or other
  misc_feature (569)..(569): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcgggcgcgggctggacctgacgctggaccgcacgtcccggctcccgggttccagtccaaaggcgagtacctggttcggcaagatcgacatggcagatcaagctggtgccaggcaactcccgtggcacggtcaccacccttctacctgtcgtcccagggcgaccgnncacgacgagatcngacttcgagttcctgggcaaacgtgagcggngagccctacacgctgcacaccaacgtgttcacgcgcggaaggggccaggggnnnagcagcagttcccggcctctggttcgaccctaccactgccttccaccctactcccatcctgtggacccgcagacgggaaatccttcgcggggacggaccccccggtgcgggat

SEQ ID NO: 15700 - DNA, 713 bp, Zea mays
  misc_feature: Ceres CLONE 1378852-F
  misc_feature: Translation starting site: 393
  misc_feature: SWISSPROT Homolog: EC 3.4.21.92 Endopeptidase Clp
  misc_feature (568)..(568): n is a, c, t, g, unknown, or other
  misc_feature (569)..(569): n is a, c, t, g, unknown, or other
  misc_feature (572)..(572): n is a, c, t, g, unknown, or other
  misc_feature (580)..(580): n is a, c, t, g, unknown, or other
  misc_feature (681)..(681): n is a, c, t, g, unknown, or other
  misc_feature (694)..(694): n is a, c, t, g, unknown, or other
aagctggagctccccgcggtggcggccgctctagaactagtggatcccccgggctgcaggaattcgcacgagaccattacctagaacatcctaatcgaaaaagattagtcacactcttcgcaagcaaaaaaaaaaaaaaaaaatccccaaatttcggataagcctcgccggcgacgaaatcagggtttcatcgaacaacaagatggctcacgcttgcgtctccacatcagcttcctctctcaggttcacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccaatataggattatcccnntgngggtgggngctggtggatgatgatatggccaacataatcgtagctcagcttctttccctcggatgctgttgatcctactaaggatattggttatgtatgtgaactctcntgggtggatcagntaccagctggtatggctat

SEQ ID NO: 15701 - DNA, 771 bp, Zea mays
  misc_feature: Ceres CLONE 1378855-F
  misc_feature: Translation starting site: 313
  misc_feature (407)..(407): n is a, c, t, g, unknown, or other
  misc_feature (446)..(446): n is a, c, t, g, unknown, or other
  misc_feature (502)..(502): n is a, c, t, g, unknown, or other
  misc_feature (503)..(503): n is a, c, t, g, unknown, or other
  misc_feature (539)..(539): n is a, c, t, g, unknown, or other
  misc_feature (601)..(601): n is a, c, t, g, unknown, or other
  misc_feature (611)..(611): n is a, c, t, g, unknown, or other
  misc_feature (665)..(665): n is a, c, t, g, unknown, or other
  misc_feature (672)..(672): n is a, c, t, g, unknown, or other
  misc_feature (682)..(682): n is a, c, t, g, unknown, or other
  misc_feature (744)..(744): n is a, c, t, g, unknown, or other
  misc_feature (745)..(745): n is a, c, t, g, unknown, or other
aagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcttcggacaccatccgcacggccatcggcgtcatcggcaatgggaccgccctagtgctcttcctctccccggtgcctacgtttatccnatctggaagaagggggtcgggtggagcagtactcgccgnatcccgtacgtggcgacgctgctgactgcattgattgttggggttgtttgtacggnnctggcccgctggtgcacccgcacagcaatggctggntgatcaccatcaacggcacccggcatgctcatccagctggacctacgtggcgctcttctcgnctacttcccnggggggggcggcgcgcccgcaaggtgtcccctctgcttgggccgccgaggtcgnctttcgntcggggcggncgccggggttggtggctcgcctggcgcacacccacgagcgcggggtccctgggtgtggccgnnttcctttggggtcctcttcgggcccg

SEQ ID NO: 15702 - DNA, 761 bp, Zea mays
  misc_feature: Ceres CLONE 1378861-F
  misc_feature (400)..(400): n is a, c, t, g, unknown, or other
  misc_feature (442)..(442): n is a, c, t, g, unknown, or other
  misc_feature (454)..(454): n is a, c, t, g, unknown, or other
  misc_feature (459)..(459): n is a, c, t, g, unknown, or other
  misc_feature (533)..(533): n is a, c, t, g, unknown, or other
  misc_feature (659)..(659): n is a, c, t, g, unknown, or other
  misc_feature (660)..(660): n is a, c, t, g, unknown, or other
  misc_feature (714)..(714): n is a, c, t, g, unknown, or other
ggagctccccgcggtggcggccgctctagaactagtggatcccccgggctgcaggaattcgcacgagaccattacctagaacatcctaatccaaaaatccgccttcgcctccaaccgcgtgcgctccacgcctcctccaggaaagcgagagcttctgcataagaacaacaaatcaaaagcttgatcagctcggtgcctcccccccggaacaagcaaggggcatgtgtgaccccggccttttccttaaaaaaaaaaataaagcgggggggtgaagtcccccccccccccctgtggtgctgttgctgggacagaagaaaaagtttttgccccgcctccaagagaggaaggacagaaccagttttgttacccgccccggaaaaaaaaacaaactctccctctnccctattccctccaggaaaaaaaaaaagaaaataaagctggnccgcccccgcanaatcnaacacccggacggtcgccgccgcgttttggcgttcccgggacacacccgcaaaaaagggggttaatttccaccnacccccccccccccctggccccaaaacacccgcttaatactccgcccccctcaccggacgcccgcaagccgcccggccccaattatggggacccccccattttagggaacattaaaaaacaaaaannacgaagccacggtgcgcgggggacgaacggggaaacgtggtcggtttcgggggngcggtcggccgccccccccccccaccccccacctccccccccccccc

SEQ ID NO: 15703 - DNA, 717 bp, Zea mays
  misc_feature: Ceres CLONE 1378862-F
  misc_feature (598)..(598): n is a, c, t, g, unknown, or other
  misc_feature (647)..(647): n is a, c, t, g, unknown, or other
  misc_feature (649)..(649): n is a, c, t, g, unknown, or other
  misc_feature (650)..(650): n is a, c, t, g, unknown, or other
  misc_feature (705)..(705): n is a, c, t, g, unknown, or other
aaactggagctccccgcggtggcggccgctctagaactagtggatcccccgggctgcaggaattcgcaagaagacattacctaaaaaatcctaatcgtaaaatcaaccatattattgagaccaacaagcaacatagaaagtggaatccagtagcaacaatagagcaacaatggcgaccaagatattttccctccttatgctcctttgcttctttctgcatgtgttgctaacgcgacaattttccctcaatgctcacaagctcctatagcttccctttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagncagctagctactgcctactctcagcaacaacaacttctttcatttaacnannttggcgcactgaaccccgctgcttatttgcagcagcaaatactactaacatttancagctagctgca

SEQ ID NO: 15704 - DNA, 652 bp, Zea mays
  misc_feature: Ceres CLONE 1378863-F
  misc_feature (270)..(270): n is a, c, t, g, unknown, or other
  misc_feature (277)..(277): n is a, c, t, g, unknown, or other
  misc_feature (326)..(326): n is a, c, t, g, unknown, or other
  misc_feature (331)..(331): n is a, c, t, g, unknown, or other
  misc_feature (336)..(336): n is a, c, t, g, unknown, or other
  misc_feature (337)..(337): n is a, c, t, g, unknown, or other
tggagctccccgcggtggcggccgctctagaactagtggatcccccgggctgcaggaattcgcacgagaccattacctagaacatcctaatcgaaaaatcgcacatattattgagaccaactagcaacatagaaagcacaatattgtaccaataatggcagccaaaatattttgcctcattatgctccttggtctttctgcaagtgctgctacggcgagcattttcccgcaatgctcacaagctcctatagctttcctttctcccccatnactctcnacagcgatgtcttcagtatgtgaaaatccaattcttctacccctacagnatcancaggnnatcgcagcaggcatcctacccttatcaccccttgtcctcccaaaaatcattcagccctattaaaaaaagtacccttttggggggatttatttgggcaccaaaaactttaggggaaaaaaaaataaaaaaaattcggggtaaaaaaaccttggtttcctaatttcccagaaaaagaaggtaactttttgggggcattttttgggccaaaaaaaattggggggcaaaaaaaataaaaaaaaaatttgggttaaaaaaaaactttgtggccacctctcctaaaaaaaaaaaggttttttttgcatattaaacaaaaaa

SEQ ID NO: 15705 - DNA, 728 bp, Zea mays
  misc_feature: Ceres CLONE 1378864-F
  misc_feature: Translation starting site: 227
  misc_feature (157)..(157): n is a, c, t, g, unknown, or other
  misc_feature (391)..(391): n is a, c, t, g, unknown, or other
  misc_feature (562)..(562): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (657)..(657): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaatacactgagaaccgcagagacaggcgtcttcgtactcgcctatctccgcgactcanagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtganactggcgctgggaagcacgccccccgtgggctgtttttgttgaccttgagcccctgtcatcgatgagggtgaggactggcacctaccgccagctcttccatcctgagcagctcatcagtgggcaaggaggatgcagccaacaactttcgctcgtggtcactacccattggncaagggagattgttgacctgtgccttgaccgcatcaggaagcttgcagataattgcactggtctccagggcttcccgnnnctcaacgctgttggngggagaaacggnctctggggcttgggtctctctcctgaggggccctgtctgttgatatatggcaagaggcc

SEQ ID NO: 15706 - DNA, 756 bp, Zea mays
  misc_feature: Ceres CLONE 1378865-F
  misc_feature: Encodes the peptide sequence at SEQ ID NO. 15707
aaagctggagctccccgcggtggcggccgctctagaactagtggatcccccgggctgcaggaattcgcacgagaccattacctagaacatcctaatcgaaaaagatcttgatccgttcctgttcctgttcctgctgctagctgctggttgctggggccgtgtacgtacgcgttgatgaaggtgacccggtggaagggagcggcgccggcccggccgcggtcaagaggaggcggagtggcgcgcctggcaggcgccagagcggcggcgtgagcgtgcggcggcgcgtgcaggtggacgcggcgaccgcgccagagccgacgccgctccagcgtctgcttgccgcgtgccgccgcgcgttcggaggccccggaaccgtgccgacgcaccacgacgtcgtcctcatcagagacatcctcgacaagatgcgaccagatgatgcgcacctgagagccgacaccaaggccgccgccgtattccgccggctctcgaaggagccatgttcctatcatcacacgaacccccctttataaatgcaagaacttctcgccccgagggggtcctgctggccccaggcccgaccatccctctgcaaaaccaccccggagaaggacgctggtcaaccaagcttctcccccgctcccctccccatacggtccaaccacgggggcggaggccgaccaacgtccccgccgcctgcgggaggggaatcgcccactgcctgggcgtggctcaaccctgctgttggcggctcacccg

SEQ ID NO: 15707 - protein, 35 aa, Zea mays
  misc_feature: Ceres CLONE 1378865-F
MRPDDAHLRADTKAAAVFRRLSKEPCSYHHTNPPL

SEQ ID NO: 15708 - DNA, 737 bp, Zea mays
  misc_feature: Ceres CLONE 1378866-F
  misc_feature (617)..(617): n is a, c, t, g, unknown, or other
ggagctccccgcggtggcggccgctctagaactagtggatcccccgggctgcaggaattcgcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagattaaagttgaattaattattaatggaatattctctcatatggtgcatactaatcaatttataatatagtttaatcacatagatcttccataaatcataactccttaaccatgactccgatcttactagttctcgaacccacgatctcgtagcgacgagtagatcattattatgcaatttgttcttatgtttggtgtgatgttaattattcctataccatgtttgtttgtattgctatgactagtagtgaggtcacgagaatctaaagatcatcttgatacctggaatctcnagtcccaagaaagttatgcccttgatcacttttatttacccaataatgttctttataatcatttactcctgcataggttttaattttgatggggacctaatagtcacccctagactggtt

SEQ ID NO: 15709 - DNA, 717 bp, Zea mays
  misc_feature: Ceres CLONE 1378870-F
  misc_feature: Translation starting site: 227
ggagctccccgcggtggcggccgctctagaactagtggatcccccgggctgcaggaattcgcacgagaccattacctagaacatcctaatcgaaaaatttatacccctccgtttcccacccttacctccccactccggcagtccccgtcccaccactacagccactgctgcccggccgaccgcgtccctcttcctccgccaggcgccagccgcccggtctccatcaatggtgtctgcctcgtacgccccgacgccgctgctcaaggacgagctggacatcggcatcccgacgatccgcaacctcgacttcctggagatgtggaggcccttcttccagccctaccacctcatcatcgtgcaggacggcgaccccagcaagaccatccgcgtccccgagggcttcgactacgagctctacaaccgcaacgacatcaaccgcatgctggggcccaaggcatcctgcatctccttcaaggactccgcctgccgctgcttcggctacatggtctccaagaagaagacatctacaccatcgacgatgactgcttcgttgccaggcatccatcagggaaggacatcaatgcacttgagcagcacatcaagaacctcctgagccttccactccatttttcttcaatactctgatgaccccttaccgtgttgggggcgatttttttggttacgtggtacacattcagccttgttgtggagggggta

SEQ ID NO: 15710 - DNA, 757 bp, Zea mays
  misc_feature: Ceres CLONE 1378871-F
  misc_feature: Encodes the peptide sequence at SEQ ID NO. 15711
  misc_feature (398)..(398): n is a, c, t, g, unknown, or other
  misc_feature (458)..(458): n is a, c, t, g, unknown, or other
  misc_feature (487)..(487): n is a, c, t, g, unknown, or other
  misc_feature (505)..(505): n is a, c, t, g, unknown, or other
  misc_feature (632)..(632): n is a, c, t, g, unknown, or other
ggagctccccgcggtggcggccgctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggaggaccctgcggtggtgcaagcaggcgtgcgagtggcagtacggaaaggacaccccgcggaagagggaagccnagagcgagtgccgcgagcggcaccagcaagctgacgcggggcgaggacggcgacagcggncgtggaacgcctacgtctcccgctccggnaagggggggaggtgccgnccccagtggcctgcgcccgccacgaggtccaggccgggcgaggccccaggagtggcaggagggtgttgccgccgcccgcggactgggctgcttacctggaacgtagaattagtgttggggtgcagcncagggggggggggaagtgtcgcgggaagggtggggtggggcccgccgcccggttggtatggtgctgaggagtcattccccttgttttacggactctagcaaaccctggcggcgcgtggtcttccc

SEQ ID NO: 15711 - protein, 165 aa, Zea mays
  misc_feature: Ceres CLONE 1378871-F
  misc_feature (56)..(56): Xaa is any aa, unknown, or other
  misc_feature (76)..(76): Xaa is any aa, unknown, or other
  misc_feature (134)..(134): Xaa is any aa, unknown, or other
MVGVPPARRRAAGRSSHGRGGGTEWSNGTARRTLRWCKQACEWQYGKDTPRKREAXSECRERHQQADAGRGRRQRXWNAYVSRSGKGGRCRPQWPAPATRSRPGEAPGVAGGCCRRPRTGLLTWNVELVLGCSXGGGGSVAGRVGWGPPPGWYGAEESFPLFYGL

SEQ ID NO: 15712 - DNA, 747 bp, Zea mays
  misc_feature: Ceres CLONE 1378872-F
  misc_feature: Encodes the peptide sequence at SEQ ID NO. 15713
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaagcctcggcctctgctcccggctcccccacggtactccagccgctagcctgcgattccgccagtacgccaccaccaccgagcctggactaccgccgccgcccttcgccgatatcttcagcggcgaacagcgcccaccagatcccgcccctgcgatggagtccgtggtgaacccgaaggcatacccgctggctgatgcgcagctgacgatgggtatcctcgatatcatccagcaggccgccaactacaaacagcttaagaagggagcgaatgaagcgacgaagaccctgaataggggcatatcggagtttgtagtgatggcggcggacacagagcctctcgagatcctgctccacctccccttgttagctgaggataagaacgtgccatatgtgtttgttccatcgaagcaagctcttggccgtgcttgtggtgtgacaagaccggttattgcttgctcagtgaccagtaatgagggtagccagctgaaactacagatacagggtctcaaggactccattgagaagcttctcatctgatctgccgaaaagactttcagtgtgatgggcctcagcgacacttttttcagagctgnacctggggggaggggggcctttgttaactttgcgcttttcaactatatttga

SEQ ID NO: 15713 - protein, 127 aa, Zea mays
  misc_feature: Ceres CLONE 1378872-F
  misc_feature (19)..(113): Pfam Name: Ribosomal_L7Ae Pfam Description: Ribosomal protein L7Ae/L30e/S12e/Gadd45 family
MESVVNPKAYPLADAQLTMGILDIIQQAANYKQLKKGANEATKTLNRGISEFVVMAADTEPLEILLHLPLLAEDKNVPYVFVPSKQALGRACGVTRPVIACSVTSNEGSQLKLQIQGLKDSIEKLLI

SEQ ID NO: 15714 - DNA, 727 bp, Zea mays
  misc_feature: Ceres CLONE 1378874-F
  misc_feature: Translation starting site: 222
  misc_feature (322)..(322): n is a, c, t, g, unknown, or other
  misc_feature (382)..(382): n is a, c, t, g, unknown, or other
  misc_feature (418)..(418): n is a, c, t, g, unknown, or other
  misc_feature (545)..(545): n is a, c, t, g, unknown, or other
  misc_feature (647)..(647): n is a, c, t, g, unknown, or other
tccccgcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgnatgtttgtgaaagttttgacagcatgggactgcaagagaaccttctgagaggcatctatngcctatggttttgagaagccatcggctattcagcanaggggaatagttcccttctgcagggggcttgacgtgattcagcaagctcagtctggaactggaaaaacagctaccttctgttctggatcttgcacaactggattaatggattggttgatgccaggcnattggttcttgctccaacccgtgagcttgctcagaaaatgagaaagggtatgcgtgctctggggaactaattggggtggcaagggatggcccctggggtggngggaacatcgggtcgggaggacccaagatcttttgccgggggggggcggcgtgtgttttgggcacaccccgggggggggg

SEQ ID NO: 15715 - DNA, 705 bp, Zea mays
  misc_feature: Ceres CLONE 1378875-F
  misc_feature: Encodes the peptide sequence at SEQ ID NO. 15716
  misc_feature (314)..(314): n is a, c, t, g, unknown, or other
  misc_feature (354)..(354): n is a, c, t, g, unknown, or other
cgcggtggcggccgctctagaactagtggatcccccgggctgcaggaattcgcacgagaccattacctagaacatcctaatcgaaaatatttcctgaggctatggctgatgcatcagaagacaatgaaatagcgattgaacttgacacctctgtggaaattgacgctaaaggcagttcagttggacataacttgaactttgaacccagaaaagatacaagtcatcatgagtctgccagcaacatctgtgctgatgatcagataaaaacagaacgtcagccgcaatgttttgcacgagaaaatacagcatctacnaaggttagtactcattcagtgaattcagatagtgaagacnagagctacaagcaagtcatggatactgatcctggtacaagccatagcaaagggttgatgtttgaggtgggcgctgcagaagaagacttgacatgctcctcgattcatttgccggaactcaccttccagctccaacttggacgaacatttgagccccgttcactttgcagaggatcagtcgtccaatgagaaggtgggactagcttgtcttcgggaccacctttgctggacctctcgacgatgctctaaaggactgtttcagagattcccaaatggtgaacagacgaaaggtttgctacccaatgataacttcccaccgagggttggtttggccaaaacccggattcaaaac

SEQ ID NO: 15716 - protein, 146 aa, Zea mays
  misc_feature: Ceres CLONE 1378875-F
  misc_feature (85)..(85): Xaa is any aa, unknown, or other
MADASEDNEIAIELDTSVEIDAKGSSVGHNLNFEPRKDTSHHESASNICADDQIKTERQPQCFARENTASTKVSTHSVNSDSEDXSYKQVMDTDPGTSHSKGLMFEVGAAEEDLTCSSIHLPELTFQLQLGRTFEPRSLCRGSVVQ

SEQ ID NO: 15717 - DNA, 717 bp, Zea mays
  misc_feature: Ceres CLONE 1378883-F
  misc_feature: Encodes the peptide sequence at SEQ ID NO. 15718
  misc_feature (512)..(512): n is a, c, t, g, unknown, or other
  misc_feature (582)..(582): n is a, c, t, g, unknown, or other
  misc_feature (655)..(655): n is a, c, t, g, unknown, or other
tccccgcggtggcggccgctctagaactagtggatcccccgggctgcaggaattcgcacgagaccattacctagaacatcctaatcgaaaaagcaagcaattgtcaaccgactctatcttagctctctttgcaagccagtaggtcaccactcaaaagcttgtgaagcaggtgagatgggcaaggaggtggatgtgtccactctagaggccggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggttgccacggtgatcgggtacaagcaccagacggacgcgtcggcgtcggggcccgacgcggcgtgcagcggcgtgggcatcctgtgcatcgcgtgtgcgttcggcggcatgatcttcatcctcgtctactgcaccgccggcatctcgggcgggcacatcaacccggncgtcacgttcgggctcttcctggcgcgcaaggtctccctgttgcgcgctctgctgtacatggccgcgcanaagctcggtgctatctgcgtcgtcgcgctcgtcatgtttacccagagcggggtctagcgcgcctacggcgcgngggccaatggaggataaggcccgctacttcacttttccgggttttccccgttgaaaataacg

SEQ ID NO: 15718 - protein, 154 aa, Zea mays
  misc_feature: Ceres CLONE 1378883-F
  misc_feature (33)..(155): Pfam Name: MIP Pfam Description: Major intrinsic protein
  misc_feature (113)..(113): Xaa is any aa, unknown, or other
  misc_feature (136)..(136): Xaa is any aa, unknown, or other
MGKEVDVSTLEAGGVRDRDYADPPPAPLIDIDELGKWSLYRAVIAEFVATLLFLYITVATVIGYKHQTDASASGPDAACSGVGILCIACAFGGMIFILVYCTAGISGGHINPXVTFGLFLARKVSLLRALLYMAAXKLGAICVVALVMFTQSGV

SEQ ID NO: 15719 - DNA, 697 bp, Zea mays
  misc_feature: Ceres CLONE 1378885-F
  misc_feature: Encodes the peptide sequence at SEQ ID NO. 15720
  misc_feature (380)..(380): n is a, c, t, g, unknown, or other
  misc_feature (382)..(382): n is a, c, t, g, unknown, or other
  misc_feature (396)..(396): n is a, c, t, g, unknown, or other
  misc_feature (397)..(397): n is a, c, t, g, unknown, or other
  misc_feature (399)..(399): n is a, c, t, g, unknown, or other
  misc_feature (408)..(408): n is a, c, t, g, unknown, or other
  misc_feature (414)..(414): n is a, c, t, g, unknown, or other
  misc_feature (697)..(697): n is a, c, t, g, unknown, or other
tccccgcggtggcggccgctctagaactagtggatcccccgggctgcaggaattcgcacgagaccattacctagaacatcctaatcgaaaaaccatgttcaaaacgaaaagtctgatctgaagccagcagacgtgaaaccgacagcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggccggaggtcccntncccccgggtctcgnngnaggaggcgntggtgntgtaccaaagcagcgccaaccctctgcccagcggcatcccggcctacaccgtgcagatcatcaacgtctgcggcggagggtgcaccgtgtacgacgtgcacgtctcctgcggcgacttcgcctccacggagctcgtcgacccggccaagttccagcgcgtcgccttcgacgactgcgtcgtcaagggcggcgccgccttggaacccagcgagaccgtctccttccagtactccaactccttctcctaccagctcagtgtcgccctccgtcggttgccactaan

SEQ ID NO: 15720 - protein, 171 aa, Zea mays
  misc_feature: Ceres CLONE 1378885-F
  misc_feature: SWISSPROT Homolog: EC 2.1.1.43 Histone-lysine N-methyltransferase
  misc_feature (67)..(67): Xaa is any aa, unknown, or other
  misc_feature (72)..(72): Xaa is any aa, unknown, or other
  misc_feature (73)..(73): Xaa is any aa, unknown, or other
  misc_feature (76)..(76): Xaa is any aa, unknown, or other
  misc_feature (78)..(78): Xaa is any aa, unknown, or other
MGEWCFKKRAALVIIVAIISSLQLLLITAQEAGGDHEVWSSSSSPAGGRGGGAVVVPTARMGPEVPXPRVSXXEAXVXYQSSANPLPSGIPAYTVQIINVCGGGCTVYDVHVSCGDFASTELVDPAKFQRVAFDDCVVKGGAALEPSETVSFQYSNSFSYQLSVALRRLPL

SEQ ID NO: 15721 - DNA, 699 bp, Zea mays
  misc_feature: Ceres CLONE 1378888-F
  misc_feature: Encodes the peptide sequence at SEQ ID NO. 15722
tcaccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcaaccaacaacttcgctcgtggtcactacaccattggcaaggagattgttgacctgtgccttgaccgcatcaggaagcttgcagataattgcactggtctccagggcttcctcgtcttcaacgctgttggtggaggaacgggctctgggcttggttctctcctcctggagcgcctgtctgttgaca

SEQ ID NO: 15722 - protein, 160 aa, Zea mays
  misc_feature: Ceres CLONE 1378888-F
  misc_feature (49)..(160): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDATNNFARGHYTIGKEIVDLCLDRIRKLADNCTGLQGFLVFNAVGGGTGSGLGSLLLERLSVD

SEQ ID NO: 15723 - DNA, 675 bp, Zea mays
  misc_feature: Ceres CLONE 1378891-F
  misc_feature: Translation starting site: 167
  misc_feature: Pfam Name: Glyco_hydro_28 Pfam Description: Glycosyl hydrolases family 28
  misc_feature (675)..(675): n is a, c, t, g, unknown, or other
caaagctggagctccccgcggtggcggccgctctagaactagtggatcccccgggctgcaggaattcgcacgagaccattacctagaacatcctaatcgaaaaactccactccatcatcccgtgcctcacgagtcacgagtcactccaggtccaggctgagcagcaatggcgccgcgaacgctcggcctcaacgcggccccgctcctccagattctgcggtccctgtgcctcctggccctcgccgcggcggcggcggtgtccgggcggcgccacggggcctccccggcgcgcggcagcgggcagagcatgtacctggcgccggcctgccgggcgcacacggcgtcggtggcggacttcggcggcgtgggcgacggcaccacttccaacaccgcggcgttccggtccgcggtggaccacctgtcgcagtactcgggcgagggcggcggcggtggcatgctgtacgtgcccgcgggcaagtggctgacgggccccttcaacctgaccagccacttcaccctctacctccacccaagacgccgtcatcctcgggtcccaggacgtaggcgactggccaatcgtggatcccctgccttcttacggaaaaaggagggacaaggtcccgagggaggctccctaccctcatccgcggctcgaacctggaccgacgtagtccn

SEQ ID NO: 15724 - DNA, 662 bp, Zea mays
  misc_feature: Ceres CLONE 1378892-F
aaagctggagctccccgcggtggcggccgctctagaactagtggatcccccgggctgcaggaattcgcacgagaccattacctagaacatcctaatcgaaaaacaaaatttctctacttttcttcgaccgtcctaccctatccgctcccctcgccggcgccgcggcggcggcgagaaagagagaacgcgctcctcttccttctcgactcgatctgccccttccagcccgctcgcccctcatcgagcggcctccgtagccctaggtgatccgcgcctccttccgccgcagcggaacaggacgcctgaccgtcgaccgtcgaagcgattcctctctcgcgggcgtcctcgtctcgccctcctcgcctcctcggtgccagtgggtcggcgcggggaggcatccgtcccgggctacggtcgatttggtctccacttgctggtggactttaaatagacaatggatctggagacagaaaatcggtcttggcttctttactactggaggaggccggaagattacaattagagggctaacaggggaagggggtcaaggcatatctggcaaaaaccctaagggttgggggatccgcccaaaatccttgggggtccccccaaccccccagtttgggggggttacccaaaaaaaaacgggggggggggggggg

SEQ ID NO: 15725 - DNA, 696 bp, Zea mays
  misc_feature: Ceres CLONE 1378899-F
  misc_feature: Encodes the peptide sequence at SEQ ID NO. 15726
  misc_feature (449)..(449): n is a, c, t, g, unknown, or other
  misc_feature (461)..(461): n is a, c, t, g, unknown, or other
  misc_feature (535)..(535): n is a, c, t, g, unknown, or other
  misc_feature (540)..(540): n is a, c, t, g, unknown, or other
tggagctccccgcggtggcggccgctctagaactagtggatcccccgggctgcaggaattcgcacgagaccattacctagaacatcctaatcgaaaaaaagttcggagtcgaggccgccgcccagaccgcctccccttccccgcctccggtgcccaaggccaggccaacagttttgaggtggtaatggcggaccaggctaaccaacccactgtccttcataagctaggtggccagttccacctgagctccagcttctctgaaggtgtacgggcccgtaacatctgcccttctttctcaccttatgaaaggagatttgccacgaggaactacatgacccagagcctttggggcccttcaatgtctgttagcggtggcatcaatgttccagtgatgccgactccgctttttgccaatgctccagctgagaaaggtggcaaaacttcatggnatgattcatgantggcggtgtttcagctgctgtttcgagactgcagctgctcccatttgacgagtgagctgcttattcagaatcangatgnagatgatcagtctggtaagctatcagagccgtacaagggtattgctgattgcttcaaacgaccatccagggatgagggtttcccttccttggggaggggaacctggcaaaggtattccgtacttcccacccaggtttgactttgggttaagggaaa

SEQ ID NO: 15726 - protein, 91 aa, Zea mays
  misc_feature: Ceres CLONE 1378899-F
  misc_feature (89)..(89): Xaa is any aa, unknown, or other
MADQANQPTVLHKLGGQFHLSSSFSEGVRARNICPSFSPYERRFATRNYMTQSLWGPSMSVSGGINVPVMPTPLFANAPAEKGGKTSWXDS

SEQ ID NO: 15727 - DNA, 672 bp, Zea mays
  misc_feature: Ceres CLONE 1378906-F
  misc_feature: Encodes the peptide sequence at SEQ ID NO. 15728
  misc_feature (512)..(512): n is a, c, t, g, unknown, or other
  misc_feature (614)..(614): n is a, c, t, g, unknown, or other
tggagctccccgcggtggcggccgctctagaactagtggatcccccgggctgcaggaattcgcacgagaccattacctagaacatcctaatcgaaaatacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctaccgccagctcttccatcctgagcagctcatcagtggcaaggnaggatgcagccaacaacttcgctcgtggtcactacaccattggccagggagattggtgacctgtgccttgaccgcatcaagaagctttgaaaaaattgaacntggtctccaggggttcctcgtcttcaacgctgttggggggaagaaacggcttctggtt

SEQ ID NO: 15728 - protein, 150 aa, Zea mays
  misc_feature: Ceres CLONE 1378906-F
  misc_feature (97)..(97): Xaa is any aa, unknown, or other
  misc_feature (131)..(131): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKXGCSQQLRSWSLHHWPGRLVTCALTASRSFEKIEXGLQGFLVFNAVGGKKRLLV

SEQ ID NO: 15729 - DNA, 815 bp, Zea mays
  misc_feature: Ceres CLONE 1378909-F
  misc_feature (34)..(34): n is a, c, t, g, unknown, or other
aaaaccccccccaaaacacccccccccccccccnccccccgccggttttgcaagctggagctccaccgcggtggcggccgctctagaactagtggatcccccgggctgcaggaattcgcacgagaccattacctagaacatcctaatcgaaaagaacaaacatgatccgtttccttatccccttggagcagaggaggagcagcatagcataacccgggagctcgctctcgctcccacctccccctccctccccttttgaccctccctcaccagctgcaaaaccgcgggccgcctcccgcccgtgccgcccaccggcggtcaccgccgcccacatatccccctcatcgggcactcgcccagcccaagcaccccacgcaacctaacgcgagggggttcaattgtgtgttcgggcccgttccgccgaagccctaggcgcccgccgttagtacccgtacccccaagggagaacaccagaatgtcgacgcgcctcactgaactctccctccccagcgccccccccccacccatcccgcccctcctcccgctctttcttcccgctcacttctcccgcacctccgcgcgcggaccacgggcctccccgcgcaacaaaaccacggcccccacccgccgctcgccaccacacggcggagaggggcccctgcacggacgctaccgctacgatcgacaccgtaggatagctgaaaagcaataaatataagagattttgcgatccaccccgctccccccgcaatcccctcccaaccctcctccgtgctgctggggggtgtctgtcttgaacctgattcccgtggtcg

SEQ ID NO: 15730 - DNA, 657 bp, Zea mays
  misc_feature: Ceres CLONE 1378913-F
  misc_feature: Translation starting site: 156
  misc_feature: Pfam Name: Ribosomal_S13 Pfam Description: Ribosomal protein S13/S18
  misc_feature (367)..(367): n is a, c, t, g, unknown, or other
  misc_feature (423)..(423): n is a, c, t, g, unknown, or other
  misc_feature (598)..(598): n is a, c, t, g, unknown, or other
gctctagaactagtggatcccccgggctgcaggaattcgcacgagaccattacctagaacatcctaatcgaaaattagccgcgcggacgcccaccagcagctgcccccttgctgtcgccgcctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgntggcgaacccctagggcagttccaaggtgccggactggttccctcacaggaagaangattacaagggacggaaggttctcacaggtcgtctcccaacgcctcgacatgaagctcagggacgacctcgagaggctcaagaagatcaggaaccaccgtggtctgcgtcactactgggggctcccgtgtccgtggccaacacaccaggacactggccagcggcgaaaaactggntggtgcctccagaagcgataagctacatatctatcgaccaatctcagatggactagtgt

SEQ ID NO: 15731 - DNA, 697 bp, Zea mays
  misc_feature: Ceres CLONE 1378919-F
  misc_feature: Encodes the peptide sequence at SEQ ID NO. 15732
  misc_feature (386)..(386): n is a, c, t, g, unknown, or other
  misc_feature (430)..(430): n is a, c, t, g, unknown, or other
tggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccngaggagatcgacgaggggcttcccgaggggttcctgatcctcancccagcactacgggtaccacttctccgcaacagcaggtcaacagccagaatcaatccgtccggggtggcagcttatgcggcagcacaacctgtggacccaggaaaacgctggcccctgtcggtctttccacggcagcccagggtttacctggtaccaagcaatcccttggctggaggggctcttgctttggtttttggggctaacgcctgctggcctttatcaaagaaaatggttccttccctaaggttcaaggccttgggatcccg

SEQ ID NO: 15732 - protein, 155 aa, Zea mays
  misc_feature: Ceres CLONE 1378919-F
  misc_feature (74)..(74): Xaa is any aa, unknown, or other
  misc_feature (88)..(88): Xaa is any aa, unknown, or other
MASGIGSGQQQPPAPAADADPGAVGDKLVFEAPPQPVREDYVQNAVKFLSHPKVRGSPVVYRRSFLEKKGLSTXGDRRGASRGVPDPXPSTTGTTSPQQQVNSQNQSVRGGSLCGSTTCGPRKTLAPVGLSTAAQGLPGTKQSLGWRGSCFGFWG

SEQ ID NO: 15733 - DNA, 683 bp, Zea mays
  misc_feature: Ceres CLONE 1378929-F
  misc_feature: Encodes the peptide sequence at SEQ ID NO. 15734
ggagctccccgcggtggcggccgctctagaactagtggatcccccgggctgcaggaattcgcacgagaccattacctagaacatcctaatcgaaaaaataaaaaaaaatccgtcttcttgtggtcttctccaaaccctagcgcccccggccccggtctccgcccccccgccttcgccgtcgcggtcgcgccccatggcggggaagtcgcgaccgcccaagcggatcctcgagtcctataccatcaagggttcggacagagtcatcaagcctggcgattgcgtgctaatgagggcatctgatgcttcaaagccaccttatgtggcaagagttgaggcaattgaagcagcaggatctcgaggcaccaatgtgagagtacgagtgcggtggtattatcgaccagaggagtccataggtggtcggcgggcatttcatgggtccaaggaggttttcctctctgaccactatgatgtacaaagtgctgacaccattgagggggaatggcatgtccacagcttccgtagctatacaaagcttgattctggcaatgctgaggatttcctctgcggcttcgagaataaatcaactactgggagcttgtgacaaaattggaaaacaagggttttgaaagggcgaatgcctatacatcccaatggccttaggtctcaatggggggaagtgtttg

SEQ ID NO: 15734 - protein, 135 aa, Zea mays
  misc_feature: Ceres CLONE 1378929-F
  misc_feature (22)..(136): Pfam Name: BAH Pfam Description: BAH domain
MAGKSRPPKRILESYTIKGSDRVIKPGDCVLMRASDASKPPYVARVEAIEAAGSRGTNVRVRVRWYYRPEESIGGRRAFHGSKEVFLSDHYDVQSADTIEGEWHVHSFRSYTKLDSGNAEDFLCGFENKSTTGSL

SEQ ID NO: 15735 - DNA, 583 bp, Zea mays
  misc_feature: Ceres CLONE 1378933-F
  misc_feature: Encodes the peptide sequence at SEQ ID NO. 15736
tggagctccccgcggtggcggccgctctagaactagtggatcccccgggctgcaggaattcgcacgagaccattacctagaacatcctaatcgaaaagaaagctgtccagatcgtgtgattttgcatcccatccgcgagcgcgacacgcgctgacctactcgacggcctccacctccgtcttgaggcgaagcgtagtgcgaaggaccaactctttcgaagggaaattatatctcaggtgcttaggagtctgccatggccagcgagaataaggtatttaggttcgaggaagtcgccaagcacaacgtcaccaaggactgctggatcatcatcgccggcaaggtgtatgatgtcactccttttatggatgagcatcctggtggagatgaggttttgctagctgtaactgggaaagatgctacagctgattttgaagatattggccacagtgattcccgcagggacatgaatggagaagtaccacctcggggcagatagatgcgttcaaccaatccccgcaaaggggaatttatggggccccccgggaaggggccccgcccctccaaaaaaaaaaatggatttccc

SEQ ID NO: 15736 - protein, 80 aa, Zea mays
  misc_feature: Ceres CLONE 1378933-F
  misc_feature (7)..(76): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
MASENKVFRFEEVAKHNVTKDCWIIIAGKVYDVTPFMDEHPGGDEVLLAVTGKDATADFEDIGHSDSRRDMNGEVPPRGR

SEQ ID NO: 15737 - DNA, 707 bp, Zea mays
  misc_feature: Ceres CLONE 1378934-F
  misc_feature: Encodes the peptide sequence at SEQ ID NO. 15738
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
  misc_feature (639)..(639): n is a, c, t, g, unknown, or other
tccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagcgcgagacaagagtggtggggnnnnnnnnnnnnnnnnnnnnnnnnnnnnnnnnnncnncccctgtgttgctgccactccctgagtccacgacgaagagaagaaggcggcgcccctgctcccgagcg

SEQ ID NO: 15738 - protein, 144 aa, Zea mays
  misc_feature: Ceres CLONE 1378934-F
  misc_feature (125)..(125): Xaa is any aa, unknown, or other
  misc_feature (126)..(126): Xaa is any aa, unknown, or other
  misc_feature (127)..(127): Xaa is any aa, unknown, or other
  misc_feature (128)..(128): Xaa is any aa, unknown, or other
  misc_feature (129)..(129): Xaa is any aa, unknown, or other
  misc_feature (130)..(130): Xaa is any aa, unknown, or other
  misc_feature (131)..(131): Xaa is any aa, unknown, or other
  misc_feature (132)..(132): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (136)..(136): Xaa is any aa, unknown, or other
  misc_feature (137)..(137): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIARDKSGGXXXXXXXXXXXXXPCVAATP

SEQ ID NO: 15739 - DNA, 672 bp, Zea mays
  misc_feature: Ceres CLONE 1378937-F
  misc_feature: Encodes the peptide sequence at SEQ ID NO. 15740
  misc_feature (612)..(612): n is a, c, t, g, unknown, or other
  misc_feature (672)..(672): n is a, c, t, g, unknown, or other
ggagctccccgcggtggcggccgctctagaactagtggatcccccgggctgcaggaattcgcacgagaccattacctagaacatcctaatcgaaaatcctctcgctcgccaggagaagcagccgccgttgctgctgccgcgtccacagaatggggggtttcgtgaagacccataagaccaatgcgtatttcaaacgtttccaagtgaaattcaagagaaggcgggctggcaagacagactacagggccaggataaggctgattaaccaagacaaaaacaagtacaacacacccaaatacagatttgttgtgcgatttaccaacaaggacatcactgcacaaatcatatctgctagtatagcgggtgatatggttcttgcttctgcctactctcatgagttgccacgatatggtcttgaagttggtctgaccaactatgcagctgcctactgcactggacttctgttggctcgccatgtgctaaagatccgtggtttggataaggagtatgagggcaatgttgaggccactggtgaggacttctctgttgagccagctgatgagaggagggcattccgtgcttctcttgggatgttggcttatcaggactacnacagggaaccggtgtctttggtgcctccaagggagttttttggataggggcctggatatn

SEQ ID NO: 15740 - protein, 169 aa, Zea mays
  misc_feature: Ceres CLONE 1378937-F
  misc_feature (27)..(150): Pfam Name: Ribosomal_L18p Pfam Description: Ribosomal L18p/L5e family
  misc_feature (155)..(155): Xaa is any aa, unknown, or other
MGGFVKTHKTNAYFKRFQVKFKRRRAGKTDYRARIRLINQDKNKYNTPKYRFVVRFTNKDITAQIISASIAGDMVLASAYSHELPRYGLEVGLTNYAAAYCTGLLLARHVLKIRGLDKEYEGNVEATGEDFSVEPADERRAFRASLGMLAYQDYXREPVSLVPPREFFG

SEQ ID NO: 15741 - DNA, 798 bp, Zea mays
  misc_feature: Ceres CLONE 1378938-F
  misc_feature: Encodes the peptide sequence at SEQ ID NO. 15742
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (43)..(43): n is a, c, t, g, unknown, or other
  misc_feature (45)..(45): n is a, c, t, g, unknown, or other
  misc_feature (425)..(425): n is a, c, t, g, unknown, or other
accatccanaccaacannnacaccccccgcgcccnnttttntntntggggctggggctccccgcgggggcggccgctctataatagtggatcccccgggctgcaggaattcgcacgagaccattacctagaacatcctaatcgaaaagtccgccccaggctaagccgattcaaagcgcccgttccccgtgtccgtgccaagcgaggcgagcccaacccccaagagccagctgctcggggctccacgcgatggcgcagaaggagactagtggcagcaacggcgatcacatctccacccgcccgccgccgaccccctcgcccctccgcttctccaagttctttcaggctaacctgcggatcctggtcactggtgggggggggttcatcggctcgcacctgcgataccagctcatggggaacgggaancacgaggccattggtgggtgggggctgttttcactgggttcacaaggacgccgtggagaaatgggattggccccccccggggatttgaggctcatcccgggatggatggccaccggagccggcttccttcgggggagggtggaccaaggtgtaatgacccctgggtgggcccgtggtttccgcgggggcttcctacatagggcaaccccctggtgaggaggcttggaggacgcagggggaagtgggtgagcccggagagggggctcaggactttgccagaacacagcgagggacactcacggactttgtggtggagatccagcgctgcttaaggattgagggggaggaagccgccttgaggcggtcggggaag

SEQ ID NO: 15742 - protein, 130 aa, Zea mays
  misc_feature: Ceres CLONE 1378938-F
  misc_feature: SWISSPROT Homolog: EC 5.1.3.2 UDP-glucose 4-epimerase
  misc_feature (59)..(59): Xaa is any aa, unknown, or other
MAQKETSGSNGDHISTRPPPTPSPLRFSKFFQANLRILVTGGGGFIGSHLRYQLMGNGXHEAIGGWGLFSLGSQGRRGEMGLAPPGDLRLIPGWMATGAGFLRGRVDQGVMTPGWARGFRGGFLHRATPW

SEQ ID NO: 15743 - DNA, 769 bp, Zea mays
  misc_feature: Ceres CLONE 1378940-F
  misc_feature: Encodes the peptide sequence at SEQ ID NO. 15744
  misc_feature (676)..(676): n is a, c, t, g, unknown, or other
tggagctccccgcggtggcggccgctctagaactagtggatcccccgggcttgcaggaattcgcacgagaaccattacctagaacatcctaatcgaaaaatctacctcactcgtagctcaagcatcagcggcaggagcttctgggcagcgtgcgcacgtggggtacctagctcgctcttgctaagcctaccatggctgatcaccaccggggcgcgacgggaggtggcgggggctacggcgacctccagcgcgggggcggcatgcacggcgaggcgcagcagcagcagaagcagggcgccattgatgacggcgctcaaggccgcgacggccgcgacctttcggcgggtcgatgctggtgcttgtccgggctgatcctggccggcaccgtgattcgcgctcacggtggccacccccgtgctgtgatcccgcccctttttttttttccgcgcgcccccccccaattggtgttggggcttatgggggggcccggtttcgtccacctccggggggccttcggcgttcgctggcgcttgtccgtgtttctcctgggatgtacaaagtacctggacgggcaagcaccctgccgggcgccgaccagctggaccacgccaagggcgaggcttggcgtccaaggcccgcgacatcaaggatgcagcacagcaccgcatcgacaagnggcaggggtccttgagagaaagaacacactcgagcggaccgcgcgcgcgtcctccttgaccactgccggcgcggcggatatggccccttaaag

SEQ ID NO: 15744 - protein, 191 aa, Zea mays
  misc_feature: Ceres CLONE 1378940-F
  misc_feature (162)..(162): Xaa is any aa, unknown, or other
MADHHRGATGGGGGYGDLQRGGGMHGEAQQQQKQGAIDDGAQGRDGRDLSAGRCWCLSGLILAGTVIRAHGGHPRAVIPPLFFFPRAPPQLVLGLMGGPGFVHLRGAFGVRWRLSVFLLGCTKYLDGQAPCRAPTSWTTPRARLGVQGPRHQGCSTAPHRQXAGVLERKNTLERTARASSLTTAGAADMAP

SEQ ID NO: 15745 - DNA, 760 bp, Zea mays
  misc_feature: Ceres CLONE 1378941-F
  misc_feature: Translation starting site: 245
  misc_feature: SWISSPROT Homolog: EC 1.2.1.12 Glyceraldehyde-3-phosphate dehydrogenase (phosphorylating)
  misc_feature (307)..(307): n is a, c, t, g, unknown, or other
  misc_feature (328)..(328): n is a, c, t, g, unknown, or other
  misc_feature (365)..(365): n is a, c, t, g, unknown, or other
  misc_feature (421)..(421): n is a, c, t, g, unknown, or other
  misc_feature (439)..(439): n is a, c, t, g, unknown, or other
  misc_feature (450)..(450): n is a, c, t, g, unknown, or other
  misc_feature (458)..(458): n is a, c, t, g, unknown, or other
ggagctccccgcggtggcggccgctctagaactagtggatcccccgggctgcaggaattcgcacgagaccattacctagaacatcctaatcgaaaaatccgctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgacccccttcatcaccacggactacatgacctacatgttncagtacgacaccgtccacggncactggaagcacagcgacatcacactcaaggactccnagacccttctcttttcgtgacagccggtcaccgtctttggcatcaggaaccctgangaaaatccgtggggtgangctggcgctgnatatgtcntggagtccacccgcggcctcactgaaaaggacaaggttgctgcaaatctccaggggggggccaagaaagggtgttattccctgccccaagaaaaaaccccccatggttggtggtggggggcaaaggggaaaaaaccccccggaagggtaaatttgtttccagggggatggggcccaaaatgggctggcccccttgggaagggcattttaggaaacttccctttttgggaggggtttagaaaaatgtggttgccccctctccgccccaaaaaatgtgtggggccccccccccgaggggggggg

SEQ ID NO: 15746 - DNA, 603 bp, Zea mays
  misc_feature: Ceres CLONE 1378944-F
  misc_feature: Encodes the peptide sequence at SEQ ID NO. 15747
  misc_feature (142)..(142): n is a, c, t, g, unknown, or other
  misc_feature (255)..(255): n is a, c, t, g, unknown, or other
  misc_feature (256)..(256): n is a, c, t, g, unknown, or other
  misc_feature (259)..(259): n is a, c, t, g, unknown, or other
  misc_feature (290)..(290): n is a, c, t, g, unknown, or other
  misc_feature (298)..(298): n is a, c, t, g, unknown, or other
tggagctccccgcggtggcggccgctctagaactagtggatcccccgggctgcaggaattcgcacgagaccattacctagaacatcctaatcgaaaaacatcccaattggaagggcagctaataaggtaaggggcgacgaanatggctccaacgaccgccaccaaggacgacagtggctacggcgacaagcgccggcgcgagctgcaggcgttcgacgacacgaagctgggggtgaaaggtctggtggactccgnngtnaagtccatcccgtccatctttcaccacccgncggagccntgagcgacatatttcttcggggcctctttgcgccgtcgcccgccctcccgggccgccatccccgggggggaactctccgggaccgggggggagggactaatccaaaaggtgaggcccccggccggaaagggggcttctttctggtggggaaacccccaaagcccgaaagacttaatgggcgcatgctccccggggtgcgcatagaggccccccgggggggggggggaaaaaaaaaaagccccttctatagaggggaagcctttgccgaaaaaggggggttttccccccaaattttagaactcttg

SEQ ID NO: 15747 - protein, 52 aa, Zea mays
  misc_feature: Ceres CLONE 1378944-F
  misc_feature: SWISSPROT Homolog: EC 1.14.11.20 Desacetoxyvindoline 4-hydroxylase
  misc_feature (38)..(38): Xaa is any aa, unknown, or other
  misc_feature (50)..(50): Xaa is any aa, unknown, or other
MAPTTATKDDSGYGDKRRRELQAFDDTKLGVKGLVDSXVKSIPSIFHHPXEP

SEQ ID NO: 15748 - DNA, 675 bp, Zea mays
  misc_feature: Ceres CLONE 1378948-F
  misc_feature: Encodes the peptide sequence at SEQ ID NO. 15749
  misc_feature (675)..(675): n is a, c, t, g, unknown, or other
tggagctccccgcggtggcggccgctctagaactagtggatcccccgggctgcaggaattcgcacgagaccattacctagaacatcctaatcgaaaaatccaacccacacacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttgtggctgggtggcgaaaatgctggttactgtaccactagatcaagcatgttgtgcgtgtctgaagaaatgccaattgtgacttgctgtttgttcaaacatgctccacatttcaacacccgtcgtcccn

SEQ ID NO: 15749 - protein, 103 aa, Zea mays; identical to SEQ ID NO: 6459
  misc_feature: Ceres CLONE 1378948-F
  misc_feature (25)..(94): Pfam Name: Histone Pfam Description: Core histone H2A/H2B/H3/H4

SEQ ID NO: 15750 - DNA, 687 bp, Zea mays
  misc_feature: Ceres CLONE 1378953-F
  misc_feature: Encodes the peptide sequence at SEQ ID NO. 15751
  misc_feature (513)..(513): n is a, c, t, g, unknown, or other
  misc_feature (584)..(584): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacatcacccttgaggtggagtcctcagacaccatttgacatgtncagggcaagatccagggacaaggaggggcatcccactggacagcaacgtctcatctttgccgggaaacaanttggaaggatgggaggacccctggctgactacaacattccgaagggaagcaccctcccactgggggcggggctttaaggggggaaggcaaaactttgggaaaa

SEQ ID NO: 15751 - protein, 150 aa, Zea mays
  misc_feature: Ceres CLONE 1378953-F
  misc_feature (6)..(74): Pfam Name: ubiquitin Pfam Description: Ubiquitin family
  misc_feature (102)..(102): Xaa is any aa, unknown, or other
  misc_feature (126)..(126): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTSPLRWSPQTPFDMXRARSRDKEGHPTGQQRLIFAGKQXGRMGGPLADYNIPKGSTLPLGAGL

SEQ ID NO: 15752 - DNA, 656 bp, Zea mays
  misc_feature: Ceres CLONE 1378955-F
  misc_feature (336)..(336): n is a, c, t, g, unknown, or other
  misc_feature (366)..(366): n is a, c, t, g, unknown, or other
  misc_feature (371)..(371): n is a, c, t, g, unknown, or other
  misc_feature (374)..(374): n is a, c, t, g, unknown, or other
  misc_feature (401)..(401): n is a, c, t, g, unknown, or other
  misc_feature (485)..(485): n is a, c, t, g, unknown, or other
  misc_feature (616)..(616): n is a, c, t, g, unknown, or other
aagctggagctccccgcggtggcggccgctctagaactagtggatcccccgggctgcaggaattcgcacgagaccattacctagaacatcctaatcgaaaacttccctctcttccgcctccgattgagtggctcaccttctttcccagccagcacgagcttgcaagcaagcgagctcctgagatttcagctcgcttctcctccagaggtcgagcagaccagactcctccgaccgaagctctaccacttcccagttagcctgtccaggaactgcttggccggagatccaaacaaacctctggtgttggggttctccggggttccttgcgctggaggnagggttcgttctcgctggccatgggttggnctganaangcagcagtgggcagcatcttgatgccnaatctctgagctttatgaagatcggcactcacctggggcgctctgcttcctccactccttcctcgggtggctccctctactggnttttatgggtcccccaaaatttgccttccccccggaatcgccaattcccccggtggcctcttttcgggccccctaaactttttcccctcctttcttggttcccctcaacaatcggccaataacagcactancgggaacgggtaaagggatcttttccaggtaagctagggc

SEQ ID NO: 15753 - DNA, 702 bp, Zea mays
  misc_feature: Ceres CLONE 1378956-F
  misc_feature: Encodes the peptide sequence at SEQ ID NO. 15754
  misc_feature (393)..(393): n is a, c, t, g, unknown, or other
tggagctccccgcggtggcggccgctctagaactagtggatcccccgggctgcaggaattcgcacgagaccattacctagaacatcctaatcgaaaaatcaccaagttttggattccagcagcggcgcccccaggccaggccccacccgctcagcctcctcagctgcccaaccttctccccatctgctcagcctcagctgtcattcccgcgaagcgccgtctcccggctctatcgatggaccgagtcgccgccctcggcgtcgcgctcctcgccctcttcttcgccgccggggccacggcgcaggccccggcctcgtcgcccaagcgcactccagcgccagcgccacccaggacggccttcctcccgccgccgccggccagggcgcctatggnctccccgccctcgcctcccgcgatggcgccggggcccgagacctcagcctgtgtgccggccacgagacccgccggcgcgtgagttggtgacaacgcgaagagaacgggcggagccgcggtggctctgacaccgaatgccgcgcccgtcacggacaagagcgccgtcgtctcaccctccgccagagaaattagcctctggacaattgttgacggcgggaaagccaccacagcgttatagacctggcccgacctagagacaacagatatgccggtggatccggggaggaactaaacctgcagtcttttcta

SEQ ID NO: 15754 - protein, 79 aa, Zea mays
  misc_feature: Ceres CLONE 1378956-F
  misc_feature (53)..(53): Xaa is any aa, unknown, or other
MDRVAALGVALLALFFAAGATAQAPASSPKRTPAPAPPRTAFLPPPPARAPMXSPPSPPAMAPGPETSACVPATRPAGA

SEQ ID NO: 15755 - DNA, 677 bp, Zea mays
  misc_feature: Ceres CLONE 1378968-F
  misc_feature: Encodes the peptide sequence at SEQ ID NO. 15756
  misc_feature (450)..(450): n is a, c, t, g, unknown, or other
  misc_feature (588)..(588): n is a, c, t, g, unknown, or other
tccccgcggtggcggccgctctagaactagtggatcccccgggctgcaggaattcgcacgagaccattacctagaacatcctaatcaaaagtgttcttgttcgtctccgcctcaggcaactccacacggacacggtcacacctcgctcgctctcgctcccgtatcgcggtttccttttcgaagccttgctaggtttagctggggcctccgtctatcctgtcaatggccccttaggcggctgtacttcagacttcagaggtgacgtgaggcgtggggacgcgcgtagctgattggttcgaggaggcggggatggacccggacttctcgccggcgagtgggggcccgagctttgagttcgccttcaactcggtcaacttctctgacccgggtgttgcgggatcgaagatcgtcgctggggatgacgccctcggggccaagggcgccaccggncgagggtgctcatctcttgccgactgggcgtggcaccgcaagcgacgacgggaggagctccgacgcgacaaagatctagaaaatacatggcagatccagcaaactgccaaagtgaagctgaagaatgtgatgcctacnaggaaggccatgagcctgtagctatgatagaagaatctccgcctgatattgaggcagatggtggaggagggaaaagcagcgactcgtac

SEQ ID NO: 15756 - protein, 99 aa, Zea mays
  misc_feature: Ceres CLONE 1378968-F
MDPDFSPASGGPSFEFAFNSVNFSDPGVAGSKIVAGDDALGAKGATGRGCSSLADWAWHRKRRREELRRDKDLENTWQIQQTAKVKLKNVMPTRKAMSL

SEQ ID NO: 15757 - DNA, 598 bp, Zea mays
  misc_feature: Ceres CLONE 1378972-F
  misc_feature (188)..(188): n is a, c, t, g, unknown, or other
  misc_feature (203)..(203): n is a, c, t, g, unknown, or other
tggagctccccgcggtggcggccgctctagaactagtggatcccccgggctgcaggaattcgcacgagaccattacctagaacatcctaatcgaaaactccactcctcctcctctctctctccacatttcctctcccgataagagtgaggcctcggctaagcttgagcttccccctcctcccctcagngctccagctcccctnccatctcgccaaaaattctgcgcgagctccgatccggtcgactactaacccacgcgcaaaaaccgcgcgacctgatcccccggggtccagaaaagggaaaccggggccgcgtttgctgcaacgtaacgcccaagaaaagaaaaggagccgtatccctcggcccgttggccccgggacgatggattccaaaccggatttccgccctggcccccgaaagggttttaggggggaaatttggcccaaaattagggccgaaatgaaaatttgtaaaagaaaaaagggtttccccccaattccccctgcccttttgggttaaggagacccaggggggtatcccttttggggcgccgggggggggggaaaccccttttaaaacccagggggggggggggtgg

SEQ ID NO: 15758 - DNA, 664 bp, Zea mays
  misc_feature: Ceres CLONE 1378975-F
  misc_feature (589)..(589): n is a, c, t, g, unknown, or other
tccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaaatgcgccccgcangcccaccttcgtgggcatctggaagaagcgtgcggtggagcagtactcgccgatcccgtacgtggcgacgctgcc

SEQ ID NO: 15759 - DNA, 665 bp, Zea mays
  misc_feature: Ceres CLONE 1378976-F
  misc_feature: Encodes the peptide sequence at SEQ ID NO. 15760
tccccgcggtggcggccgctctagaactagtggatcccccgggctgcaggaattcgcacgagaccattacctagaacatcctaatcgaaaactccactcgctctcccacacagaaaaccctagccgccgccaccgaagcggcctcccaggtaagcaggatcgtccagcccgccgccgccatgaagcgcaatccccgcgtcacgagctcccgccggaagtgccgcaaggcgcactttacggccccgtcctccgtccgccgtgttctcatgtccgccgggctgtcgacggagctccgccacaagtacaacgtgcgctccatcccgatccgcaaggacgacgaggtgcaggtcgtgcgcggcacctacaagggccgtgaggggaaggtggtgcaggtgtaccgccgccgctgggtcatccacgtcgagcggatcacccgcgagaaggtgaacggctccaccgtgaacgtgggcatccacccctccaaggtgatcgtcaccaagctgaagctcgacaaggaccgtaaggcgctcctcgaccgcaaggcccggggccgcgccgccgacaaggctaagggcaagtttactgccgacgacgtcgccgccgccgccgctggtggcgccgccaccggcgcctctctccaggagatcgactagactcttcacggt

SEQ ID NO: 15760 - protein, 157 aa, Zea mays
  misc_feature: Ceres CLONE 1378976-F
  misc_feature (51)..(82): Pfam Name: KOW Pfam Description: KOW motif
MKRNPRVTSSRRKCRKAHFTAPSSVRRVLMSAGLSTELRHKYNVRSIPIRKDDEVQVVRGTYKGREGKVVQVYRRRWVIHVERITREKVNGSTVNVGIHPSKVIVTKLKLDKDRKALLDRKARGRAADKAKGKFTADDVAAAAAGGAATGASLQEID

SEQ ID NO: 15761 - DNA, 674 bp, Zea mays
  misc_feature: Ceres CLONE 1378980-F
  misc_feature: Encodes the peptide sequence at SEQ ID NO. 15762
  misc_feature (391)..(391): n is a, c, t, g, unknown, or other
  misc_feature (410)..(410): n is a, c, t, g, unknown, or other
  misc_feature (449)..(449): n is a, c, t, g, unknown, or other
  misc_feature (456)..(456): n is a, c, t, g, unknown, or other
  misc_feature (472)..(472): n is a, c, t, g, unknown, or other
  misc_feature (522)..(522): n is a, c, t, g, unknown, or other
  misc_feature (572)..(572): n is a, c, t, g, unknown, or other
  misc_feature (618)..(618): n is a, c, t, g, unknown, or other
  misc_feature (630)..(630): n is a, c, t, g, unknown, or other
tccccgctgtggcggccgctctagaactagtggatcccccgggctgcaggaattcgcacgagaccattacctagaacatcctaatcgaaaactccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgagcggtaaggacattaccgagctcattgctgctggcagggagaagtttgcttcagtcccatggtggcgntggcggtggtggctgttgncgcagctgcccctgctgctggcggcgctcctgcagctgnagcgaanaaagaagagaggtggnaggagaaggaagaagtgatgacgacatgggcttcagcctcttcgactaangctgtgcaatagtcaagagtattgtttttgagtcgcggaagcagaggaangaaaaatcggagtcatggttggactttaacttttggttatgttggnaaagacttgaangacttttccctgtgtaaatctaggcgtaaggtgctgtgcttggt

SEQ ID NO: 15762 - protein, 101 aa, Zea mays
  misc_feature: Ceres CLONE 1378980-F
  misc_feature (76)..(76): Xaa is any aa, unknown, or other
  misc_feature (89)..(89): Xaa is any aa, unknown, or other
  misc_feature (91)..(91): Xaa is any aa, unknown, or other
MKFVAAYLLAVLAGNSSPSAEDLTAILESVGCEVDNEKMELLLSQLSGKDITELIAAGREKFASVPWWRWRWWLLXQLPLLLAALLQLXRXKKRGGRRRKK

SEQ ID NO: 15763 - DNA, 754 bp, Zea mays
  misc_feature: Ceres CLONE 1378981-F
  misc_feature (38)..(38): n is a, c, t, g, unknown, or other
ttttttttattttttttttttaacggcggcagataaanaaaagcggtttggggaaaagtggagctccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggttactgcatgcagggctgggaccaccgctgcatcggtctcgacccctgaaccccgccggcacttgcttctttgatatgatttcattcgggtcggtcggggcccctcccgacctggatctgttgcgcgagagcgcgggagcgcgcgagatacgcgcccttctcttctcctaggaagcaggcaggcagtcgaccggtccgctgagctcccgcccgccccacgagtcgcccgcggcggtcgaatgaaaacatctggccagggggaggagaaaccccgcgggcgaacgggcccgcccgccccgcggggggggccccggacgcaaccccccctcgggcccgcggacccacgtcccggg

SEQ ID NO: 15764 - DNA, 522 bp, Zea mays
  misc_feature: Ceres CLONE 1378985-F
  misc_feature (343)..(343): n is a, c, t, g, unknown, or other
  misc_feature (344)..(344): n is a, c, t, g, unknown, or other
tggagctcaccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccagggaattcttacccgcacgggtagcagtttctaggactgattgatgctcagtacactgctactttcccaaatcagctgctcctggctctanngttagcgcatgatgttgtgaagaagcatatcgagagtgtggccgcagggcttcccattgattccgaggaaaagggcatccttggctgagatgctgaagaaaatggttatggatgggcaattgcaaaggcctttgctgcggctggggggctaaattctttgggggaaacatgggggccc

SEQ ID NO: 15765 - DNA, 777 bp, Zea mays
  misc_feature: Ceres CLONE 1378988-F
  misc_feature: Encodes the peptide sequence at SEQ ID NO. 15766
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (45)..(45): n is a, c, t, g, unknown, or other
  misc_feature (46)..(46): n is a, c, t, g, unknown, or other
nnnnnnnnnnccacaaaannnnaaacccaccgcccnnggggnccnnccccaaactggcgctccaccgctgtggcggccgctctagaactagtggatcccccgggctgcaggaattcgcacgagaccattacctagaacatcctaatcgaaaactccgcctctccttccagtgtccgccgtcgtgcgctcgctacccctctccctcgaggcctttgccggcgaagagcgcccagtcgcccaccaggatgaagtttgttgctgcctacctgcttgctgtcctcgctgggaactccagcccctctgccgaggacttgacagccattctggagtcagttggctgtgaagttgacaatgaaaagatggaactccttctgtcccaactgaggggtaaggacattaccgagctcattgctgctggcagggagaagtttgcttcagacccatgtggcggcgccggtggggctgttgcggcagctgcccctgctggtggcggccgctcctgcagctgccgcgaagaaagaagagaagggggaggagaaggaacaaagggatgaccacatgcggcttccgcctcctccgactacggctggggcaatagacacagagtaattggtttttgacccgcggcagccccagggaaagaaaaatccggaagcccttggtttggagctttaaacttttggcctgagggggggcaaagggcccctcgcccaagcactttctcccgggggcaaaatttccaggggagcaagcgctgcctcgccccctccgccggcg

SEQ ID NO: 15766 - protein, 102 aa, Zea mays
  misc_feature: Ceres CLONE 1378988-F
  misc_feature (17)..(99): Pfam Name: Ribosomal_60s Pfam Description: 60s Acidic ribosomal protein
MKFVAAYLLAVLAGNSSPSAEDLTAILESVGCEVDNEKMELLLSQLRGKDITELIAAGREKFASDPCGGAGGAVAAAAPAGGGRSCSCREERREGGGEGTKG

SEQ ID NO: 15767 - DNA, 771 bp, Zea mays
  misc_feature: Ceres CLONE 1378990-F
  misc_feature: Encodes the peptide sequence at SEQ ID NO. 15768
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnaaaaaaannnaaggcgaaaggggtcccccccggnnnnnncaaagctggagctccccgcggtggcggccgctctagaactagtggatcccccgggctgcaggaattcgcacgagaccattacctagaacatcctaatcgaaaaaacgctcctgctcacagcgtgggggatcttcgcagagatggcgaggacctcgttcctgcagaagctggagcacagggtggaggcgtcggccgccgacttgcagcacatcgagtccatcgccctcgacaccgtctccttcgaggagctcctcggccactgcggcgaggcgctcaaagtctacgcgcgccacgccgacgccctccagtcgcacctcgcttcctttggctacgagcccccggacgcacaacaccccgagatcgatgtggatgtggaagatggagatgtcgggaaggctggggaccctggagatagatgcctcagcgtgtcgcgttcagtgctcaggtcgggtaagcggcggtttgagagccacagcgatgcgatatttgaagagtcactgaaggatcttgggttttcagatgcttgcctagccactctttcctcctgaaggcggacattatgggggagagcccaaaagaaactttacaagaattgcttgaaagtacctgatggatgggcgaaaaagatccatggaatggaaccctgaaaatttatggacctccccctaaaaatggaaaagaaaatggggtccaaggggaaatttcctttttggaaagggag

SEQ ID NO: 15768 - protein, 135 aa, Zea mays
  misc_feature: Ceres CLONE 1378990-F
MARTSFLQKLEHRVEASAADLQHIESIALDTVSFEELLGHCGEALKVYARHADALQSHLASFGYEPPDAQHPEIDVDVEDGDVGKAGDPGDRCLSVSRSVLRSGKRRFESHSDAIFEESLKDLGFSDACLATLSS

SEQ ID NO: 15769 - DNA, 664 bp, Zea mays
  misc_feature: Ceres CLONE 1378994-F
  misc_feature: Translation starting site: 188
ggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagccccgtggctggtgcgggccgccatcgcgctggcgctcatggcggccgggttcgtcacctccggcggcctcggcgtcgctgcgctgtccgtgttcctctggatgtacaagtacctgacgggcaagcaccccgcgggcggcgaccagctggaccacccaaggggaagctggcggtccagggcccgcgacttcaggatggaggcacggaccggattgacccagggggaggggctcttgaaaaa

SEQ ID NO: 15770 - DNA, 672 bp, Zea mays
  misc_feature: Ceres CLONE 1378995-F
  misc_feature: Encodes the peptide sequence at SEQ ID NO. 15771
  misc_feature (295)..(295): n is a, c, t, g, unknown, or other
  misc_feature (313)..(313): n is a, c, t, g, unknown, or other
ggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgcntggcctgcttctcctggncgcgcccgtccgcccgggctcggcggctccgtggaggatggcctgctcagcaatggtgactttgagacagcaccaagtggtgtttttgtaaatctgctttctgtgctgagggtgcatcgtcaatcccctggttggacgatcaacgggacggttggactcatttcagcagggccacaccaggggtggcatgatcctgattggttcacagggggaccatgcagtaaggctagggaatgatgctaccgttgggccaggtggtggacctttaaaaagggttcggattatgctatcacattcagggctgccccggactgggccacaactggagggacttgaatgtttcccggcttaggggggtg

SEQ ID NO: 15771 - protein, 54 aa, Zea mays
  misc_feature: Ceres CLONE 1378995-F
MILIGSQGDHAVRLGNDATVGPGGGPLKRVRIMLSHSGLPRTGPQLEGLECFPA

SEQ ID NO: 15772 - DNA, 665 bp, Zea mays
  misc_feature: Ceres CLONE 1379005-F
  misc_feature: Encodes the peptide sequence at SEQ ID NO. 15773
tggagctccccgcggtggcggccgctctagaactagtggatcccccgggctgcaggaattcgcacgagaccattacctagaacatcctaatcgaaaactactacccctggctcccgcgacctgacgccgccactcccgacttcgccatccggcgatcgccacagccctagctccggcgtctctagcgatccccaaaacccactccgccgcatttctgccgacttggccggattggtccgttattgagatggctacgccacttatagcaggacttgcagttgcagcaactgctcttgctggtcgatatggcgtccaagcttggcaagcttataaggcaaggcctatagttccagggatgcgcaaattctatgaaggtggctttcaccctacaatgaaccgaggggaggctgcattaatccttggtgtcagggaaactgcccacgcagagaaagtaaaagaggcgcacaagagggttatggtcgcccaccatccagatgctggtggaaatcattaccttgcgtcaaagattaatgagggcgaggatgtgttgccaagaaaacaaaaggagggggtccggccttctgattggaaaataagaatggactctctgctaaaaggataattttgggcccctaaatttagcattaaaaaaactggagacccgg

SEQ ID NO: 15773 - protein, 124 aa, Zea mays
  misc_feature: Ceres CLONE 1379005-F
MATPLIAGLAVAATALAGRYGVQAWQAYKARPIVPGMRKFYEGGFHPTMNRGEAALILGVRETAHAEKVKEAHKRVMVAHHPDAGGNHYLASKINEGEDVLPRKQKEGVRPSDWKIRMDSLLKG

SEQ ID NO: 15774 - DNA, 666 bp, Zea mays
  misc_feature: Ceres CLONE 1379006-F
  misc_feature: Encodes the peptide sequence at SEQ ID NO. 15775
  misc_feature (572)..(572): n is a, c, t, g, unknown, or other
  misc_feature (654)..(654): n is a, c, t, g, unknown, or other
tggagctccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagcagtagagagaaggttgaaaaaacaatgcaagttggacaaacagacattcaaatatatggtccttctaaaagagaaagatgtctttcatctattgctgatgaattcccagatgtcatttgtgtgnactacacaggacccggttctgtgaactctaatgctgagctctattgcaagcttggattgcattggtgatgggcacaactggntggaaacagcat

SEQ ID NO: 15775 - protein, 85 aa, Zea mays
  misc_feature: Ceres CLONE 1379006-F
  misc_feature: SWISSPROT Homolog: EC 1.3.1.26 Dihydrodipicolinate reductase
  misc_feature (64)..(64): Xaa is any aa, unknown, or other
MGLSVAEAAALRGLHLVPVSFSSREKVEKTMQVGQTDIQIYGPSKRERCLSSIADEFPDVICVXYTGPGSVNSNAELYCKLGLHW

SEQ ID NO: 15776 - DNA, 641 bp, Zea mays
  misc_feature: Ceres CLONE 1379007-F
  misc_feature: Encodes the peptide sequence at SEQ ID NO. 15777
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
gctctagaactagtggatcccccgggctgcaggaattcgcacgagaccattacctagaacatcctaatcgaaaattcccctccctgcctcctcgtctcctcggtctcccctccctgtcttccagagacacagagcagggcgctcttcggtcggaggagaagcgcgaccacgaccatgggctttatctcgttcgtcggccgggttctcttcgcctccctcttcctcctctcggcctaccaagagttcattgaatttggaaatgacggtggacctgcagcgaagaccttgaagccaaagttcaatttgttcgtcaagctagtgtccaagaatactggactggggctgccgcatatggatataaaaactgtcattgcagctaccatgtttcttaaaggctttggtggtcttctgttcatagtcagcagctcatttggagcattcctcctggttagcatctaagtattgtttttttctggcatggctaatgtcttgtgtttaaaacataaaggcttatagaggtattgcaaaaaagggactaataacccaatgaatacatgactgctccagatcggaattgagtcacatgtgaggnnnnnnnnnnnnnnnnnnnnnnnnnnnnnnnnnnnnnnnnnnnnnnnnnn

SEQ ID NO: 15777 - protein, 94 aa, Zea mays; identical to SEQ ID NO: 13271
  misc_feature: Ceres CLONE 1379007-F
  misc_feature (1)..(94): Pfam Name: HR_lesion Pfam Description: HR-like lesion-inducing

SEQ ID NO: 15778 - DNA, 630 bp, Zea mays
  misc_feature: Ceres CLONE 1379009-F
  misc_feature: Encodes the peptide sequence at SEQ ID NO. 15779
  misc_feature (396)..(396): n is a, c, t, g, unknown, or other
ggagctccccgcggtggcggccgctctagaactagtggatcccccgggctgcaggaattcgcacgagaccattacctagaacatcctaatcgaaaaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttccccgctgggcggctgctgctggtgctgtncgggctggcgctgacggcctccgtggtggggctggccgtggcccacgcccgtgtcctgatcttcagcccccgtgctcgtcccccgcgcggttggtcattcgggaaaggcccgtcatgggggttccttccccgtccggggccgccttggggctccgggggggctgtccccccctcccagggggccccccacaaaaggggggggggggaggggtggtttccccccaaccccccccc

SEQ ID NO: 15779 - protein, 142 aa, Zea mays
  misc_feature: Ceres CLONE 1379009-F
  misc_feature (65)..(65): Xaa is any aa, unknown, or other
MADRDRSGIYGGAHATYGQQQQQGGGGRPMGEQVKGMLHDKGPTASQALTVVTLFPAGRLLLVLXGLALTASVVGLAVAHARVLIFSPRARPPRGWSFGKGPSWGFLPRPGPPWGSGGAVPPSQGAPHKRGGGEGWFPPNPP

SEQ ID NO: 15780 - DNA, 726 bp, Zea mays
  misc_feature: Ceres CLONE 1379014-F
  misc_feature: Encodes the peptide sequence at SEQ ID NO. 15781
  misc_feature (417)..(417): n is a, c, t, g, unknown, or other
  misc_feature (436)..(436): n is a, c, t, g, unknown, or other
  misc_feature (444)..(444): n is a, c, t, g, unknown, or other
  misc_feature (530)..(530): n is a, c, t, g, unknown, or other
  misc_feature (543)..(543): n is a, c, t, g, unknown, or other
  misc_feature (648)..(648): n is a, c, t, g, unknown, or other
ggagctccccgcggtggcggccgctctagaactagtggatcccccgggctgcaggaattcgcacgagaccattacctagaacatcctaatcgaaaaaggtagctgagcgaagcatccggtgtgttccctcgccatccgccgccgccgccatgccgggcttcgctcagcgtctcgcgggcatcccgtggcggagcatcgcgaggcaaggcctctcccgcgtgttcctggtggcgaaggcctactgcgtgatccacgtcgtcaacgaccacctctgctcggtgaccttagtgcggggcgccagcatgctgccgtccctgaacctggcgggcgacgcggtggcggtggacagggtcagcgtgaggctcggccgggtcgcgccgggggacatcgtgctgatgatctcccccgaggacccgncgcaagtcggtcgtcaagncgcgtcgntcgggatgcaggggggactccgtcacctaccttgtcgaccccggcaaaagcgactcctccagaaaaccgtcgtggtaccgcaggantcatgtctggggntgcagggtgacaatatctttgcttctaacgattcgaggcaattttggagctgtgccctatggctgattacagggagatctttttttcccggtttggccccccccnaaaaatttggcccaatgatgagccaacgaacagcttaagggctgaggaggagccgaggagaccatggaccccctattg

SEQ ID NO: 15781 - protein, 178 aa, Zea mays
  misc_feature: Ceres CLONE 1379014-F
  misc_feature (90)..(90): Xaa is any aa, unknown, or other
  misc_feature (96)..(96): Xaa is any aa, unknown, or other
  misc_feature (99)..(99): Xaa is any aa, unknown, or other
  misc_feature (127)..(127): Xaa is any aa, unknown, or other
  misc_feature (132)..(132): Xaa is any aa, unknown, or other
  misc_feature (167)..(167): Xaa is any aa, unknown, or other
MPGFAQRLAGIPWRSIARQGLSRVFLVAKAYCVIHVVNDHLCSVTLVRGASMLPSLNLAGDAVAVDRVSVRLGRVAPGDIVLMISPEDPXQVGRQXASXGMQGGLRHLPCRPRQKRLLQKTVVVPQXSCLGXQGDNIFASNDSRQFWSCALWLITGRSFFPGLAPPXKFGPMMSQRTA

SEQ ID NO: 15782 - DNA, 696 bp, Zea mays
  misc_feature: Ceres CLONE 1379015-F
  misc_feature: Encodes the peptide sequence at SEQ ID NO. 15783
  misc_feature (438)..(438): n is a, c, t, g, unknown, or other
tccccgcggtggcggccgctctagaactagtggatcccccgggctgcaggaattcgcacgagaccattacctagaacatcctaatcgaaaaaacccgcatcccacatcactcatccacagctcgcagccgtattcctgtctcgtatcctctctcgccgctccgatggcccgcacgaagcaaacagcaaggaagtcgaccggcggcaaggccccccggaagcagctggccactaaggctgcgcgcaagtcggccccggccaccggcggcgtgaagaagccccaccgcttccgccccggcaccgtcgcgctccgcgagatccgcaagtaccagaagagcactgagctgctcatccgcaagctcccctttccagcgctcgtccgcgagatcgcgcaggacttcaagactgatctgaggttccagtcctccgccgtcgcggngctgcaggaggccgccgaggcgtaactggtgggggctcttcgaggaaacaaacttttgcgccatcccagccaaggggggtccatatcatggcccaggaacatccagtttcgggggggaattaaggggcaaaaggcttggaccccccccccgggtgcctcttttttgaaggggaacaaaaaaaagaagggggggatttttttttggggggtttcctttttccctggagagaaaaaggttctaaaaagggctgggctcct

SEQ ID NO: 15783 - protein, 99 aa, Zea mays
  misc_feature: Ceres CLONE 1379015-F
  misc_feature (92)..(92): Xaa is any aa, unknown, or other
MARTKQTARKSTGGKAPRKQLATKAARKSAPATGGVKKPHRFRPGTVALREIRKYQKSTELLIRKLPFPALVREIAQDFKTDLRFQSSAVAXLQEAAEA

SEQ ID NO: 15784 - DNA, 631 bp, Zea mays
  misc_feature: Ceres CLONE 1379016-F
  misc_feature: Encodes the peptide sequence at SEQ ID NO. 15785
gctctagaactagtggatcccccgggctgcaggaattcgcacgagaccattacctagaacatcctaatcgaaaaaagcaaacctaaccaagcctctgcggctcttcttcgaatccaactcctccccgatccccaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttaaagacgaacagaagaacctcaagcgcgaactcctccctgcgcaggagggagtcaagcggatccagtccgtaccgctcgtcatcggccagtttatggagatggtcgacggcaacaacggcatcgggggttctactacgggcaggaactactatgggggggatcctcagcacccatcaaccgcgagctgctcaaagcgtcagcattctgtccccgttgcatcgtccctcccaacgcttttatccaacggggtgcccccccgaaggccaa

SEQ ID NO: 15785 - protein, 152 aa, Zea mays
  misc_feature: Ceres CLONE 1379016-F
MSAATTAPTPAVATPMAPPPSYPASSTISASVAASVEEEDDLYGRLKSLQRHMEFVEIQEEYVKDEQKNLKRELLPAQEGVKRIQSVPLVIGQFMEMVDGNNGIGGSTTGRNYYGGDPQHPSTASCSKRQHSVPVASSLPTLLSNGVPPRRP

SEQ ID NO: 15786 - DNA, 691 bp, Zea mays
  misc_feature: Ceres CLONE 1379017-F
  misc_feature (215)..(215): n is a, c, t, g, unknown, or other
  misc_feature (216)..(216): n is a, c, t, g, unknown, or other
  misc_feature (255)..(255): n is a, c, t, g, unknown, or other
  misc_feature (600)..(600): n is a, c, t, g, unknown, or other
  misc_feature (602)..(602): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
tggcggccgctctagaactagtggatcccccgggctgcaggaattcgcacgagaccattacctagaacatcctaatcgaaaacccgtccctccactcctcccgtcgagcacttggcactgccaatggcggcagccgcccacaccccttcgatgcgcgcaagccgccctcttttcctctgagatcgacgcacctcctcctctcgtactccattccnngctcagttcgtttctttcgggacgaagcatcggacgggncgccccggatctcggcctggtcccagggccctgccctccgcgggtcttcgaagggggggggcccggtggccaatcccgggaaatccagatcccttgggaactcccggaaggggggaaaaatccctcggggggggaaggggaaaaagggccccaaaaaaataaggggaaggggaaaggggggccggggaaaaccccttttgacggggtgtctcccccccgtgtttttttggggttttttccccaaaaaaaaaaaaaaaaaaaaaatttttttcccccccgaaaaaagagggtggggggggggtttttttatttttgggggccccccccccccgggggggggggggnanattttgggggcccccaagaaaaagagaaagtgttggtctcccacaaaaaaaaaaaaaaaaaacggggnnnnnnnnnnnnnnnnnnnnnn

SEQ ID NO: 15787 - DNA, 698 bp, Zea mays
  misc_feature: Ceres CLONE 1379020-F
  misc_feature: Encodes the peptide sequence at SEQ ID NO. 15788
  misc_feature (337)..(337): n is a, c, t, g, unknown, or other
  misc_feature (348)..(348): n is a, c, t, g, unknown, or other
  misc_feature (351)..(351): n is a, c, t, g, unknown, or other
  misc_feature (498)..(498): n is a, c, t, g, unknown, or other
tggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattgncaggaacatgntgncgccgctcctggtgctcaacctcatcatgtacatcatcgtcatcggcttcgcgagctggaacctgaaccacttcatcaacgggcagacaactaccccggcgtgcccggcaacgcgcgacgttctacttcctggggttccccatctgncccgcgtggtgggccccgcttcaaagctgggggcggggaccaggtggggccttggggccaaaaaggctgaaaacaacgcccggttgttcttatgccggggcatccagggctcccctttcgttgggcgggaaggaaaacaattgggaaaccccggttgggcccccccgggttgtaaaattttttataattccccccctcag

SEQ ID NO: 15788 - protein, 125 aa, Zea mays
  misc_feature: Ceres CLONE 1379020-F
  misc_feature (14)..(97): Pfam Name: AWPM-19 Pfam Description: AWPM-19-like family
  misc_feature (5)..(5): Xaa is any aa, unknown, or other
  misc_feature (9)..(9): Xaa is any aa, unknown, or other
  misc_feature (10)..(10): Xaa is any aa, unknown, or other
  misc_feature (59)..(59): Xaa is any aa, unknown, or other
MAGIXRNMXXPLLVLNLIMYIIVIGFASWNLNHFINGQTTTPACPATRDVLLPGVPHLXRVVGPASKLGAGTRWGLGAKKAENNARLFLCRGIQGSPFVGREGKQLGNPGWAPPGCKIFYNSPPQ

SEQ ID NO: 15789 - DNA, 699 bp, Zea mays
  misc_feature: Ceres CLONE 1379021-F
  misc_feature: Encodes the peptide sequence at SEQ ID NO. 15790
  misc_feature (541)..(541): n is a, c, t, g, unknown, or other
  misc_feature (610)..(610): n is a, c, t, g, unknown, or other
  misc_feature (668)..(668): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
cgcggtggcggccgctctagaactagtggatcccccgggctgcaggaattcgcacgagaccattacctagaacatcctaatcgaaaacacctctcccacccaacaacaaaacaagcctaatggcttcctctccatctcacgccactgcgttgcctacttgccctagaaccctcgccgccgcccctctttaggattcccatgtccctggtcgccccctgacacgcccgccccggatcctgcaccggaattccgcgtggaattccgggccgaaccgcctctctgcgtgcgcctccgaccaccaaactctctcacacgcgcgcgcgcgcacgtctgaggcggttggattctccggtgggggtcccttggtctcgatttgctgctgatgggggtgccgaagcagcgctggacgccggaggaagaggccgcgctcaaggccggcgtcgccaagcacggccccggcaagtggcgcaccatcctccgggactcggacttcagcgcgctcctgcgcctccgctccaatgttgaccctcagggacagtgncgcaacttgagcgtcaccgcaggaggttacgggtctagagagaaggcaaggatggcgtgaagaaagcangcgcgtgtgcctaagctactgtgagcatggatgtaatgaaagtatgacacctctgccngctgatggacgtaataggggnnnnnnnnnnn

SEQ ID NO: 15790 - protein, 72 aa, Zea mays
  misc_feature: Ceres CLONE 1379021-F
  misc_feature: The sequence is a functional homolog of SEQ ID NO 1221 in the 10/666,642 US patent application
  misc_feature: The sequence is a functional homolog of SEQ ID NO 1374 in the 10/666,642 US patent application
  misc_feature: The sequence is a functional homolog of SEQ ID NO 1220 in the 10/666,642 US patent application
  misc_feature: The sequence is a functional homolog of SEQ ID NO 1526 in the 10/666,642 US patent application
  misc_feature: The sequence is a functional homolog of SEQ ID NO 388 in the 10/666,642 US patent application
  misc_feature (53)..(53): Xaa is any aa, unknown, or other
MGVPKQRWTPEEEAALKAGVAKHGPGKWRTILRDSDFSALLRLRSNVDPQGQXRNLSVTAGGYGSREKARMA

SEQ ID NO: 15791 - DNA, 703 bp, Zea mays
  misc_feature: Ceres CLONE 1379030-F
  misc_feature: Encodes the peptide sequence at SEQ ID NO. 15792
  misc_feature (380)..(380): n is a, c, t, g, unknown, or other
  misc_feature (381)..(381): n is a, c, t, g, unknown, or other
  misc_feature (448)..(448): n is a, c, t, g, unknown, or other
  misc_feature (449)..(449): n is a, c, t, g, unknown, or other
  misc_feature (456)..(456): n is a, c, t, g, unknown, or other
  misc_feature (522)..(522): n is a, c, t, g, unknown, or other
  misc_feature (544)..(544): n is a, c, t, g, unknown, or other
gcggtggcggccgctctagaactagtggatcccccgggctgcaggaattcgcacgagaccattacctagaacatcctaatcgaaaaagcaggcgttcggcccggcagcccccaagtcccatcgccgagcagaaagtcaggaacagaactcaggcgttggcgattggcatctccctcccctaagccatggctaccgggcggcccgtacgactcgtgctggatgcctccctcctcctcgacccctcctccaccagggaggcggcggcggtggcgctgcggcccggggtagaggagttgctgcggcggttgcgctactccaacctgagcgtggcaatctgctatgcagagggcatgcccactaatgagtcagactttcttgannagggtcgcagctcacacttggtttggatctatagtacttcttgcaaaaggtgggaatctttctccannttgatantgatagaatggagcccgaacagtttttggttttatgcgacttcaagagttgacaaaggttaaattnctgacctcagatcagaactggnagagtctttctgagctatgatggaaacataggggttcctgggggtttaaatgtcaagggtttcgggagtgctttccaccttggtaccaaaggaaaaggactttggggccaactgggtctgggggtgggaaataaaggaaaaaaccccgggggaaacttt

SEQ ID NO: 15792 - protein, 110 aa, Zea mays
  misc_feature: Ceres CLONE 1379030-F
  misc_feature (65)..(65): Xaa is any aa, unknown, or other
  misc_feature (66)..(66): Xaa is any aa, unknown, or other
  misc_feature (88)..(88): Xaa is any aa, unknown, or other
  misc_feature (91)..(91): Xaa is any aa, unknown, or other
MATGRPVRLVLDASLLLDPSSTREAAAVALRPGVEELLRRLRYSNLSVAICYAEGMPTNESDFLXXGRSSHLVWIYSTSCKRWESFSXLIXIEWSPNSFWFYATSRVDKG

SEQ ID NO: 15793 - DNA, 741 bp, Zea mays
  misc_feature: Ceres CLONE 1379034-F
  misc_feature: Encodes the peptide sequence at SEQ ID NO. 15794
  misc_feature (504)..(504): n is a, c, t, g, unknown, or other
  misc_feature (517)..(517): n is a, c, t, g, unknown, or other
  misc_feature (577)..(577): n is a, c, t, g, unknown, or other
  misc_feature (593)..(593): n is a, c, t, g, unknown, or other
  misc_feature (610)..(610): n is a, c, t, g, unknown, or other
ggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgccggagggcagccggttggcggcggcgatggagctgcatcatcaggcgcagaaggaagctatggcgccgcagcaggctcaggctccgcccctctttctggnactctcgcatggnagtaagcagatcaaaacaagcgcactcttggctccgcggcggattttcgtcttcttgggnagaggacggcaccttnctgttcgaattccgganccggaaaaaggccccggggaactaaaattgggcggggtggttgggggacataaaataacgcgggcggggagaaaccggaaccccaggggaccccctttttctctccaaattttttcctttggaagagaacc

SEQ ID NO: 15794 - protein, 29 aa, Zea mays
  misc_feature: Ceres CLONE 1379034-F
MAVQAHYHHHYHRESPFLVRYLPWPLCIF

SEQ ID NO: 15795 - DNA, 721 bp, Zea mays
  misc_feature: Ceres CLONE 1379037-F
  misc_feature: Encodes the peptide sequence at SEQ ID NO. 15796
  misc_feature (1)..(1): n is a, c, t, g, unknown, or other
  misc_feature (632)..(632): n is a, c, t, g, unknown, or other
nggcggccgctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctcctccagtcgatcccatggattaaccacttccacaagacccccgaccgcgagtggttcgagaccgacgcggtgctcagggtcagcctcggcaacttcctcttcttcaccatcctcgccgtcatcatggccgggataaaggaccagaaggacccccgtgacaagatccaccacgggcggatggatggccaagatcttctgctgggtcatcatcgtcttcctcatgttctcgngggccccacggggtcgtcagcttctatgattctatatccaagttggggctctggctggtcttctcccggtcaggttggtctgggtggtt

SEQ ID NO: 15796 - protein, 162 aa, Zea mays
  misc_feature: Ceres CLONE 1379037-F
  misc_feature (8)..(159): Pfam Name: Serinc Pfam Description: Serine incorporator (Serinc)
  misc_feature (133)..(133): Xaa is any aa, unknown, or other
MWAASCLASCCAACACEACRTAVGSIGRRSARIAYCGLFALSLFASWALREVAAPLLQSIPWINHFHKTPDREWFETDAVLRVSLGNFLFFTILAVIMAGIKDQKDPRDKIHHGRMDGQDLLLGHHRLPHVLXGPTGSSASMILYPSWGSGWSSPGQVGLGG

SEQ ID NO: 15797 - DNA, 726 bp, Zea mays
  misc_feature: Ceres CLONE 1379039-F
  misc_feature: Encodes the peptide sequence at SEQ ID NO. 15798
  misc_feature (630)..(630): n is a, c, t, g, unknown, or other
  misc_feature (673)..(673): n is a, c, t, g, unknown, or other
  misc_feature (674)..(674): n is a, c, t, g, unknown, or other
ccccgcggtggcggccgctctagaactagtggatcccccgggctgcaggaattcgcacgagaccattacctagaacatcctaatcgaaaaaccgttcggttccttctcgtactgagccgcgggtagccagccaaccgccgacgcagtccacaagcgatgaagcgcttcttccagccagtgcccaaggacggctccccgtccaagaagcggctagcgggtgctgctgaaccgggcgactgccccacatcagccggtgccgccaccggcgctggcggggatgtagaggggaggcccaccgaggagccgttcaagttcctgacgtggaacgccaacagcctgctcctccggatgaagagcgactggcctgctttctcgcagctcgtcgcccgccttgaccccgacgtcatttgtgtccaggaagtgcggatgccggcagctggttccaaaggggcacctaaaaaccccagtgaactaaaagatgacacaagcttgtcacgggatgaaaagcaggtagttctacgtgctttgtcagcttcacctttcaaagactaccgtggtctggtggtctctttcagattcaaaatatgctggggacagctatgttaataaaagaaaaagttgagccctaangaaggtgtctttcaacttggatagaacatcttctaacatgagnnccgatgggcgtgttattaattgcggaattttgatcattccttttactgaacc

SEQ ID NO: 15798 - protein, 149 aa, Zea mays
  misc_feature: Ceres CLONE 1379039-F
MKRFFQPVPKDGSPSKKRLAGAAEPGDCPTSAGAATGAGGDVEGRPTEEPFKFLTWNANSLLLRMKSDWPAFSQLVARLDPDVICVQEVRMPAAGSKGAPKNPSELKDDTSLSRDEKQVVLRALSASPFKDYRGLVVSFRFKICWGQLC

SEQ ID NO: 15799 - DNA, 802 bp, Zea mays
  misc_feature: Ceres CLONE 1379040-F
  misc_feature: Encodes the peptide sequence at SEQ ID NO. 15800
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (29)..(29): n is a, c, t, g, unknown, or other
  misc_feature (30)..(30): n is a, c, t, g, unknown, or other
  misc_feature (417)..(417): n is a, c, t, g, unknown, or other
nnnnnnnnnggggnnnnnnnaaaggaaannggtgggggcgcggggcggcagactggagctccccgcggtggcggccgctctagactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccggcaggcagaccatcagtctggccgccgcccgaaacgcgggctgggctgtgcgcggatgtcattgcgctccacgatcccgtcncaaccccgccgggggcgccggcgtccacggaagagggcaggcgcccccccccccgcgtatgcaggggggtcctggggcctgggaggaaggtggaccgggagggccatggcagctaccgtcgagggaccggggggggcccgcccaaagggggaggaagcatgggggggggggcccgttccccggctgggggccccggcccgccaaggggccgggcccgctcgccagtcgccccgcttccccccctgccccaaggcaaacaaagggcaattgcgtaaggaataaatgtgaggggggccctggaaagggttttcacaaaaaggaggcttacccccctctccgggggggcccttgacgctggacgcgtggagggggttccttgaagaga

SEQ ID NO: 15800 - protein, 154 aa, Zea mays
  misc_feature: Ceres CLONE 1379040-F
  misc_feature (38)..(38): Xaa is any aa, unknown, or other
MAPAVGLKRSGRQTISLAAARNAGWAVRGCHCAPRSRXNPAGGAGVHGRGQAPPPPRMQGGPGAWEEGGPGGPWQLPSRDRGGPAQRGRKHGGGGPFPGWGPRPAKGPGPLASRPASPPAPRQTKGNCVRNKCEGGPGKGFHKKEAYPPLRGGP

SEQ ID NO: 15801 - DNA, 724 bp, Zea mays
  misc_feature: Ceres CLONE 1379044-F
  misc_feature (230)..(230): n is a, c, t, g, unknown, or other
  misc_feature (392)..(392): n is a, c, t, g, unknown, or other
  misc_feature (596)..(596): n is a, c, t, g, unknown, or other
  misc_feature (618)..(618): n is a, c, t, g, unknown, or other
  misc_feature (656)..(656): n is a, c, t, g, unknown, or other
agagctggagctccccgcggtggcggccgctctagaactagtggatcccccgggctgcaggaattcgcacgagaccattacctagaaaatcctaatcgaaaaggagcatcaccgttcactggataattcgctcgctccgctcgatgcccgcttgtttgcggtgaagcctccggcgaacagccgtagcggaaacgccgcccgagatgtctgctccctccgccccaccccgnacggtgatctgtgtgggcgacgtccacggctacatcacgaagctggagagcctctggcccaacgtccaggccgaactccccgccggacgccttcccccccgcgctggtcatcttcctcggcgactacaacaaccgccccccggggggggggggggggcctcnaatcttctcttcccgttcccaacgggctaacccggcgcaggggcacggcttccccctggcggggacccccgacctgccccttccgcccgggatccagcggggggggtggtggccgcccgcgcgagcggaccccccgttgctcggcacaacgggggacccaggaggaccccgccccacgcgatcacacggcgcgccgggctcacncggcccccgcccaccgccaggnggggggcgcggcgcacgcgtgagggaagtgcggccccncgccccccccgacgcggtaaatatgtagcgcccggaccccccggccgctccgggggtgacgggggaag

SEQ ID NO: 15802 - DNA, 654 bp, Zea mays
  misc_feature: Ceres CLONE 1379048-F
  misc_feature: Encodes the peptide sequence at SEQ ID NO. 15803
tccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgattggtacgcgcgtgctttcacccgtccgacgcctctctctcggctgtctgattgatttggttgccccggttccagaaatggaggtccaggcgcattatcaccaccactaccaccgcgagtcccctttcctcgtcaggtacctgccgtggccgctgtgcatcttctaatcgtttcttccgcgtcgatcgtcggtctgctggatcgtattcagatgagagatttgagcgtctgcgttgtcagcgacgccccgtagtcacccggatgccgacgacgatggagctgcatcatcaggtgcacaaggaggctatgttgccgcagcaggatcagcctccgcccctcttcttggacttctcgcatggaggtaagctaattaaacaaagcgcactccttggctccgggggggatttccgtcttcctggtgaatattacccgcacccttcttgttgaatttcggatcaggaaaaggtcccccgggaaactaaattgcccgggttgctgggggc

SEQ ID NO: 15803 - protein, 61 aa, Zea mays
  misc_feature: Ceres CLONE 1379048-F
MPTTMELHHQVHKEAMLPQQDQPPPLFLDFSHGGKLIKQSALLGSGGDFRLPGEYYPHPSC

SEQ ID NO: 15804 - DNA, 730 bp, Zea mays
  misc_feature: Ceres CLONE 1379049-F
  misc_feature: Encodes the peptide sequence at SEQ ID NO. 15805
  misc_feature (604)..(604): n is a, c, t, g, unknown, or other
  misc_feature (674)..(674): n is a, c, t, g, unknown, or other
tccccgcggtggcggccgctctagaactagtggatcccccgggctgcaggaattcgcacgagaccatacctagaacatcctaatcgaaaaaactactccgtcactttgtttacaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacgccggtcatggggtccctcacgtcgggcgcgctggggggctccggggggcctgtcctcgctcacgtgcctcgccacaccgggggcggcaggcgttccagcgcacccgggattaanggggaagaggcgcaccgcacggaatgggggagggccgcgccgcacgcgggccacaaagaccgcgcaagcnagccaggccatcccagggcgtgggcgcatgaagcccgctccccggggtaaggggct

SEQ ID NO: 15805 - protein, 176 aa, Zea mays
  misc_feature: Ceres CLONE 1379049-F
  misc_feature (44)..(166): Pfam Name: Oleosin Pfam Description: Oleosin
  misc_feature (137)..(137): Xaa is any aa, unknown, or other
  misc_feature (161)..(161): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTPVMGSLTSGALGGSGGPVLAHVPRHTGGGRRSSAPGIXGEEAHRTEWGRAAPHAGHKDRASXPGHPRAWAHEARSPG

SEQ ID NO: 15806 - DNA, 687 bp, Zea mays
  misc_feature: Ceres CLONE 1379054-F
  misc_feature: Encodes the peptide sequence at SEQ ID NO. 15807
  misc_feature (525)..(525): n is a, c, t, g, unknown, or other
  misc_feature (615)..(615): n is a, c, t, g, unknown, or other
  misc_feature (630)..(630): n is a, c, t, g, unknown, or other
ctagaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttccgccgcctcaccggccactcccacttcgtccaggacgtcgtcctcagttccgacggccagttcgccctttccggctcctgggatggagagctccgcctctgggacctctccaccggcctcaccacccgccgcttcgtcggccacgagaaagatgtcctctccgttgccttctccgttgacnaccgccagatcgtctccgcgtcccgcgacaagaccattaagctctggaacaccctcggtgagtgcagtacaccatcggaggtgacctcgntgggcgcgagggcancaacgggtggtctccctgcgtcagttctcccaaacacattcagccaccattgtctcc

SEQ ID NO: 15807 - protein, 182 aa, Zea mays
  misc_feature: Ceres CLONE 1379054-F
  misc_feature (107)..(145): Pfam Name: WD40 Pfam Description: WD domain, G-beta repeat
  misc_feature (65)..(103): Pfam Name: WD40 Pfam Description: WD domain, G-beta repeat
  misc_feature (8)..(47): Pfam Name: WD40 Pfam Description: WD domain, G-beta repeat
  misc_feature: SWISSPROT Homolog: EC 2.7.11.7 [Myosin heavy-chain] kinase
  misc_feature (129)..(129): Xaa is any aa, unknown, or other
  misc_feature (159)..(159): Xaa is any aa, unknown, or other
  misc_feature (164)..(164): Xaa is any aa, unknown, or other
MAGAQESLSLVGTMRGHNGEVTAIATPIDNSPFIVSSSRDKSLLVWDLTNPVHSTPESGATADYGVPFRRLTGHSHFVQDVVLSSDGQFALSGSWDGELRLWDLSTGLTTRRFVGHEKDVLSVAFSVDXRQIVSASRDKTIKLWNTLGECSTPSEVTSXGARAXTGGLPASVLPNTFSHHCL

SEQ ID NO: 15808 - DNA, 738 bp, Zea mays
  misc_feature: Ceres CLONE 1379058-F
  misc_feature: Encodes the peptide sequence at SEQ ID NO. 15809
  misc_feature (505)..(505): n is a, c, t, g, unknown, or other
ccccgcggtggcggccgctctagaactagtggatcccccgggctgcaggaattcgcacgagaccattacctagaacatcctaatcgaaaaatcgatcgtcaatgcaagtttgtccattcgcattgctctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgacgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgtccctcctnccccggcgtggggccggccacccctcggggggcgtgcgtggggggggccccacggggcgcccccgtgggccactatacagtcctgaccaccaaaatccggggaagtcgcttcaatcgctggggccatcacggcgcctcaaaccctacggctgtcccaaaaaaaggaaaaaccacttctggggaatcccccgcggtgggggcctctggctcgatttgtttggaaatgccttcac

SEQ ID NO: 15809 - protein, 135 aa, Zea mays
  misc_feature: Ceres CLONE 1379058-F
  misc_feature (14)..(78): Pfam Name: AWPM-19 Pfam Description: AWPM-19-like family
MAGIGRNMVTPLLVLNLIMYIIVIGFASWNLNHFINGQTNYPGVAGNGATFYFLVSLLPRRGAGHPSGGVRGGGPTGRPRGPLYSPDHQNPGKSLQSLGPSRRLKPYGCPKKRKNHFWGIPRGGGLWLDLFGNAF

SEQ ID NO: 15810 - DNA, 700 bp, Zea mays
  misc_feature: Ceres CLONE 1379061-F
  misc_feature: Encodes the peptide sequence at SEQ ID NO. 15811
  misc_feature (679)..(679): n is a, c, t, g, unknown, or other
gctctagaactagtggatcccccgggctgcaggaattcgcacgagaccattacctagaacatcctaatcgaaaagcgctcttcacccatttccccatctccgacctcccccttcctctcccccctgccgctccccgcgccgagaaggagaaccccagccgccgcgcagcgcgccgcccatggcctcctcgtcggagaacgcggctgtgccgccggaggaggagccccaggccccgccgccgccggacacagagcctaccgaggcggcgcccggcgaggcggaggatgagccgcaaaccctagagcgggcgcaggagctcttcgacaggggttccaaggccatcgaggatgaggacttcgtcgacgccgtagactgcctcagccgagcgctcgagatcagggcttcacattatggagagctcgcgccggagtgtgccagcacatacttcaaatatggatgtgccctgctatacaaagctcaggaggagagtgatgttttgggaaatgttccccagagcttgccaaatggagactcagtgaagagtacagctactaaagatgacagtggaaccctcaaggtctctggtaccaatgtggaggatgctgcgtcatcagaaaaaggtgatgctgaagaaaggtcaaactcaatgggcaaaatcaggaaaatgggaatgggtgantgaaagaaatgatgatgacca

SEQ ID NO: 15811 - protein, 166 aa, Zea mays
  misc_feature: Ceres CLONE 1379061-F
MASSSENAAVPPEEEPQAPPPPDTEPTEAAPGEAEDEPQTLERAQELFDRGSKAIEDEDFVDAVDCLSRALEIRASHYGELAPECASTYFKYGCALLYKAQEESDVLGNVPQSLPNGDSVKSTATKDDSGTLKVSGTNVEDAASSEKGDAEERSNSMGKIRKMGMG

SEQ ID NO: 15812 - DNA, 726 bp, Zea mays
  misc_feature: Ceres CLONE 1379062-F
  misc_feature: Encodes the peptide sequence at SEQ ID NO. 15813
  misc_feature (382)..(382): n is a, c, t, g, unknown, or other
  misc_feature (501)..(501): n is a, c, t, g, unknown, or other
  misc_feature (606)..(606): n is a, c, t, g, unknown, or other
tccccgcggtggcggccgctctagaactagtggatcccccgggctgcaggaattcgcacgagaccattacctagaacatcctaatcgaaaaattgcctattgccccaccctccccgctagggttttgccagcatggccgccgccgccgccgcccggaggctcctctcccgccgcgcctcctcgtcctccctctccgcgcttctccgtcgcggcgctgtcccggagcagtcgctggtgctgcgcccggctgttgtcgcggcggcctcccgcctcggcttccagcgcgggatggcgcggcggcctggcggggacggctacggctcgacgcggtctgggcgcgggcggggaccgcgcgcccatggccacggagatggcgccgctngttccccgggtgcgactacgagcattggctcatcgtgatggacaagcccgggcggggagggcgccagcaagcagcagatgattgactgctacatccagaccctcgccaaggtccttggnaagcgaggaggaggcgaagaagaagatctacaacgtctcgtggagggcttactttccggtttggggtgcgagatcgatgaggagacatctaacaagctcgagggnctccctggtggtctctttgtgctccgggattcgtatgttgatgctgaatacaggactacggagctgaactctcgcaaacggggagattggtcagaggatcctgagaggcagaggagggtg

SEQ ID NO: 15813 - protein, 89 aa, Zea mays
  misc_feature: Ceres CLONE 1379062-F
MIDCYIQTLAKVLGKRGGGEEEDLQRLVEGLLSGLGCEIDEETSNKLEGLPGGLFVLRDSYVDAEYRTTELNSRKRGDWSEDPERQRRV

SEQ ID NO: 15814 - DNA, 753 bp, Zea mays
  misc_feature: Ceres CLONE 1379064-F
  misc_feature: Encodes the peptide sequence at SEQ ID NO. 15815
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (21)..(21): n is a, c, t, g, unknown, or other
  misc_feature (34)..(34): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
nnnnnnnnnnnaaaanaaatnaatcccaaacccntggtggtgcaaacannancaaaggtggagctccaccgcggtggcggccgctctagaactagtggatcccccgggctgcaggaattcgcacgagaccattacctagaacatcctaatcgaaaaagaaacacagatgggcgacggggctccgccgccaggggctctatactccttcggaacgccgtggccggagctcaatcaaggcctcacctacaccgacacgttccgttgcgctgatgcggacgccgctaccaccttgattgagttctactctactaaccacaagagctcggcgccattggccaggggtgggatcaagaggattcgtaatgggccagataacccggttgatgggggaaggttgtcacctggatccaggatatgacctctgggggggatggggtctaaaaggtggggaatatccatcggttttccctttggcaaggaagccaattttgcggcccgcattttgcctgggaaaggggctcctaccgagggagggagggaccctgggttggcccctttaaaaaaggccctttctgggccttggaaaagttccttgccctaaaagggaactggttttcaaacaagcggaaactttggttttaacccaccggctttcccaattggaaaaaaaactgggagaaaaaggggccctccaatgtttgtggcgggggttcagagaagaaaaaaaaagggggggcagcggccaccgtcccc

SEQ ID NO: 15815 - protein, 83 aa, Zea mays
  misc_feature: Ceres CLONE 1379064-F
MGDGAPPPGALYSFGTPWPELNQGLTYTDTFRCADADAATTLIEFYSTNHKSSAPLARGGIKRIRNGPDNPVDGGRLSPGSRI

SEQ ID NO: 15816 - DNA, 743 bp, Zea mays
  misc_feature: Ceres CLONE 1379066-F
  misc_feature: Translation starting site: 230
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnnnnnnnnccgggccgggggcccnnccacnnnnnnnnaaaagctggagctccaccgcggtggcggccgctctagaactagtggatcccccgggctgcaggaattcgcacgagaccattacctagaacatcctaatcgaaaaatatagcttgcagcgccacctacaccgagcagccaagcgaggaagcgaagacccatttccccgagcgcaagagtaccatggcggcggcggcagtttatggcggcctcaaggggaagcttggcgtcgaggatgcccccgagctgcagctgaatcgcatccgcatcaccctctcatccaagaacgtcaagaacctggagaaagtttgtgcggatttggtaaagggagccaaggataagcatctgagggttaaggggcctgtcacgatcccctactaggggtctccacatcaccacccgcaaatccccttgcggtgaaggaacaaaccacatgggaccggtttgagttccgcatccataagagggtgatcgacctgatcagctccccccagacgtggggaagcagatcacctctatcaccattgagccgggtgttgaggtccaggggaccattgcagacgtgtaatgacgatctatatatccggggtggcttttgtttttgggctcccccttgcgggccggcaagagagacatccaggtaattgttagcctaataaacccttttggagcctgaaaggccttatgctggggggcg

SEQ ID NO: 15817 - DNA, 701 bp, Zea mays
  misc_feature: Ceres CLONE 1379067-F
  misc_feature: Encodes the peptide sequence at SEQ ID NO. 15818
  misc_feature (358)..(358): n is a, c, t, g, unknown, or other
  misc_feature (363)..(363): n is a, c, t, g, unknown, or other
  misc_feature (666)..(666): n is a, c, t, g, unknown, or other
acttaactagtggatcccccgggctgcaggaattcgcacgagaccattacctagaacatcctaatcgaaaatcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcacacattgagggaggggaggntgcanaaacaaaagccgaacaacacatccccaagctcttacttctcggtgctggagaatcggggaagtctaccatattttaaacaataaaagcttctttttccaactggggtttgacgagggaaaggttaagaagtagacttcggtcatccagcctaatggggagtcgacaagttaaaaaatttttggaggagggtaaaaggtaggcgaaagggaaaccaattcttgtaatattgcttaactccggataatggggagttggggaggaatttgagagaggggggcgaaagggaatacccggcggggagnggaacgtgtgggggggtgaagaaacactggggaaa

SEQ ID NO: 15818 - protein, 66 aa, Zea mays
  misc_feature: Ceres CLONE 1379067-F
  misc_feature (40)..(40): Xaa is any aa, unknown, or other
  misc_feature (42)..(42): Xaa is any aa, unknown, or other
MSVLTCVIESMGSSCSRSHSFDEAEAAENAKSAHIEGGEXAXTKAEQHIPKLLLLGAGESGKSTIF

SEQ ID NO: 15819 - DNA, 716 bp, Zea mays
  misc_feature: Ceres CLONE 1379076-F
  misc_feature: Encodes the peptide sequence at SEQ ID NO. 15820
cgcggtggcggccgctctagaactagtggatcccccgggctgcaggaattcgcacgagaccattacctagaacatcctaatcgaaaaagttccagccccacctcgcctctaccctcctcaaaccctacaccacgccccccggcccccagcccccggtcttcgcccaacccgatagcgtaccgccggcgcacaaccggaccctgccgtgcggttgtccaccccgctcggcgccgcccgccgccgccgccgcctttgatgtctcctacctgcgacctcggattcctctgcccccggtcgcagaagagctcccaataggtccccccagccaccgcttccggcgcccagcgattggcttccccaccgcagccgagatgagcagcggcggcgagaagatgttgttgtttgactcctttacggaggacgagactaagttgttacagggtcagcccctcaaaagtccaactaaaagtgtcatcaaagaatgtgaacggacggaagatccagtttgtgaccctgcaacttgtccattgatgaatttagagaaaaatctacttccaagtgatgttcttcctgcaaaatcagcaaaaggggaaaccagtgccatcaaccaaggagaatgcatgcaataatgaaaagaaagctgcagggtcagcctttcaaacggcgggctacagatctgggttaatgcatgcctttcctgctaatgtactggctaa

SEQ ID NO: 15820 - protein, 85 aa, Zea mays
  misc_feature: Ceres CLONE 1379076-F
MSSGGEKMLLFDSFTEDETKLLQGQPLKSPTKSVIKECERTEDPVCDPATCPLMNLEKNLLPSDVLPAKSAKGETSAINQGECMQ

SEQ ID NO: 15821 - DNA, 678 bp, Zea mays
  misc_feature: Ceres CLONE 1379077-F
  misc_feature: Encodes the peptide sequence at SEQ ID NO. 15822
  misc_feature (493)..(493): n is a, c, t, g, unknown, or other
  misc_feature (506)..(506): n is a, c, t, g, unknown, or other
  misc_feature (507)..(507): n is a, c, t, g, unknown, or other
  misc_feature (533)..(533): n is a, c, t, g, unknown, or other
  misc_feature (534)..(534): n is a, c, t, g, unknown, or other
  misc_feature (544)..(544): n is a, c, t, g, unknown, or other
cgcggtggcggccgctctagaactagtggatcccccgggctgcaggaattcgcacgagaccattacctagaacatcctaatcggaaactccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctgccggagcgcgccctcttcggccgccgcgagtggtacttcttcacgcccgcggaccgcaagtaccccaacggntcccgccccaacnngcgcgcgggtcgggctactggaaggnncacggcgcgnacaagcccgtggagcacgggggccggacggcggggaatcagaaagcgctcgtgttctaccacggcagcccgcgcgcggggtcagaacggagtggatcatggacgagtccgcctcggcgggaaaccgaagaaagc

SEQ ID NO: 15822 - protein, 151 aa, Zea mays
  misc_feature: Ceres CLONE 1379077-F
  misc_feature (21)..(133): Pfam Name: NAM Pfam Description: No apical meristem (NAM) protein
  misc_feature (95)..(95): Xaa is any aa, unknown, or other
  misc_feature (104)..(104): Xaa is any aa, unknown, or other
MAAVQQQQQQQRRDAEAELNLPPGFRFHPTDEELVAHYLCARAAGRRPPVSIIAEVDLYRFDPWDLPERALFGRREWYFFTPADRKYPNGSRPNXRAGRATGRXTARTSPWSTGAGRRGIRKRSCSTTAARARGQNGVDHGRVRLGGKPKK

SEQ ID NO: 15823 - DNA, 732 bp, Zea mays
  misc_feature: Ceres CLONE 1379079-F
  misc_feature: Encodes the peptide sequence at SEQ ID NO. 15824
  misc_feature (646)..(646): n is a, c, t, g, unknown, or other
  misc_feature (689)..(689): n is a, c, t, g, unknown, or other
  misc_feature (701)..(701): n is a, c, t, g, unknown, or other
tggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcngtctaggggtggtatgcagatctttgtgaaaacccttactggncagacatcactncttgaggtggagtcttcagatacattgacaa

SEQ ID NO: 15824 - protein, 176 aa, Zea mays
  misc_feature: Ceres CLONE 1379079-F
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (148)..(148): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLXSRGGMQIFVKTLTGQTSLLEVESSDTLT

SEQ ID NO: 15825 - DNA, 706 bp, Zea mays
  misc_feature: Ceres CLONE 1379080-F
  misc_feature: Encodes the peptide sequence at SEQ ID NO. 15826
  misc_feature (695)..(695): n is a, c, t, g, unknown, or other
  misc_feature (706)..(706): n is a, c, t, g, unknown, or other
tccccgcggtggcggccgctctagaactagtggatcccccgggctgcaggaattcgcacgagaccattacctagaacatcctaatcgaaaaaaccgcagcagggcgttgggcgagtgagtgagtcagtgaggctgggatagcagcagcagcatcagtgcgccgcactcaacttctcttcttgccgtgcggtgcggcgcggcgcggtgaggcaccgcacggccgcaagcaatgccgcgccggcagaggacgcgcagcagcgaggagctcaaggcggaggacttcgtcgactcggtgctcaacttcggcggcgaggaggaggatgggcaagaggagaagcaggaggccggcggagacggccagccggcggcggagttcaagtccaagaacctgcaggccgagcggaagcggcgcggcaagctcaaccgcaacatcctcgcgctcagggccgtgatgccgaacatcaccaagatgagcaaggagtccaccctctcggacgctatcgacctcatacagaagctccagaaccaggtccttgagctgcagcgtcagctcgccgactcgcccggagaggcctgcgagaccatgacagcgcgtcgtgctctgaatccttcactggcacggaaacatgccgtatcagggtcagatcgagctggttcctctggggtcatgcagtaccacctcggatcttctgcanaaaggcgcgcn

SEQ ID NO: 15826 - protein, 159 aa, Zea mays
  misc_feature: Ceres CLONE 1379080-F
  misc_feature (51)..(98): Pfam Name: HLH Pfam Description: Helix-loop-helix DNA-binding domain
  misc_feature (156)..(156): Xaa is any aa, unknown, or other
MPRRQRTRSSEELKAEDFVDSVLNFGGEEEDGQEEKQEAGGDGQPAAEFKSKNLQAERKRRGKLNRNILALRAVMPNITKMSKESTLSDAIDLIQKLQNQVLELQRQLADSPGEACETMTARRALNPSLARKHAVSGSDRAGSSGVMQYHLGSSAXRRA

SEQ ID NO: 15827 - DNA, 673 bp, Zea mays
  misc_feature: Ceres CLONE 1379081-F
  misc_feature: Encodes the peptide sequence at SEQ ID NO. 15828
tggcggccgctctagaactagtggatcccccgggctgcaggaattcgcacgagaccattacctagaacatcctaatcgaaaagaaaccgacctttccccctcccccgcattccacctcgcggagatccagtccagccctagggtttcgccagcggcgagccaaactccacgagcgggggaagaggggaaagcagggacgacgagggggcagccatggggcagcagtcgctgatctacgcgttcgtggcccgtggcacggtcatactggccgagtacacggagttcaccggcaacttcaccaccatcgcctcccagtgcctcatgaagctccccgcaagcaacaacaagttcacctacaactgcgacggtcacactttcaattacctcgtggaagacggattcacatactgtgttgttgctgttgaatcggtggggcaacaaattcctattgctttcatggatagggttaaggaggatttcacaaaaaggtatggtggtgggaaagctgctactgctgcagctaacagcctcaatcgagagtttggatcaaaacttaaagacacatgcagtattgtgtggatcaccctgaagaggttagcaagctggccaagtgaaggcgcaggttcaaaaggtcagggtgtatgatgaaacaattgaaaaagggtctggatcg

SEQ ID NO: 15828 - protein, 143 aa, Zea mays
  misc_feature: Ceres CLONE 1379081-F
MGQQSLIYAFVARGTVILAEYTEFTGNFTTIASQCLMKLPASNNKFTYNCDGHTFNYLVEDGFTYCVVAVESVGQQIPIAFMDRVKEDFTKRYGGGKAATAAANSLNREFGSKLKDTCSIVWITLKRLASWPSEGAGSKGQGV

SEQ ID NO: 15829 - DNA, 709 bp, Zea mays
  misc_feature: Ceres CLONE 1379086-F
tcaccgcggtggcggccgctctagaactagtggatcccccgggctgcaggaattcgcacgagaccattacctagaacatcctaatcgaaaaataccggatatgcacgcaagaacgcgctcccatcccctctcgatcgaaaacgccgccaaaatcccggcccgattcggtgtcctccgactagctcctcctgggcaaagccggcacctggatatggtattagaggaagggtcgtctattacttgggtagacactcccgacatcactcatcgtcgacctggattaggagatcgagctcgcgcgtgaggggatcaaggcgcccgggcaccagatcctcaccatctgcaaggtcctcgatcgacgttgacgaaaaaagtggagtcgtctcggagtgctgttagctccacttgaacgattgaaaaattgcttcaggatcaaaatccgcatagcatcctgtacagatgatactgatcctattgacgagtatatctgcataacagaggcgctgcgtgcacttttcaatggtgaatggtaccaattagtgaaggattgttcatgattctgccgtgaagtaatttagctacgatcattgctcaaagtgaattctaggctgctaacgacataacactggagaagaagaagtcatcttatccgctcttgtgacatggagctggcccatgagcatgaatcataactgtgaccgcgattacc

SEQ ID NO: 15830 - DNA, 702 bp, Zea mays
  misc_feature: Ceres CLONE 1379089-F
  misc_feature: Encodes the peptide sequence at SEQ ID NO. 15831
  misc_feature (481)..(481): n is a, c, t, g, unknown, or other
tccccgcggtggcggccgctctagaactagtggatcccccgggctgcaggaattcgcacgagaccattacctagaacatcctaatcgaaaactcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaacaagactgcgatctcggactacatcaagggcagctacggctcccacctccctgcccagcacaacgccgtcctcacgggccacctcgcccgcatgaaggctaccggtgagctcgccttcctcaggaacaactatctcctccccaacgaggacgaagcctccccgctgagcaccggtgggcacaagggcccccgcgcccgcgaggagtctactgggcgtgtggacgttggtgacgatgtngtgcttgcttcccctctcgtcatcgacgctgacgccgtcgacattgacgtgcctgctccagctcccgttgtcaccgctgatgtcgacgacattgacgtgcttgctccagctcccgttgtcagcgctgatgtcaccctggtcataccaagcggggacgcggacgcccccgaagcaagggacccccgtgctgaggggtacggtggaagcccgctaggtcccgt

SEQ ID NO: 15831 - protein, 189 aa, Zea mays
  misc_feature: Ceres CLONE 1379089-F
  misc_feature (15)..(85): Pfam Name: Linker_histone Pfam Description: linker histone H1 and H5 family
MAGKDGSVPSPPPPRLPSYPEMIVEAIRALGLENGCNKTAISDYIKGSYGSHLPAQHNAVLTGHLARMKATGELAFLRNNYLLPNEDEASPLSTGGHKGPRAREESTGRVDVGDDVVLASPLVIDADAVDIDVPAPAPVVTADVDDIDVLAPAPVVSADVTLVIPSGDADAPEARDPRAEGYGGSPLGP

SEQ ID NO: 15832 - DNA, 681 bp, Zea mays
  misc_feature: Ceres CLONE 1379092-F
  misc_feature: Encodes the peptide sequence at SEQ ID NO. 15833
tggagctccccgcggtggcggccgctctagaactagtggatcccccgggctgcaggaattcgcacgagaccattacctagaacatcctaatcgaaaaacaaacttcccctgtcacgagagtacgagaccacgccttctgtgggatcaatcggctagggtttcggagatgttcggccgcgcgccgaagaagagcgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctatgaccagtatggcgaggatgccctcaaggagggaatgggaggcggtggtgggatgcatgatccctttgacatattccagtcattctttggtggtggaagcccttttggaggtggcagcagtaggggcagaaggcaacgacggggagatgatgtggttcatcctctgaaggtttctctggaggatttgtacaatgggacatcaaagaagctctctctgtccccgcatgtcctctgctccagtgcaatggtaagggttccaagtttggagcttcctcgagggggctgggtgtcaaggttctgggcttc

SEQ ID NO: 15833 - protein, 171 aa, Zea mays
  misc_feature: Ceres CLONE 1379092-F
  misc_feature (13)..(71): Pfam Name: DnaJ Pfam Description: DnaJ domain
MFGRAPKKSDNTRYYEILGVSKDASQDDLKKAYRKAAIKNHPDKGGDPEKFKELAQAYEVLSDPEKREIYDQYGEDALKEGMGGGGGMHDPFDIFQSFFGGGSPFGGGSSRGRRQRRGDDVVHPLKVSLEDLYNGTSKKLSLSPHVLCSSAMVRVPSLELPRGGWVSRFWA

SEQ ID NO: 15834 - DNA, 817 bp, Zea mays
  misc_feature: Ceres CLONE 1379093-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (817)..(817): n is a, c, t, g, unknown, or other
nnnccccnccccnnnnnnnnnnttnntgggggcnnnnggggcgnngggccaaatctggagctccaccgcggtggcggccgctctagaactagtggatcccccgggctgcaggaattcgcacgagaccattacctagaacatcctaatcgaaaaaaaaaaaaacgccggctgcaactgcaatcggcgacggtgaaccatagagcagccggcagcgtcgccgtcgcgccgctcccgcactgctcccctgccccggccgccgccgccgtcgccgtccgcccgctcaccgctgatcgatgaccgcccgctctggcgctcggccttcgccccgtttctgccctcgcccctcagccgcctcggcgcctgtccgagaccgacgtcctctctccatccaggcagttgaccagctcgactgctctagctcgagctctccggcgcggatttgaattccttcctttcagccccaacccagccccaaaggccgccaggatcggggggactcccgtcccaacccccggggggccaccggatcccccctttttccaccccccctcttcctccctcggtggggcgggggggaaagatgatttcccccaaaaggccagaaggcaggctcccctggaggcgcgccttcaaccaccgcccgagaaaccggcatcagcggccggggggcttggcaacccttgcgcggaaggcgggggaatggaagggagcctggggataacttctgcaggcgccgcccccgcccccaaagggggagtccgggcgggggccttgggcgggggaagggtgcgtttagggggttagggaagggagaaan

SEQ ID NO: 15835 - DNA, 698 bp, Zea mays
  misc_feature: Ceres CLONE 1379095-F
  misc_feature: Encodes the peptide sequence at SEQ ID NO. 15836
  misc_feature (501)..(501): n is a, c, t, g, unknown, or other
ctccccgcggtggcggccgctctagaactagtggatcccccgggctgcaggaattcgcacgagaccattacctagaacatcctaatcgaaaaattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctccctctgtcattgttgggctcgtgccatatgtgaagactcctcgtgggctccgcacacctcactctggttgggcccacatcttaatgaaaaggggaggaaaaggntctacaagaactgtgggaagaagcaaaaaggagggttttcccaaagtatggttcccaaaaatgaaaagggatgctgggaaaaaaggaaattcccccttgcgccttggaaaaaaatgaaaaaaatggtttctggtataccgggcctttgccccatccccaaattaagaaaaatatgagggttttaaaacaaaacaaag

SEQ ID NO: 15836 - protein, 155 aa, Zea mays
  misc_feature: Ceres CLONE 1379095-F
MSHRKFEHPRHGSLGFLPRKRSSRHRGKVKSFPRDDPKKPCHLTAFLGYKAGMTHIVREVEKPGSKLHKKETCEAVTIIETPPSVIVGLVPYVKTPRGLRTPHSGWAHILMKRGGKGSTRTVGRSKKEGFPKVWFPKMKRDAGKKGNSPLRLGKK

SEQ ID NO: 15837 - DNA, 764 bp, Zea mays
  misc_feature: Ceres CLONE 1379097-F
  misc_feature: Encodes the peptide sequence at SEQ ID NO. 15838
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnncccgccccctcgttgaggggaacccnnncccaaaatggagctccaccgcggtggcggccgctctagaactagtggatcccccgggctgcaggaattcgcacgagaccattacctagaacatcctaatcgaaaattttgttgagacctagatacgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgcggtcctgatcccgctctccgcgggtatggccctcctcggcgtgctccgctactgtggcggcagggtcatgccctccccggggacctctccgtctcccgaccccaagctcgttaagggagggcagggggtcatcaagggcgaggaacctggaggaccaacgcacagttcatcccggcccaaggcttttcagggcacgcaagggtttattaaccccaacgagggaagagggattacctccctggcgccaaggggaggacggcgcaaaaagggctcaggcaggccatggtttttctggacccaaaccatgggccccgggaacatgattgtaagaaaagaaccctactcccctgggagaagtttccccccgaaacacttaaccatttggcaccgcggggg

SEQ ID NO: 15838 - protein, 123 aa, Zea mays
  misc_feature: Ceres CLONE 1379097-F
MALLGVLRYCGGRVMPSPGTSPSPDPKLVKGGQGVIKGEEPGGPTHSSSRPKAFQGTQGFINPNEGRGITSLAPRGGRRKKGSGRPWFFWTQTMGPGNMIVRKEPYSPGRSFPPKHLTIWHRG

SEQ ID NO: 15839 - DNA, 668 bp, Zea mays
  misc_feature: Ceres CLONE 1379100-F
  misc_feature: Encodes the peptide sequence at SEQ ID NO. 15840
  misc_feature (422)..(422): n is a, c, t, g, unknown, or other
  misc_feature (445)..(445): n is a, c, t, g, unknown, or other
tggagctccccgcggtggcggccgctctagaactagtggatcccccgggctgcaggaattcgcacgagaccattacctagaacatcctaatcgaaaagctttcgctttggcgtcttcgagaacccgcaagcaacctatatagcccgccgcgaattccgcctggcttcctcgtcgcccgcctcgtcgtcgcgccgcagtgagaggagggggaggcgatggatctcaacgaatgcgagaggagggggccggcggggccggatccgctgtcgaggcaggggtcgatctactcgctcacgttcgacgagttccagaaccgcttcggcgggatggggggagggcttggcaaggacttcggctccatgaacatggacgagctgctgcggagcatctggaccgccgaggagagccaggccatggcgtcngcttcggcctcggcctcggcctncgtgtccgcgctgggggcagccgtcgacggcggggcggcgctgcagagacagggtctctcgcgctgccgcgcactctcaacgtcaagacgggggacgagggcctggcgggacttcgtgcgggaggccccccccgggacggctggcggcgaagaacccccaaccaaccgacagccgactctcggggagatgacgctggaggagttcctggtcagggccggggtc

SEQ ID NO: 15840 - protein, 151 aa, Zea mays
  misc_feature: Ceres CLONE 1379100-F
  misc_feature (77)..(77): Xaa is any aa, unknown, or other
MDLNECERRGPAGPDPLSRQGSIYSLTFDEFQNRFGGMGGGLGKDFGSMNMDELLRSIWTAEESQAMASASASASAXVSALGAAVDGGAALQRQGLSRCRALSTSRRGTRAWRDFVREAPPGTAGGEEPPTNRQPTLGEMTLEEFLVRAGV

SEQ ID NO: 15841 - DNA, 922 bp, Zea mays
  misc_feature: Ceres CLONE 1379102-F
  misc_feature (6)..(6): n is a, c, t, g, unknown, or other
  misc_feature (7)..(7): n is a, c, t, g, unknown, or other
  misc_feature (9)..(9): n is a, c, t, g, unknown, or other
  misc_feature (11)..(11): n is a, c, t, g, unknown, or other
  misc_feature (16)..(16): n is a, c, t, g, unknown, or other
  misc_feature (18)..(18): n is a, c, t, g, unknown, or other
ctcccnncncncattncntctctacccggtaaaaaactcaacccccaaaaattggagctccccgcggtggcggccgctctagaatagtggatcccccgggctgcaggaattcgcacgagaccattacctagaacgtcctaatcgaaaaaactactccgtcactttgtttgcaaagctcctcctcgatccatcgatcactgcaccggccggtggcaccgcgctcgcaggggctagccaacgagacggcagcattggcggaccgtgaccgcagcgacatctacggcggtgcccacgccacctaccggcaccaacaccagcagggagggaggcgcgccgcccaatggacgaccagggtgaacgccatgatcccccgaccaggggtccgaacgccgcccacggcgatgaacgtgggccaacccttcttcccccctgggtcgtggtctgcttgttggctgctagccggccgtctggccctctaactctcctctcctcgtcgcggaattgatccattcacccaaccccccgcggtgctccctgaatctccctcgacctccccagcgtgtgctccccccctcttgcgactcctaccatcctcccgcgaacatgcttcccccacttgtggggggacacactcaccaaacatctctggaccccacgacctggtcgccatatccggtagcgcactcggccccttcggctcccagcgtgtctccgcctccccaatatgaggcctgcctctcaatggggcttcctccttctacatactacccgaaacaacacaactcccttcggtaagtcgctcacctccctcacccaattaattctttcacccttccaactcacccgccatctgtccctactacaaccacctggccgcgagcacaccacccctcctcgcccacctcatgccgcaccacggcct

SEQ ID NO: 15842 - DNA, 715 bp, Zea mays
  misc_feature: Ceres CLONE 1379104-F
  misc_feature: Encodes the peptide sequence at SEQ ID NO. 15843
  misc_feature (475)..(475): n is a, c, t, g, unknown, or other
  misc_feature (524)..(524): n is a, c, t, g, unknown, or other
  misc_feature (598)..(598): n is a, c, t, g, unknown, or other
cgcggtggcggccgctctagaactagtggatcccccgggctgcaggaattcgcacgagaccattacctagaacatcctaatcgaaaaaatcaatcaaaaaaaaagttcgttttctttctcaaaccctttctagcgatgtcaggttaccctccgacgagccaaggctacagttacggctacggcggtggaaatcaacctccccctcctcagccaccttactcctccaccggaaacaatcctccgacgagccaaggtcacggttacggctacggcggcggaaacaatcctccgtacggatcatcatctccttacgctgtcccctacggcgcgtcgaagccccaatcctcgtctgctccttctgctccaccgtacgctccttctcctcctccaggggacttcaacccgccaaaggacaagcctttcggcggcggctacggagcttcgccgccgtctggggcttacggtgctgctcctnccccgtcgggagggatacgagctgctcccgcgcattccgaatacgcggntacggcgctgcgccgcgtccttacggcggatacggagctgctgctccgccgtcgggggtcctgaatacggcggntacggtggtgctccggctcgtccaggaggaacggaggctatccttctcctcagggggcttcttacgaagccctttccttctctgggttcgtcgggttttgctccggggaccgatcga

SEQ ID NO: 15843 - protein, 150 aa, Zea mays
  misc_feature: Ceres CLONE 1379104-F
  misc_feature (114)..(114): Xaa is any aa, unknown, or other
  misc_feature (130)..(130): Xaa is any aa, unknown, or other
MSGYPPTSQGYSYGYGGGNQPPPPQPPYSSTGNNPPTSQGHGYGYGGGNNPPYGSSSPYAVPYGASKPQSSSAPSAPPYAPSPPPGDFNPPKDKPFGGGYGASPPSGAYGAAPXPSGGIRAAPAHSEYAXTALRRVLTADTELLLRRRGS

SEQ ID NO: 15844 - DNA, 732 bp, Zea mays
  misc_feature: Ceres CLONE 1379105-F
  misc_feature: Encodes the peptide sequence at SEQ ID NO. 15845
  misc_feature (459)..(459): n is a, c, t, g, unknown, or other
  misc_feature (574)..(574): n is a, c, t, g, unknown, or other
  misc_feature (593)..(593): n is a, c, t, g, unknown, or other
  misc_feature (600)..(600): n is a, c, t, g, unknown, or other
  misc_feature (661)..(661): n is a, c, t, g, unknown, or other
ggagctccccgcggtggcggccgctctagaactagtggatcccccgggctgcaggaattcgcacgagaccattacctagaacatcctaatcgaaaaaaaacacgccctatgagggccctcgtccggatccacctgcccacggccatctccaccggatccttcctccacacctcatcaaccgccgcctccaagaccctagtaccgaaccccaacctcgtcccgctccggctcgtccgccactttccggccatggccgccaccgccgcagacgagttcgtgaagggccgcgtcttccccaacggcgtcgccgtcatcacgctcgaccgacccaaggccctcaacgccatgaacctcgaaatggatgttagatacaaggcacttcttgatggatgggaaacaaatccaagtgtcaagtgtattcttgtggaaagcagctctcctcgtgccttctcagcaggnatggatattaaggggggttgccgtggaatacaaaaagacaaaaaaccccacttgtgcaaaaggtctcacagcagagtactccttatttggtagatacatgagtatgcaaaccttnatatatgcttgatggatgnagtgacnatgggatttggaatgggctatcagggcatggccgctaccgcattattacagagagacactnctagccatggcctgaaatggtattggcctgttccaagatgtgggcttggctacatgggtgcaaaggggcag

SEQ ID NO: 15845 - protein, 147 aa, Zea mays
  misc_feature: Ceres CLONE 1379105-F
  misc_feature: SWISSPROT Homolog: EC 3.1.2.4 3-hydroxyisobutyryl-CoA hydrolase
MRALVRIHLPTAISTGSFLHTSSTAASKTLVPNPNLVPLRLVRHFPAMAATAADEFVKGRVFPNGVAVITLDRPKALNAMNLEMDVRYKALLDGWETNPSVKCILVESSSPRAFSAGMDIKGGCRGIQKDKKPHLCKRSHSRVLLIW

SEQ ID NO: 15846 - DNA, 616 bp, Zea mays
  misc_feature: Ceres CLONE 1379108-F
  misc_feature: Encodes the peptide sequence at SEQ ID NO. 15847
ggagctccccgcggtggcggccgctctagaactagtggatcccccgggctgcaggaattcgcacgagaccattacctagaacatcctgatcgaaaactctcgattcggaaaacctccaaggctccaaccctagccgcgatccgacaacgcctccatccctagccgactgctgcaagcttcagagctcaagagtcagggcgccatggcgacagagacggagaccttcgcctttcaggctgagatcaaccagctgctctcactcatcatcaacaccttctattccaacaaggagatcttcctccgggagctcatttccaactcttccgatgcgttggacaaaatcaggttcgagagcctcactgacaagagcaagctcgatgcgcagccggagctgttcatccacattgtaccagacaaggcttcgaacacgctctccatcatcgacagcggcatcggcatgaccaagtccgacttggtcaacaacctcggtaccatcgccagggtccgggaccaaggagttcatggaaacccttgctgctggcgctgatgtgtctatgattggggcagttcgggggtcggtttctactctggctacctcgtccgcgaagagaagccg

SEQ ID NO: 15847 - protein, 114 aa, Zea mays
  misc_feature: Ceres CLONE 1379108-F
MATETETFAFQAEINQLLSLIINTFYSNKEIFLRELISNSSDALDKIRFESLTDKSKLDAQPELFIHIVPDKASNTLSIIDSGIGMTKSDLVNNLGTIARVRDQGVHGNPCCWR

SEQ ID NO: 15848 - DNA, 729 bp, Zea mays
  misc_feature: Ceres CLONE 1379110-F
  misc_feature: Translation starting site: 182
  misc_feature: Pfam Name: EF1_GNE Pfam Description: EF-1 guanine nucleotide exchange domain
tccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagccctcagattccctggtaaggctgttggtgtaaatctgcctgcgggatcagctcctggcgcagctgctcctgcgggatgagctgaggacgatgatgaccttgatctttttggtgatgaaactggagaggacagaaggcagctgatgagcgtgcccgcgctgccaaggcctcttctaaaagaaagaaagtgtaaatcctccgtccttatggatgtcaaccatgggacgatgagactgatatgaaaagctggaggaggctgtccgcagtgtccagatggaaggtctgacttggggacatcaaagctggtgcctgttggatacggcatcagagatgactatatgttgacatttgcgac

SEQ ID NO: 15849 - DNA, 800 bp, Zea mays
  misc_feature: Ceres CLONE 1379112-F
  misc_feature: Encodes the peptide sequence at SEQ ID NO. 15850
ggagctccccgcggtggcggccgctctagaactagtggatcccccgggctgcaggaattcgcacgagaccattacctagaacatcctaatcaaaaaatctcactcatcagctagcaccaccaggaagtaggaacacacctcccaccagtccactgtttcatcgctcatcactaggctgcaatggctgcaaagtcacctgtgcttgcagcactggtactgctcctgagctccgcccagctgtccacgggggcaaggaggcgcatggagctgtaccaccccgatccgggggacatgctctcctaccacaacggatccgtgctccactccgacatcttcgggtccgtgctcctggtacggccgcttcccgcaggtgcaaaaaggagataatccaacaatttcctgatttcgttcaccacccttgccccaaggccgcttcgcggtccggacggggaattggtgggaaattgatccacaccaaaaaaaccgtgtccaaagggggaggaaaaaccactgaggctacccacccccccggctggatgtctggaacaccaacccatgcggttccccacaacaaaggactagtcccctgtgggacagtcccctcaaaccctggggagacatttccctacccccttaaccatggggggccctaggaccaagtaaagagggcgcgctctccggcagtgaggcacccaacgtgacattgactttgacacgtgaaagcgttttttccccccaaacacagaggatgtcgccgtcaaggaaacggataaatcccccctccccttccccaccaccgg

SEQ ID NO: 15850 - protein, 68 aa, Zea mays
  misc_feature: Ceres CLONE 1379112-F
MAAKSPVLAALVLLLSSAQLSTGARRRMELYHPDPGDMLSYHNGSVLHSDIFGSVLLVRPLPAGAKRR

SEQ ID NO: 15851 - DNA, 880 bp, Zea mays
  misc_feature: Ceres CLONE 1379114-F
  misc_feature: Encodes the peptide sequence at SEQ ID NO. 15852
  misc_feature (29)..(29): n is a, c, t, g, unknown, or other
  misc_feature (863)..(863): n is a, c, t, g, unknown, or other
ccatcatacaaccccccccccccccctcnctcttatttttattcaaagctggagctccccgcggtggcggccgctctagaactagtggatcccccgggctgcaggaattcgcacgagaccattacctagaacatcctaatcgaaaaaagatctctctccctttcccccctctctctctctccgaactctaccccgcagtctcggccgcggccatggcggaggacgcccccaacgccgtcgccgagggcagccagcccgcggcctccgagggatccgccgacgccgccctgtcggctgccgcgggcgccaaggccgcggaggcgctgctcccgacgctcagtatctggctgccgtcgcagagcacgcgcgacgccgtggtgccccggctcgggccgacggtcgccggggaccaggcccttctccccatcttattgttgccgcccccgaagccccgtatgtgggggggtgtcgtccgggagccggccaggtcccaggtctttggaccgtcggcctcccaaatccccgtagcacgccgaccaccttgaatgctcccggccctccccctaaaggagggccgaactacaggcggctttccaaggcatagattcccgcgggggaggggtctgttcctcgtactctcttcacggggatgttctccaggaacacccgcaccaccccgtctgctctgggctacgggcgctcagttcccacccacaataggagtaacccctccctaacgccccctgtggctccggggccgccgcccccctcttccaggccacagtgcctcctccaatcaaacaaatttagttcactggccccccaatcagctcatagccgatgctgctacgctacatcgacancgtgaggaatcaccctg

SEQ ID NO: 15852 - protein, 110 aa, Zea mays
  misc_feature: Ceres CLONE 1379114-F
MAEDAPNAVAEGSQPAASEGSADAALSAAAGAKAAEALLPTLSIWLPSQSTRDAVVPRLGPTVAGDQALLPILLLPPPKPRMWGGVVREPARSQVFGPSASQIPVARRPP

SEQ ID NO: 15853 - DNA, 721 bp, Zea mays
  misc_feature: Ceres CLONE 1379115-F
  misc_feature: Translation starting site: 210
  misc_feature: Pfam Name: Motile_Sperm Pfam Description: MSP (Major sperm protein) domain
  misc_feature (373)..(373): n is a, c, t, g, unknown, or other
  misc_feature (376)..(376): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (423)..(423): n is a, c, t, g, unknown, or other
tccccgcggtggcggccgctctagaactagtggatcccccgggctgcaggaattcgcacgagaccattacctagaacatcctaatccaaaaagcctcgcttcccaaaccctagctcctcgctctcccgcccgcgtggcctgccaggcaaccacccccagatcaactccgtacagcgtgcctccgcctcccggactccagcggcggcgggatgtggtctcactccaaggacttgctcgagatcgagcccctcgagctccgattcccattcgagacaaagaagcagatctcgtgctctatgcagttgacaaaccgaacagatgactacatcggctttagggtaagacgacgagcccgaagaatactgtgtccggnccnaacagcgcatcgtggcacctcgnnntcacagcgatgtcattgtgacnatggcaagcacaaaggagggcgcaccagacatgcagtgcaggaacagtttcttgtgcaaagtgccttttggggcggaagggaacctttatcagggaatcccctggggatttgttaacaaaaaatcacttaagggggggggaaggggttagcttaaaggggttttaattccccccccccaaaaccccttccccggggggtggggaaattaaaaaagagttttccccccccaccctcttgtgggccgggggagatatttttgtttttttacaaaaacaccggggtgttttttttggtcct

SEQ ID NO: 15854 - DNA, 838 bp, Zea mays
  misc_feature: Ceres CLONE 1379117-F
  misc_feature: Encodes the peptide sequence at SEQ ID NO. 15855
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (29)..(29): n is a, c, t, g, unknown, or other
  misc_feature (34)..(34): n is a, c, t, g, unknown, or other
nnnccccccccnnnnnnntccccccaccnatatnggacgttgccccccccgaaaggtggagctccccgcggtggcggccgctctagaactagtggatcccccgggctgcaggaattcgcacgagaccattacctagaacatcctaatcgaaaaacacccatgtccacctccgtctccgccgccgccgttgccgctctcgtcccacccctcaccggccgccggtcgccgccggcatctcgcgtaccgcagatttgccgaagaagaatcagatccaaaccccgtatcttctcttcttccccctccttccccattgtccccgccgctgccatggccacccggcggcgccgcccccaccggctcggatgccgggtccaagaagaagttgctcatcttcccacctccgaggaggatctcgccggtcttctctttgcgaaagtacacttgccgaagttgtcggaagaaagtcccccggccccaaaagggggtggcctttcccccgcccgtggcttctctgggggggacccccctcaatcggagggccacttccagggaaaccttgaccgggaagcgccgcccgtgaacccttggaaattcccacgcggccaccttggaagcgcaaaggggcgccaacgctcctttcccgggggcgcggaatggaaaagggggtccgtggcccccaagggacccagtggtccggattagccccaccttccgaggcttcccacctaatgaatggggggtttccgccctccacaggggggggccaatttcctctctgtggaaagaagtttttaattgcccaataaaatggaatggcgtgtggcccaatcctaaaaag

SEQ ID NO: 15855 - protein, 180 aa, Zea mays
  misc_feature: Ceres CLONE 1379117-F
MSTSVSAAAVAALVPPLTGRRSPPASRVPQICRRRIRSKPRIFSSSPSFPIVPAAAMATRRRRPHRLGCRVQEEVAHLPTSEEDLAGLLFAKVHLPKLSEESPPAPKGGGLSPARGFSGGDPPQSEGHFQGNLDREAPPVNPWKFPRGHLGSAKGRQRSFPGGAEWKRGSVAPKGPSGPD

SEQ ID NO: 15856 - DNA, 668 bp, Zea mays
  misc_feature: Ceres CLONE 1379120-F
  misc_feature: Encodes the peptide sequence at SEQ ID NO. 15857
  misc_feature (408)..(408): n is a, c, t, g, unknown, or other
aagctggagctccccgcggtggcggccgctctagaactagtggatcccccgggctgcaggaattcgcacgagaccattacctagaacatcctaatcgaaaaaaacaagcaaaaggcacgaccaccaccgccggccgggaagcaagctcaaaccctaatcgccgtccgccggcgacgccagcacgatggcccgctacgaccgcgccatcaccgttttctcccccgacggccacctcttccaggtggagtacgctctcgaggccgtccgcaagggcaacgccgccgtgggcgtccgcggcacggacaccgtcgtcctcggcgtcgagaagaagtccacacccaagctccaggactccaggtccgtgcgcaagatcgcgtgcctagacactcacatagctctggcgtgcgncgggctgaaggcggacgcgcgcgtgctcatcaccggcgcgcgggtcgagtggcagagccaccgactcaccgtcgaggaccccgtcaccgtcgagtacatcacccgctacatcgctgggctgcagcagagtatacgcagagtggggggagtccgccccttcggccttttcaccctcattggcgggttcgacccctacacggacaaggcagggtggaccagaccgatccatccgggaccctctctggctgggaaggccatgg

SEQ ID NO: 15857 - protein, 161 aa, Zea mays
  misc_feature: Ceres CLONE 1379120-F
  misc_feature (27)..(161): Pfam Name: Proteasome Pfam Description: Proteasome A-type and B-type
  misc_feature: SWISSPROT Homolog: EC 3.4.25.1 Proteasome endopeptidase complex
  misc_feature (75)..(75): Xaa is any aa, unknown, or other
MARYDRAITVFSPDGHLFQVEYALEAVRKGNAAVGVRGTDTVVLGVEKKSTPKLQDSRSVRKIACLDTHIALACXGLKADARVLITGARVEWQSHRLTVEDPVTVEYITRYIAGLQQSIRRVGGVRPFGLFTLIGGFDPYTDKAGWTRPIHPGPSLAGKAM

SEQ ID NO: 15858 - DNA, 677 bp, Zea mays
  misc_feature: Ceres CLONE 1379131-F
  misc_feature (428)..(428): n is a, c, t, g, unknown, or other
  misc_feature (641)..(641): n is a, c, t, g, unknown, or other
tggagctccccgcggtggcggccgctctagaactagtggatcccccgggctgcaggaattcgcacgagaccattacctagaacatcctaatcgaaaaaagtgcagatcacactagcctacacacaccgagcgccgtctaaactgacagcaggtcagcagcctagcgaagccaagacatccgccgatctcaggtggccgggagaagggtgcgcggcaagagtgccgtggccgtggcggccgtcgcgctgctggcgctgctcttcgcggcgagcgaggccgacgggacgtgcaacgtcgaccggggcacggtgctgaggcagtgcgcgtcctgctcgagcggcgcgccgagccaggggtgctgcgacgcgctgaggaacgccgacttcggctgcctctgcagcaactactggaaaacagctcagaacacngcatacgccagctgcgccaagggcatccccttccgcgtggcaccctccaaacgccaagtggcagtagatggagacatggagtgcgtgacccggacagcgaacgggcagcttggaccaacagaaataatccgcttcattaccctgtttctccctctctgagtggggtagttctttgctttgagtcgtatccgatatgatcgggtgcctgctagnccggcggacgttctatatatggctttgcactaaaaa

SEQ ID NO: 15859 - DNA, 670 bp, Zea mays
  misc_feature: Ceres CLONE 1379133-F
  misc_feature: Translation starting site: 198
aagctggagctccccgcggtggcggccgctctagaactagtggatcccccgggctgcaggaattcgcacgagaccattacctagaacatcctaatcgaaaaatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaagggcggttccgacgacgtgggtgccgcctccgccaacagcaccgccgcctccggtgaggaccctcagaactgggatgccgacttcgtcaaggtcgacccagccacgcttttcgacctcatcttggctgcaactatctgaacatcaagggtctgctcgacctgacctgtcagactggtgctgacatgatcaaggcaagacaccagagagtttcgcagaccttcacaatcagatgacttccc

SEQ ID NO: 15860 - DNA, 679 bp, Zea mays
  misc_feature: Ceres CLONE 1379134-F
  misc_feature: Encodes the peptide sequence at SEQ ID NO. 15861
  misc_feature (679)..(679): n is a, c, t, g, unknown, or other
tggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccaggctccgagactccgagtctcgctcgcaccccgtcccctggagtctgtgctctgggttgcatgcaggtgagctgcgatggagcgcggacgcgcctaggagatgcaggcatattcggcgaggaagagacttgcattgctggccctgcttctcatggaggcgcccgtccgcccggactcgtcggctccggtgcaggatggcctgctcaccaatggtgactttgagactgcaccaagtggggggtttgtgacatctgcttctgtcgctgaggtggcatcgtcaatccctgtctggacgatcaacggtacggtggaactcatttcagcagggcaacaccagagtgccatgatcctgattgtcccacagggtgaccatgctgtaaggatagggaatgatgctagcgtttggcaggtggtggacgttgagaagggttcggagtatgctatcacattcgaggctgaccggacatgtgtataaatgtaggcactgaatgtttctgtgctaagtggcgtggctcaaacan

SEQ ID NO: 15861 - protein, 124 aa, Zea mays
  misc_feature: Ceres CLONE 1379134-F
MQAYSARKRLALLALLLMEAPVRPDSSAPVQDGLLTNGDFETAPSGGFVTSASVAEVASSIPVWTINGTVELISAGQHQSAMILIVPQGDHAVRIGNDASVWQVVDVEKGSEYAITFEADRTCV

SEQ ID NO: 15862 - DNA, 652 bp, Zea mays
  misc_feature: Ceres CLONE 1379137-F
  misc_feature: Encodes the peptide sequence at SEQ ID NO. 15863
gctctagaactagtggatcccccgggctgcaggaattcgcacgagaccattacctagaacatcctaatcgaaaaacgcgcctcctctcgccctcgctccgccgccgccgccgccgccgcatcaagcacccgccccgccgtcgcctgaggtagacaccaatccgccgccatggggcgtatgcacagccgcgggaagggtatctcatcgtcggcgctgccgtacaagaggacgcctcctacctggctcaagaccgctgcctccgacgtggaggagatgatcacaaaggcagcgaagaagggacagatgccgtcgcagatcggcgtcctgctccgtgaccagcacggtatcccccttgtcaagagcgtcaccggcagcaagatcctccgcatcctcaaggcccatgggctggcaccagaaatccccgaggacctgtacttcctcatcaagaaggcggtggcgataaggaagcaccttgagaggaacaggaaggacaaagactctaaattcaggctcattcttgtggagagcaggatccaccgccttgcccgctactacaagcgcacaaagaaacttccacccacctggaagtatgagtcaaccacagcggagcactctggggggccctaggtgtggaatcctccgacagcttggt

SEQ ID NO: 15863 - protein, 152 aa, Zea mays
  misc_feature: Ceres CLONE 1379137-F
  misc_feature (1)..(60): Pfam Name: Ribosomal_S13_N Pfam Description: Ribosomal S13/S15 N-terminal domain
  misc_feature (65)..(147): Pfam Name: Ribosomal_S15 Pfam Description: Ribosomal protein S15
MGRMHSRGKGISSSALPYKRTPPTWLKTAASDVEEMITKAAKKGQMPSQIGVLLRDQHGIPLVKSVTGSKILRILKAHGLAPEIPEDLYFLIKKAVAIRKHLERNRKDKDSKFRLILVESRIHRLARYYKRTKKLPPTWKYESTTAEHSGGP

SEQ ID NO: 15864 - DNA, 741 bp, Zea mays
  misc_feature: Ceres CLONE 1379140-F
  misc_feature: Encodes the peptide sequence at SEQ ID NO. 15865
  misc_feature (224)..(224): n is a, c, t, g, unknown, or other
  misc_feature (300)..(300): n is a, c, t, g, unknown, or other
  misc_feature (357)..(357): n is a, c, t, g, unknown, or other
  misc_feature (494)..(494): n is a, c, t, g, unknown, or other
acccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcggnggctacggcgacctccagcgcgggggcggcatgcacggcgaggcgcagcagcagcagaagcagggcgccatgatgnacgcgctcaaggccgcgacggccgcgaccttttcgcggtcgatgctggtgctgtccnggctgatcctggccggcaccgtgatcgcgctcacgtggccacccccgtgctggtgatctcagccgtgtcttgggtggccggcccccatcgggctggggctaatggggggccgggttcgtcacctcgggggcccccgnggtccttgcgctgtcccgggtcccctgggatgaacaagaacctgaggggaaaggccccccggggggcgaccaagttggacacgccaaggggggggtgggggcccaggcccccggattttagggggggaaaacgccccctccacaagggggggggggttttagaaaaaaacccctcggggggggaggggggggggctctcttaaacatgggggggggggggataaggccccaaaagggggggtgcggt

SEQ ID NO: 15865 - protein, 75 aa, Zea mays
  misc_feature: Ceres CLONE 1379140-F
  misc_feature (39)..(39): Xaa is any aa, unknown, or other
  misc_feature (58)..(58): Xaa is any aa, unknown, or other
MADHHRGATGGGGGYGDLQRGGGMHGEAQQQQKQGAMMXALKAATAATFSRSMLVLSXLILAGTVIALTWPPPCW

SEQ ID NO: 15866 - DNA, 737 bp, Zea mays
  misc_feature: Ceres CLONE 1379145-F
  misc_feature (322)..(322): n is a, c, t, g, unknown, or other
  misc_feature (325)..(325): n is a, c, t, g, unknown, or other
  misc_feature (409)..(409): n is a, c, t, g, unknown, or other
  misc_feature (423)..(423): n is a, c, t, g, unknown, or other
  misc_feature (449)..(449): n is a, c, t, g, unknown, or other
  misc_feature (457)..(457): n is a, c, t, g, unknown, or other
  misc_feature (458)..(458): n is a, c, t, g, unknown, or other
  misc_feature (541)..(541): n is a, c, t, g, unknown, or other
  misc_feature (598)..(598): n is a, c, t, g, unknown, or other
  misc_feature (699)..(699): n is a, c, t, g, unknown, or other
  misc_feature (706)..(706): n is a, c, t, g, unknown, or other
aagctggagctccccgcggtggcggccgctctagaactagtggatcccccgggctgcaggaattcgcacgagaccattacctagaacattctaatcgaaaactctcgtctcgtctcgtctgcagtagcagtctccgcatccgctgcctccgcctcctccgtcgatttggattcgcagcggcggcggcggccaatcaaagcaatcatcacccagtcgcccagcccaacagacgctccagtccccagccctcccacccgcctcgatcgatgcgaggcacaatgccggccaccgactcctcctcctcctcctcctcctcgccggnggnggcgccgctgtcctccatcggccgctccatccgctcgctccgccgtggacagaacagatccactccttttccgcgcgccagacngcacagacgccttnccagcgcgcgcccgccaactcctggnccgactcnncggcagcgacgacgtcctctccctcgcctggacgcgcccgctcctcgaatccttcctcctctgcctcgagggagtccgcgccntgctcttcggctccggggactcgcccgctgctcgggccccgctcgaccgcctcgtcngcgacttctccgaacgcgccggtcaggggctcgacctctgcaacggccgtcgcgaacggctcgaactcgttcgcagtggggcagcaccctcgcatcgccgnaggcggnctcgcctcgtcctctgattcctctcgccggt

SEQ ID NO: 15867 - DNA, 719 bp, Zea mays
  misc_feature: Ceres CLONE 1379146-F
  misc_feature: Encodes the peptide sequence at SEQ ID NO. 15868
  misc_feature (366)..(366): n is a, c, t, g, unknown, or other
  misc_feature (367)..(367): n is a, c, t, g, unknown, or other
  misc_feature (481)..(481): n is a, c, t, g, unknown, or other
  misc_feature (612)..(612): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgnncggtgtgggcagccgagcgccatgttccagcccgctccggcacagtgctgccagcagcagatgaggatgatggacgtgcagtccgtcgcgcaacagctgcagatgatgatgcancttgagcgtgccgctgcccgcagcagcagcctgtacgagccagctctgatgcagcagaagcagcagctgctggcagcccaggttctcaaccccatgggcatgatggatgcgcaaaacttgccggccatggntgaatttaacagtaccagttgcccacgttacggaccaacccctgtgtgggttcccgttggcatctccccccatatagggtttttggattttggggaaaacccccctc

SEQ ID NO: 15868 - protein, 188 aa, Zea mays
  misc_feature: Ceres CLONE 1379146-F
  misc_feature (71)..(71): Xaa is any aa, unknown, or other
  misc_feature (109)..(109): Xaa is any aa, unknown, or other
  misc_feature (153)..(153): Xaa is any aa, unknown, or other
MKMVIVLVVCLALSAASASAMQMPCPCAGLQGLYGAGAGLTTMMGAGGLYPYAEYLRQPQCSPLAAAPYYXRCGQPSAMFQPAPAQCCQQQMRMMDVQSVAQQLQMMMXLERAAARSSSLYEPALMQQKQQLLAAQVLNPMGMMDAQNLPAMXEFNSTSCPRYGPTPVWVPVGISPHIGFLDFGENPP

SEQ ID NO: 15869 - DNA, 740 bp, Zea mays
  misc_feature: Ceres CLONE 1379148-F
  misc_feature: Encodes the peptide sequence at SEQ ID NO. 15870
tggagctccccgcggtggcggccgctctagaactagtggatcccccgggctgcaggaattcgcacgagaccattacctagaacatcctaatcgaaaaagtcgaccaggtcctccaccgcaagagacagagaactagagaaagccatagcaagcaaaagcacaggagcgcaagagcccaacaggcgccaagaaagcaccgcccggccggtccgcgccagtatggtgacggcgatcgcggtggcgtcggcggggctcgggatgctggcggccgtcgcgatggccaacaggtcttcgcccgcgtccgcgggcgccgcgctgtgaaggccaggcgggggccccgcgctgcgctggggcggaggcccccgcgctgcaaggcgtgcggcgggtccgccaaggaggactgccgtctcttgcgggggtggtccgacgccggcgcccgcggaaagagattaaccgctccgggtggcggggggtgcgccggaccccgccggaccccgtgccggggttgcggggggtcccggtaccggtcgggggcgggcccgtgggggatcgccatgtccgggggcacccgcaccgaattgggaaggggattgacaccattgaacgtccggccccgcccgacccccaagcccgaaagcggaaggcccccgctccttccccctcccccgggaacccgccggatattccccgggaatttgtggttgaaagggcccgctctcttgttggcgcgacccccatct

SEQ ID NO: 15870 - protein, 33 aa, Zea mays
  misc_feature: Ceres CLONE 1379148-F
MVTAIAVASAGLGMLAAVAMANRSSPASAGAAL

SEQ ID NO: 15871 - DNA, 714 bp, Zea mays
  misc_feature: Ceres CLONE 1379150-F
  misc_feature: Encodes the peptide sequence at SEQ ID NO. 15872
  misc_feature (305)..(305): n is a, c, t, g, unknown, or other
ggagctccccgcggtggcggccgctctagaactagtggatcccccgggctgcaggaattcgcacgagaccattacctagaacatcctaatcgaaaagccgagagcccagcgtcggagatctccgccgccatggagacgctggccagcgccatgcggcgcgagaaccgccggtccaaggccccgccctcctcctctggttcctccgccctcgcctcgggaagggtccctctcgtcatggccttcctctcctgcctcgcctggctctacgtcgccggacgtttgtgccaggacgcgcagacccgggncgatcctgtccgctctcctcgagagagctctaccagcgtcccgaaggtgctctcgacgcaccacaagcttaggggagcttgggtgcaacgcgattgtaatgaaaattcgtgaggcggaaatggacctgaccacggcaagagcgaggggtacctggtggggaacaggactgcagctgtggactccgacagaagcagcagcttcttggcggcattggagttacactgggttgggctcccgtctcaagagaaacgtcttccggggctcctggatgcaagaggtgatgttctgaaaaagcttgaggaaaaggtcgaactcatcctttttgtattgggcgggagtgaaatccaggtgatactttggaccgaatattgaagtagaaaatcggagaacaagcccttcttgattctt

SEQ ID NO: 15872 - protein, 95 aa, Zea mays
  misc_feature: Ceres CLONE 1379150-F
  misc_feature (59)..(59): Xaa is any aa, unknown, or other
METLASAMRRENRRSKAPPSSSGSSALASGRVPLVMAFLSCLAWLYVAGRLCQDAQTRXDPVRSPRESSTSVPKVLSTHHKLRGAWVQRDCNENS

SEQ ID NO: 15873 - DNA, 625 bp, Zea mays
  misc_feature: Ceres CLONE 1379151-F
  misc_feature (325)..(325): n is a, c, t, g, unknown, or other
  misc_feature (339)..(339): n is a, c, t, g, unknown, or other
  misc_feature (364)..(364): n is a, c, t, g, unknown, or other
  misc_feature (374)..(374): n is a, c, t, g, unknown, or other
  misc_feature (508)..(508): n is a, c, t, g, unknown, or other
  misc_feature (557)..(557): n is a, c, t, g, unknown, or other
tccccgcggtggcggccgctctagaactagtggatcccccgggctgcaggaattcgcacgagaccattacctagaacatcctaatcgaaaagtaccatgttcaaaacgaaaagtctgatctgaagccagcagacgtgaaaccgacagcacgtacgtacgtacgtgtgagggctgctcggcggccatgggagaatggtgcttcaagaaacgcgcagctctgggtgattattgtggcattattagctcgctgcagctgctcctgataactgctcaagaagctggaggagaccacgagggtgtggtcgtcgtcatcctcgcccgccgntggtcgtggtggcngcgccgtcgtcctcccaacgcgcgnatgggcccgnacggtctccttcgtgttcgggggaagaggcggtgtgtgtacagagcagcgccaccctctgccaggggatcccggctacccgtgagatcatcacgtctgcgcggaggtgcacgtgtagacgtgacgtctctgcgngacttcgctccaggagctcgcgacccggcaagttcagcgcgtcgcctcnacgactggtcgtaagggcggcgccgcctggacccagggagacgtctccttcagtactccactcttctc

SEQ ID NO: 15874 - DNA, 668 bp, Zea mays
  misc_feature: Ceres CLONE 1379152-F
  misc_feature: Translation starting site: 193
  misc_feature (380)..(380): n is a, c, t, g, unknown, or other
  misc_feature (416)..(416): n is a, c, t, g, unknown, or other
  misc_feature (429)..(429): n is a, c, t, g, unknown, or other
  misc_feature (430)..(430): n is a, c, t, g, unknown, or other
tggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgacccttcgcgggtcgatgctggtgctgtcccggctgatcctggcggncaccgtgatcgcgctcacggtggcacccccgtgctngtgactcgcgggnntttggggggggggggcccccatcgggttggcgctcctgggcggccgggttcgtcacctccgcgggcctcggcgtcgctgcgctggccgtgttcctcctggatgtacaggtacctgacgggcaagcacccgccgggcgccgaccagctgggacacgccagggcgaggctggcgtccaaggcccgcgacatcaaggatgcagcacagcaccgcatcgacaagggggcaggggggcttgaa

SEQ ID NO: 15875 - DNA, 701 bp, Zea mays
  misc_feature: Ceres CLONE 1379154-F
  misc_feature (519)..(519): n is a, c, t, g, unknown, or other
  misc_feature (540)..(540): n is a, c, t, g, unknown, or other
  misc_feature (541)..(541): n is a, c, t, g, unknown, or other
  misc_feature (626)..(626): n is a, c, t, g, unknown, or other
aagctggagctccccgcggtggcggccgctctagaactagtggatcccccgggctgcaggaattcgcacgagaccattacctagaacatcctaatcgaaaaaatcctgtctactactaccatcgccgtccttgtgtttcatttttaatgaccattctctcatctgctgctggctgcggctatatacccccctctctctgtctctctatctcctcctgttcttagacgtttctccagagcctgaagccaaatctagggggcttgcttcatctgctgtccgagcgtggtttggtttctcggggctggcgcggtcaagagctcacctgagttccaccgaaatctgccacggtagttcttgcctaggtgtgtcgttgcgttgtgacccttgcggattttcttgtttcttttgagttgcgatctttgcagggttagtctcccccccatccgtaatcatccggcgtctaagaaattgcagtccagtttgcttatttgttcgtctagtgccttctcccccatctgnttagaaagaatatcggaaggnnggatttttttttttttgcctgtcgtaaagaagcagtgaaacataaattgtgcatctgataggctcgggcgaatacagcaaatccntggaatttgcatcccttgctggctctttctgatcaaagaccaatgggggatgtgtctgaatggacccgtaagcaa

SEQ ID NO: 15876 - DNA, 695 bp, Zea mays
  misc_feature: Ceres CLONE 1379157-F
  misc_feature: Encodes the peptide sequence at SEQ ID NO. 15877
  misc_feature (332)..(332): n is a, c, t, g, unknown, or other
  misc_feature (695)..(695): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctccccgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaagagggcggcgcccgatgggtgagcaggtgaagggcatgctccacgacaagggggcgacggcgtcncaggcgctgacgggggtgaccctgttcccgctgggcgggctgctgctgttgctgtccgggctggcgctgacggcctccgtggggtggtgggccttggccaccccgtgttccttgatcttcagccccggggtcgtccccgcgcggtggtcattgggaaggccggcatggggttccccaccgccggcgcggttggggctccggggccctgtcccccgtcccgggggcctcgcaaaaaagggggggggaagagggttccaaccgcgcccccggaaataatggggagggaggggcaccccccccttatgggggagaggcccccccggcccaacccctgggccccaaaaaaacccgcgcgaggggggn

SEQ ID NO: 15877 - protein, 137 aa, Zea mays
  misc_feature: Ceres CLONE 1379157-F
  misc_feature (44)..(137): Pfam Name: Oleosin Pfam Description: Oleosin
MADRDRSGIYGGAHATYGQQQQQGRGRRPMGEQVKGMLHDKGATASQALTGVTLFPLGGLLLLLSGLALTASVGWWALATPCSLIFSPGVVPARWSLGRPAWGSPPPARLGLRGPVPRPGGLAKKGGGRGFQPRPRK

SEQ ID NO: 15878 - DNA, 711 bp, Zea mays
  misc_feature: Ceres CLONE 1379158-F
  misc_feature: Encodes the peptide sequence at SEQ ID NO. 15879
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (291)..(291): n is a, c, t, g, unknown, or other
  misc_feature (316)..(316): n is a, c, t, g, unknown, or other
  misc_feature (361)..(361): n is a, c, t, g, unknown, or other
  misc_feature (362)..(362): n is a, c, t, g, unknown, or other
  misc_feature (371)..(371): n is a, c, t, g, unknown, or other
  misc_feature (381)..(381): n is a, c, t, g, unknown, or other
  misc_feature (382)..(382): n is a, c, t, g, unknown, or other
  misc_feature (402)..(402): n is a, c, t, g, unknown, or other
  misc_feature (444)..(444): n is a, c, t, g, unknown, or other
  misc_feature (447)..(447): n is a, c, t, g, unknown, or other
  misc_feature (451)..(451): n is a, c, t, g, unknown, or other
  misc_feature (454)..(454): n is a, c, t, g, unknown, or other
  misc_feature (458)..(458): n is a, c, t, g, unknown, or other
  misc_feature (461)..(461): n is a, c, t, g, unknown, or other
  misc_feature (462)..(462): n is a, c, t, g, unknown, or other
  misc_feature (481)..(481): n is a, c, t, g, unknown, or other
  misc_feature (486)..(486): n is a, c, t, g, unknown, or other
  misc_feature (491)..(491): n is a, c, t, g, unknown, or other
  misc_feature (494)..(494): n is a, c, t, g, unknown, or other
  misc_feature (503)..(503): n is a, c, t, g, unknown, or other
  misc_feature (539)..(539): n is a, c, t, g, unknown, or other
  misc_feature (540)..(540): n is a, c, t, g, unknown, or other
  misc_feature (680)..(680): n is a, c, t, g, unknown, or other
caccgcggtggcgggcgctctagaactaatgaatcccccgggctgtgggaattcgcacgagaccattacctagaacatcctaatcggaaaaacacaaacaacaagcttgcattgttccgtttgctctatcgttgcacaaaatggagaaacctgatcccgagtatcgtagtgccccccattgccgcacctgtatcagcgaacttcagcagactcgccttccgcaacctgtacatccgacggacgggtccagacagagggaatggggtgtnnnnnnctggtgaggtaagaagnaaaagctttatgattagacaggggncatgacgggacgtgagtgactttcccccgtctacgatggccgtgnnctccgacgnccgtccctgnntggcttcgcgtgcaggcgtncacaacccacgttcggaaacttccacccagttcttcaccgtncgncttncgnaggncgnncagctcagggctccacctnccttnaccgnaangagtggtgnacggatggattcgatgaatggggcaatctacgcggnnacccgagatttgctattggcgaagagtgtcgtcaaaagaggtactttgccgataggggatgcgcccggacactgacagctcagcatgcagttttttcctgccgggtgtttgcttcatcacgcacccaacagcagactccngcattctgtcccaagattggggtatgggtgg

SEQ ID NO: 15879 - protein, 105 aa, Zea mays
  misc_feature: Ceres CLONE 1379158-F
  misc_feature (90)..(90): Xaa is any aa, unknown, or other
  misc_feature (91)..(91): Xaa is any aa, unknown, or other
  misc_feature (92)..(92): Xaa is any aa, unknown, or other
  misc_feature (97)..(97): Xaa is any aa, unknown, or other
HRGGGRSRTNESPGLWEFARDHYLEHPNRKNTNNKLALFRLLYRCTKWRNLIPSIVVPPIAAPVSANFSRLAFRNLYIRRTGPDRGNGVXXXGEVRXKSFMIRQG

SEQ ID NO: 15880 - DNA, 734 bp, Zea mays
  misc_feature: Ceres CLONE 1379163-F
  misc_feature: Encodes the peptide sequence at SEQ ID NO. 15881
  misc_feature (366)..(366): n is a, c, t, g, unknown, or other
  misc_feature (537)..(537): n is a, c, t, g, unknown, or other
  misc_feature (571)..(571): n is a, c, t, g, unknown, or other
  misc_feature (639)..(639): n is a, c, t, g, unknown, or other
  misc_feature (705)..(705): n is a, c, t, g, unknown, or other
tggagctccccgcggtggcggccgctctagaactagtggatcccccgggctgcaggaattcgcacgagaccattacctagaacatcctaatcgaaaaacgggtcctgtggccactgcctcttgccgcaggcagccctcttctctctcttccgccgtctcgcctcctcacgccattaaaccccacccgcgcgcgcggcggccggcggcgagccctcacccatccgagcaagccgtggaggaagcgagcgcgcgaaagtatcaggaggaggcatgggtaccctggggcgcgcgatcttcacggtgggcaagtggatccggggcacggggcaggccatggaccgcctcggatccaccatccagggcggnctccgcgtcgaggaacaggtttcaaggcatcgtacaatcatgaatatttttgagaaagagccaaggatccatagagatgtgtttgttgctcccagtgcagcagtcattggggatggtgagattggtcatggatcgtcaatctggtacggatccatattgagaggtgatgtncacagcattcatattggatctggtactaatatancagacaattcccttgtacatggttcaaaagctaacattagcggggaaggtcctccccaccataattgnaaagcacgtgacagtgggtcacagtgctgtattacatgcatgtaccattgaggatgaagcttttgntggtatgggtggcactctgcttgatggag

SEQ ID NO: 15881 - protein, 139 aa, Zea mays
  misc_feature: Ceres CLONE 1379163-F
  misc_feature (101)..(101): Xaa is any aa, unknown, or other
  misc_feature (123)..(123): Xaa is any aa, unknown, or other
MGTLGRAIFTVGKWIRGTGQAMDRLGSTIQGGLRVEEQVSRHRTIMNIFEKEPRIHRDVFVAPSAAVIGDGEIGHGSSIWYGSILRGDVHSIHIGSGTNIXDNSLVHGSKANISGEGPPHHNXKARDSGSQCCITCMYH

SEQ ID NO: 15882 - DNA, 738 bp, Zea mays
  misc_feature: Ceres CLONE 1379164-F
  misc_feature: Translation starting site: 193
  misc_feature (495)..(495): n is a, c, t, g, unknown, or other
  misc_feature (499)..(499): n is a, c, t, g, unknown, or other
  misc_feature (597)..(597): n is a, c, t, g, unknown, or other
aagctggagctccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgactcagccgggttggggtgggcccggccgccatcgcgctggcgctcatgggcgggccgggttcgtcacctccggngggnctcggcgtcgctgcggctgtccgtgttcctcctgggatgtacaagtacttgacgggcaagcacccgccgggcgccgaccagctggacacgccaaggcngaggctgggcgtccagggcccgcgacatcaaggatgcagcacagcaccgatcgaccaggggggaaggggcctttgaaaagagaaacccactcgagcggaccgggcggcgcgaactcctttgaccaatggccgggggggggt

SEQ ID NO: 15883 - DNA, 793 bp, Zea mays
  misc_feature: Ceres CLONE 1379166-F
  misc_feature: Encodes the peptide sequence at SEQ ID NO. 15884
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (48)..(48): n is a, c, t, g, unknown, or other
  misc_feature (49)..(49): n is a, c, t, g, unknown, or other
  misc_feature (51)..(51): n is a, c, t, g, unknown, or other
  misc_feature (511)..(511): n is a, c, t, g, unknown, or other
nnnnnnnggggnnnnnnnnggctccctagcccgcgcgccaccctcccnntnaaaagttggggctccccgcggtggcggccgctctagaactagtggatcccccgggctgcaggaattcgcacgagaccattacctagaacatcctaatcgaaaaatcacctataatattttgagcattcagaaacacacctagggaagcgcactagcaacgacctaacaacaatggctaccaagatattatccctccttgcgcttcttgccctttttgtgagcgcaacaaatgtgttcattattccacaatgctcacttggctcccaaggggccattaatttccaaaaggtccctcccccacccggttatactttccaagaggggggcttttcgaaaaaccccccccccccgccgtgggggggacaaaagccccccccgcggggggggggggcttgatacaccacactccgaccgacgtggccgtccttctttggggggggccgcgggggcgggcggttcntccggtgggggggtgttttttttttcaaaaaaaaaaaagaaggggggggggcgggcgcgaataatgaagaaaaaaaaaaagagagcggcgcgggggggggccgcttcctaaaaaaaaaataaaaacacactcccgggggccggcgcgcggcgagcggcacggggacatcggccggtttcttctccccccccaggggggggggtcggcccccccacccacacaggaggggggggggggagcggcggcgcggctgctttttttgtgtgaacgaaaggtcgttgt

SEQ ID NO: 15884 - protein, 74 aa, Zea mays
  misc_feature: Ceres CLONE 1379166-F
MATKILSLLALLALFVSATNVFIIPQCSLGSQGAINFQKVPPPPGYTFQEGGFSKNPPPPPWGGQKPPPRGGGA

SEQ ID NO: 15885 - DNA, 671 bp, Zea mays
  misc_feature: Ceres CLONE 1379167-F
  misc_feature: Encodes the peptide sequence at SEQ ID NO. 15886
  misc_feature (566)..(566): n is a, c, t, g, unknown, or other
  misc_feature (603)..(603): n is a, c, t, g, unknown, or other
  misc_feature (604)..(604): n is a, c, t, g, unknown, or other
  misc_feature (609)..(609): n is a, c, t, g, unknown, or other
tccccgcggtggcggccgctctagaactagtggatcccccgggctgcaggaattcgcacgagaccattacctagaacatcctaatcgaaaactagccaccgcatcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccgggacggtggcgctgcgcgagatccgcaagtaccagaagagcacggagctgctgatccggaagttgcccttccagcgcctggtccgtgagatcgctcaggacttcaagacggatctgcggttccagagccacgccgtcctggccctccaggaagccgccgaggcctacctcgtcggcctgttcgaggacaccaacctctgcgccatcccacgcaagcgcgtcaccatcatgcccaaagacatccagctcgcccgccgcatccgcggngagcgcgcgtaggcgtatctcgcgccccgcccagtgnncgcgnagggatggaggagtgcaatttgtaactttatgctgtttggtcgcttttagacgggcgcgcga

SEQ ID NO: 15886 - protein, 136 aa, Zea mays
  misc_feature: Ceres CLONE 1379167-F
  misc_feature (58)..(132): Pfam Name: Histone Pfam Description: Core histone H2A/H2B/H3/H4
MARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIPRKRVTIMPKDIQLARRIRGERA

SEQ ID NO: 15887 - DNA, 701 bp, Zea mays
  misc_feature: Ceres CLONE 1379168-F
  misc_feature: Encodes the peptide sequence at SEQ ID NO. 15888
  misc_feature (418)..(418): n is a, c, t, g, unknown, or other
  misc_feature (419)..(419): n is a, c, t, g, unknown, or other
tggagctcaccgcggtggcggccgctctagaactagtggatcccccgggctgcaggaattcgcacgagaccattacctagaacatcctaatcgaaaactcggccctccccgcggaataaaagctttttctctggcctcccttcctccgaatccatccatccatccatctattgtctcccttccaattcgatgcctttgtagcgctgctgcctcgccgcgtcgtcgcgggtccccgatttccgcttgctgctgcgcttccaacaccatggacggcgggggatccggcaatgcctccggcggcagcggcggcgcatcgacgtgctgctactacgcgctcctcggcatccgcaagaacgcctccgcaccgacatacgcgccgcttaccggaggctcgcgatgaaagtgcaccccggaccgnntggccagcgaccccggcgcggccggcgaggcaatcagcggttccagcggatccaggaagcatactccggtctgtcgaacaagggaaaagggcatgtacgacgccgggttcctcgaccccctcgacgacgacgacaggatttctccaactcatgcagaagatgctggtgatgatggataacggaaaaacgaaagcccggaacgctggaggacctgcaaaaaagctggagaaatcctgaaaggccaccccggggcggtaacggcccaaggggggggtgcccaaa

SEQ ID NO: 15888 - protein, 44 aa, Zea mays
  misc_feature: Ceres CLONE 1379168-F
MDGGGSGNASGGSGGASTCCYYALLGIRKNASAPTYAPLTGGSR

SEQ ID NO: 15889 - DNA, 707 bp, Zea mays
  misc_feature: Ceres CLONE 1379171-F
  misc_feature: Translation starting site: 202
  misc_feature (492)..(492): n is a, c, t, g, unknown, or other
  misc_feature (521)..(521): n is a, c, t, g, unknown, or other
  misc_feature (577)..(577): n is a, c, t, g, unknown, or other
  misc_feature (707)..(707): n is a, c, t, g, unknown, or other
ggagctccccgcggtggcggccgctctagaactagtggatcccccgggctgcaggaattcgcacgagaccattacctagaacatcctaatcgaaaactctcgcgccgccacttccctcccgacccactatcccaaaaccgtagcgccctcgcctgctcgccgccgccgtcgttgcgaactccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagagttcaacttccccgagaacggcgtcgagctctacgccgagaaggtcgtcaaccgcggcctctgcngcatcgcgcaggctgagtccctccgctancagctcctcggaggccttgcccgtcggaggggctgctatggtgttcttcgctttgntatggagagtgtgccaagggttgtgaggtcattgtgagtggaaagctcagggctcaaagagccaggtcatgaaagtccaggatggctacatgatctcatctggtcagccaggtgatgagtacatcgactn

SEQ ID NO: 15890 - DNA, 674 bp, Zea mays
  misc_feature: Ceres CLONE 1379173-F
  misc_feature: Encodes the peptide sequence at SEQ ID NO. 15891
ggagctccccgcggtggcggccgctctagaactagtggatcccccgggctgcaggaattcgcacgagaccattacctagaacatcctaatcgaaaaagcaagcaattgtcaaccgactctatcttagctctctttgcaagccagtaggtcaccactcaaaagcttgtgaagcaggtgagatgggcaaggaggtggatgtgtccactctagaggccggcggcgtccgtgaccgtgactacgcggaccctccgccggcaccgctgatcgacatcgacgagctcggcaagtggtccctgtaccgcgccgtgatcgccgagttcgtggccacgctgctgttcctgtacatcacggttgccacggtgatcgggtacgagcaccagacggacccgtccgcgtccgggcccgacccggcgtggcaggggcgtgggcatcctggggcatccgcggggcggtccggggaatgatcttcttcctcgtctaatggaccgccggaatcttcggggggccaaatcaacccgggccgtacagttccggcttcttcctggggcgaaaggtccccccgggggccccctctggtggaacatggcccggcaaaagacccccggggctatttggggggggccccgcctcctcaagggcctttccagagcggggtcttacaccgcgcttaaggg

SEQ ID NO: 15891 - protein, 94 aa, Zea mays
  misc_feature: Ceres CLONE 1379173-F
MGKEVDVSTLEAGGVRDRDYADPPPAPLIDIDELGKWSLYRAVIAEFVATLLFLYITVATVIGYEHQTDPSASGPDPAWQGRGHPGASAGRSGE

SEQ ID NO: 15892 - DNA, 621 bp, Zea mays
  misc_feature: Ceres CLONE 1379175-F
  misc_feature: Encodes the peptide sequence at SEQ ID NO. 15893
  misc_feature (277)..(277): n is a, c, t, g, unknown, or other
tccccgcggtggcggccgctctagaactagtggatcccccgggctgcaggaattcgcacgagaccattacctagaacatcctaatcgaaaaactgtctccgcttccgctcccgactcctttgtctcgtcctcatccatccaaccaggcgagccaacaagcaagcaaaagtaaacggggcgaggagctggagagacgccggcgacgcgaagcaaccgcccgatcggagccgcggctgagcaggagggagccggagatggtgggtctcgtcggcggagncacggcgcgggcggagcacgtcgtcgccaacgccggaggggaggcagagtacgtgcgccgcatgcaccgccacgcgccgaccgagcaccagtgcacctccaccctcgtcaagcacatcaaggcgcccgtccacctcgtgtgggagctggtgcggaggttcaaccagccgcagcggtacaagccgttcgtcaggaactgcgtcgtgcgcgggaccagctcgaggtcggcagctgcgcgacgtcacgtcaagacggcctgccggcgacgaccagaccgagcgcctcgagagctcgacgacgactgcacatactcggtggtcagttcgtcggcgggaccacgcctcc

SEQ ID NO: 15893 - protein, 122 aa, Zea mays
  misc_feature: Ceres CLONE 1379175-F
  misc_feature (8)..(8): Xaa is any aa, unknown, or other
MVGLVGGXTARAEHVVANAGGEAEYVRRMHRHAPTEHQCTSTLVKHIKAPVHLVWELVRRFNQPQRYKPFVRNCVVRGTSSRSAAARRHVKTACRRRPDRAPRELDDDCTYSVVSSSAGPRL

SEQ ID NO: 15894 - DNA, 667 bp, Zea mays
  misc_feature: Ceres CLONE 1379176-F
  misc_feature: Encodes the peptide sequence at SEQ ID NO. 15895
  misc_feature (434)..(434): n is a, c, t, g, unknown, or other
  misc_feature (472)..(472): n is a, c, t, g, unknown, or other
  misc_feature (476)..(476): n is a, c, t, g, unknown, or other
ctccccgcggtggcggccgctctagaactagtggatcccccgggctgcaggaattcgcacgagaccattacctagaacatcctaatcgaaaaactgccgcgccgccaccctctacagataaggaagaggaggagggcaggatgtcgcaccgtaagttcgagcacccgaggcacggctccctcggcttccttcccaggaagcgctcctcccgtcaccgcggcaaggtgaagtcattccctagggatgacgccaagaagccttgccatctcactgccttccttggctacaaggctggcatgactcacattgtccgtgaggttgagaagccaggatccaaactccataagaagggaacttgtgaggctgttaccatcattgaaacccctcctcttgtcattgttgggctcgtggcatatgtgaagaactctcgtggnctccgcacactcaactctgtttggggccaacatcttancgangaagtgaggaggaaggtctacaagaactggtgcaagagcaagaagaaggctttcacaaaggatgctctcaaatatgaaaatgatgctggcaagaaggaaatcagctgcagctggagaagaatgagaaatatgctccggttatcccgggcattgctcatacccaaattaggaagatgaagggtttgaagcat

SEQ ID NO: 15895 - protein, 170 aa, Zea mays
  misc_feature: Ceres CLONE 1379176-F
  misc_feature (50)..(170): Pfam Name: Ribosomal_L3 Pfam Description: Ribosomal protein L3
  misc_feature (111)..(111): Xaa is any aa, unknown, or other
  misc_feature (112)..(112): Xaa is any aa, unknown, or other
MSHRKFEHPRHGSLGFLPRKRSSRHRGKVKSFPRDDAKKPCHLTAFLGYKAGMTHIVREVEKPGSKLHKKGTCEAVTIIETPPLVIVGLVAYVKNSRGLRTLNSVWGQHLXXEVRRKVYKNWCKSKKKAFTKDALKYENDAGKKEISCSWRRMRNMLRLSRALLIPKLGR

SEQ ID NO: 15896 - DNA, 693 bp, Zea mays
  misc_feature: Ceres CLONE 1379182-F
  misc_feature: Encodes the peptide sequence at SEQ ID NO. 15897
  misc_feature (408)..(408): n is a, c, t, g, unknown, or other
  misc_feature (415)..(415): n is a, c, t, g, unknown, or other
  misc_feature (499)..(499): n is a, c, t, g, unknown, or other
  misc_feature (500)..(500): n is a, c, t, g, unknown, or other
  misc_feature (579)..(579): n is a, c, t, g, unknown, or other
ggagctccccgcggtggcggccgctctagaactagtggatcccccgggctgcaggaattcgcacgagaccattacctagaacatcctaatcgaatatttttggacaaattaataaggtggggtattacagggggactgatgtttaccacttatttttagctttagtgttcacaaatgtattctttatgagtttttgacatgtgcagcctaatatggaacggctattttcagagtttatagaatcctgtacttggctgttaccattcccacatagcatttcattccgatttaggggctgtagtggttgaattactttcatggacaggcaccaaggacaaacagtgaagttcccagaacatgtctgatgcagtggcagctacagatttcagaaagggacagtggcaattngaaaccnagtggctacaccaacaggcacaactgaagttatcattcctttgcattatataggctttgtctgtggaaacatggcagtgaattnngagaatagagaagatgtcaggtgcttcattacaggtcatgatcctaaagctggcgaccaaactcaaaagtgttatatgncgggatcccgaagaaacaagaggcacagagcctgattcatgcctcatattctgtgggctgatcaacaataatgatgacttgatcctgggcagaccatcgtcgttaatgtcttga

SEQ ID NO: 15897 - protein, 42 aa, Zea mays
  misc_feature: Ceres CLONE 1379182-F
  misc_feature (5)..(5): Xaa is any aa, unknown, or other
  misc_feature (32)..(32): Xaa is any aa, unknown, or other
MAVNXENREDVRCFITGHDPKAGDQTQKCYMXGSRRNKRHRA

SEQ ID NO: 15898 - DNA, 627 bp, Zea mays
  misc_feature: Ceres CLONE 1379183-F
  misc_feature: Translation starting site: 261
ccccgcggtggcggccgctctagaatagtggatcccccgggctgcaggaattcgcacgagaccattacctagaacatcctaatcgaaaaaccacaccaaaacccgcatccataaacaagaaaaagaaaagaaaacccccgctgccagcgacagaagaagaaggggtcccttctccttggttgcgttgcgcctccctcctgtctgcgtgcgtgcaatcgacgcagaggcgcgggcgctcgcaccaccacgacccacgaccgatggctttcatgcgctcccgctcaaatgcatcttctggcatgggaggtgctcctaacattagggagacattcgtcgagcttcaaatgaagaaggcattccgatatggtatcttcaaatcgaagaagagcaaaagcaggtggttgtggagaagacaggggctactactgaaagctatgatgactttttggcctctctcccagagatgactgccgatatgcgcctgatggatttgatttttgtaccgggggagatggggcaaaaagcaagattttcttcatgggctgggccccatcgaactccccgataagggttaagaggttgtactccccggtgaagggaccgattccaagaggagttttggcgggt

SEQ ID NO: 15899 - DNA, 651 bp, Zea mays
  misc_feature: Ceres CLONE 1379184-F
  misc_feature: Pfam Name: GTP_EFTU_D2 Pfam Description: Elongation factor Tu domain 2
  misc_feature (200)..(200): n is a, c, t, g, unknown, or other
  misc_feature (461)..(461): n is a, c, t, g, unknown, or other
  misc_feature (544)..(544): n is a, c, t, g, unknown, or other
  misc_feature (546)..(546): n is a, c, t, g, unknown, or other
  misc_feature (605)..(605): n is a, c, t, g, unknown, or other
tccccgcggtggcggccgctctagaactagtggatcccccgggctgcaggaattcgcacgagaccattacctagaacatcctaatcgaaaaagatcaccgagcccaagagaccttcggacaagcccctgcgtctccccctgcaggatgtgtacaagattggtggtattggaactgtaccggttggtcgtgtggagactgntgtcatcaagcctggtatggttgtcaccttcggtccaattggcctgactactgaggtgaggtctgtgagatgcacccacgaaggccttttttaggggaaggcccctttcccggggggaaaaaggggtggggctttctcccggggggaaaaaaaaactggtttggtggagaaaaaatactcaccaggggggggttttttttggggcccgcccccccaccccggggggggggggccccccccccccgagaggggggggggggngttcttttttttttccccccgcgggcgtttttttttttttaaaaaaaacccccccccccccccgggggggaggagggaggganancaatccccccgggggggggggggggggacccccccccccccatgattttttgggggggngggtgggggggggggaaaaaaaaaaaaaacaaaagagggggggggg

SEQ ID NO: 15900 - DNA, 688 bp, Zea mays
  misc_feature: Ceres CLONE 1379186-F
tccccgcggtggcggccgctctagaatagtggatcccccgggctgcaggaatccgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtaatagagaggtggtgggtggccaacctaccccggggatgtactaactacctgcaggcaagggcggaggattggcaaccttttcatgggtccgggggaacgtgtttccctttccggggctctgcccccaaattttttgctttgccccagttgttgttccctaggggggtcccgtccggaaagaaaaggtgaagggttttccctccccaaaaattcccccggttggcaagggggaagaatctcctccgcaggccccgggccggggaaatcctcaagttggggggccccccaacaaaaccccaaaaggggggtttttttatatttgccaggggcgggccccctcccgggggcggggtttctaaacggggcccccctttaccccccccccccccccccccttcaaattttctgtggggaagagtttggttccctccacgg

SEQ ID NO: 15901 - DNA, 689 bp, Zea mays
  misc_feature: Ceres CLONE 1379192-F
  misc_feature: Encodes the peptide sequence at SEQ ID NO. 15902
ggagctccccgcggtggcggccgctctagaatagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggttggaggccagggtggccctgcagagtgacgatgtcgagctcgtcgccgtgaacgacccctccatcagcaccgactacatgacctacatgttcaggtacgacactgtgcacggacaggtgaagcaacatgaagtcagggggaggactccaaaacccttctctttggtgaaaggaggttctgtgtttgctgcaagaaccctgagaaatcccggggggttcggttggggtgaaaaggtggtaaaaccaatgggggtttccctgacaaaaaaagggtgcccttcctttgaaggggggggccaaaaagatttttcttcttgctcccaaaagggagcccccatggtttggtttggggcaaaaaaaaaagaaaaaaagtcaaaattaaatttgttcccaagggggaggggaaaaaaatgggggtttgttctctttttaatagggacacaaaaaaaaatctcttattttgtg

SEQ ID NO: 15902 - protein, 171 aa, Zea mays
  misc_feature: Ceres CLONE 1379192-F
  misc_feature (4)..(142): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLEARVALQSDDVELVAVNDPSISTDYMTYMFRYDTVHGQVKQHEVRGRTPKPFSLVKGGSVFAARTLRNPGGFGWGEKVVKPMGVSLTKKGCPSFEGGGQKDFSSCSQKGAPMVWFGAKKKEKKSKLNLFPRGRGKKWGFVLFLIGTQKKISYFV

SEQ ID NO: 15903 - DNA, 668 bp, Zea mays
  misc_feature: Ceres CLONE 1379195-F
  misc_feature: Encodes the peptide sequence at SEQ ID NO. 15904
  misc_feature (366)..(366): n is a, c, t, g, unknown, or other
  misc_feature (407)..(407): n is a, c, t, g, unknown, or other
  misc_feature (408)..(408): n is a, c, t, g, unknown, or other
  misc_feature (423)..(423): n is a, c, t, g, unknown, or other
  misc_feature (503)..(503): n is a, c, t, g, unknown, or other
  misc_feature (518)..(518): n is a, c, t, g, unknown, or other
  misc_feature (596)..(596): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgcccgccgcggtccacctgccaccgncggtggatgtgcccgccgcggttcatctgcccgccgcaccnnatgcactacctactncaccgccccggcctcagcctcatccccagccacacccatgcccccgtgcacagccgcatccaagcccgtgccagctgcanggaacctgcggcgtnggcagcaccccgatcctgggccagtgcgtcgagtttctgaggcatcagtgcagcccgacggcgacgccctactgctcngctcagtgccagtcgttgccgcagcagtgttgccagcagctcagggaggtggagcgcagcaccggtaccagg

SEQ ID NO: 15904 - protein, 69 aa, Zea mays
  misc_feature: Ceres CLONE 1379195-F
  misc_feature (15)..(15): Xaa is any aa, unknown, or other
  misc_feature (20)..(20): Xaa is any aa, unknown, or other
  misc_feature (46)..(46): Xaa is any aa, unknown, or other
MPPCTAASKPVPAAXNLRRXQHPDPGPVRRVSEASVQPDGDALLLXSVPVVAAAVLPAAQGGGAQHRYQ

SEQ ID NO: 15905 - DNA, 655 bp, Zea mays
  misc_feature: Ceres CLONE 1379196-F
  misc_feature: Encodes the peptide sequence at SEQ ID NO. 15906
  misc_feature (128)..(128): n is a, c, t, g, unknown, or other
  misc_feature (228)..(228): n is a, c, t, g, unknown, or other
  misc_feature (255)..(255): n is a, c, t, g, unknown, or other
  misc_feature (263)..(263): n is a, c, t, g, unknown, or other
  misc_feature (264)..(264): n is a, c, t, g, unknown, or other
  misc_feature (382)..(382): n is a, c, t, g, unknown, or other
  misc_feature (617)..(617): n is a, c, t, g, unknown, or other
gctctagaactagtggatcccccgggctgcaggaattcgcacgagaccattacctagaacatcctaatcgaaaagtcgtcgtcgtggtggtgcttgcggcagctccggagtccaggcagcacgctagntcggggggcgcgggggaggagatatggatcggtcgtatctccccgtggcggcggcggccgtcgccctggtcctcgtgtgctgctccggcctctgccgcgncgagcggcttcgggcgagggagtgcgnagacctgnngttcaccggcctcgccctctgctccgactgcaacgcgctctccgagttcgtcaaggaccaagagctggtggaggattgccgtaaatgttgcaccgaggattcagatgattctatcagncagctcacattttctgggtgcattattgaggtgtgcatgaggaaactggtattttatccagaaagtgttggcttcctcgaagagataaagacgacttcccatagtgtggaacccgttattcctatggttcgccaccaaagctcataatgctttgacacagggtgaacagaaggagaccataaggattggatactgggagcgagagcacattcggcagtttctcaaggagaaggtngagcagtggaattagacagctggagtcttgcgataggg

SEQ ID NO: 15906 - protein, 125 aa, Zea mays
  misc_feature: Ceres CLONE 1379196-F
  misc_feature (26)..(26): Xaa is any aa, unknown, or other
  misc_feature (35)..(35): Xaa is any aa, unknown, or other
  misc_feature (38)..(38): Xaa is any aa, unknown, or other
  misc_feature (77)..(77): Xaa is any aa, unknown, or other
MDRSYLPVAAAAVALVLVCCSGLCRXERLRARECXDLXFTGLALCSDCNALSEFVKDQELVEDCRKCCTEDSDDSIXQLTFSGCIIEVCMRKLVFYPESVGFLEEIKTTSHSVEPVIPMVRHQSS

SEQ ID NO: 15907 - DNA, 681 bp, Zea mays
  misc_feature: Ceres CLONE 1379197-F
  misc_feature: Encodes the peptide sequence at SEQ ID NO. 15908
  misc_feature (416)..(416): n is a, c, t, g, unknown, or other
  misc_feature (455)..(455): n is a, c, t, g, unknown, or other
ggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgcggcgcgaggacctagtcgagcaggtgaggcacgncgccgggacggtgggcttcttctggctggtgaaccacgncgtggcggaggagctgatgggcgcatgctccgcggggtgcgcagtcacgggggcccccgggggaggggaaacaggcgctctactccagggacctgggtcgcaacctgcgcttcgcctccacttcgacctcttcagggccgctgcggcgactgcgcgaacctctttttggggggaggtggctccaacccgcccccccgggaaggagctgcggagccactgaggacgg

SEQ ID NO: 15908 - protein, 177 aa, Zea mays
  misc_feature: Ceres CLONE 1379197-F
  misc_feature: SWISSPROT Homolog: EC 1.14.11.20 Desacetoxyvindoline 4-hydroxylase
  misc_feature (92)..(92): Xaa is any aa, unknown, or other
  misc_feature (105)..(105): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTRREDLVEQVRHXAGTVGFFWLVNHXVAEELMGACSAGCAVTGAPGGGETGALLQGPGSQPALRLHFDLFRAAAATARTSFWGEVAPTRPPGKELRSH

SEQ ID NO: 15909 - DNA, 671 bp, Zea mays
  misc_feature: Ceres CLONE 1379200-F
  misc_feature: Encodes the peptide sequence at SEQ ID NO. 15910
  misc_feature (224)..(224): n is a, c, t, g, unknown, or other
  misc_feature (290)..(290): n is a, c, t, g, unknown, or other
  misc_feature (383)..(383): n is a, c, t, g, unknown, or other
  misc_feature (453)..(453): n is a, c, t, g, unknown, or other
tccccgcggtggcggccgctctagaactagtggatcccccgggctgcaggaattcgcacgagaccattacctagaacatcctaatcgaaaatcgtctctttgctcgcatctggcctcaagcccctcaggcctcagctcaccaccacgaaccaaccgacagaaagagggacgaatggcgagctctcagtgctgcgataacccgccggccctgaacccggcctgcngggagggcaaggtcgtcgacagcttcggcgggctcaaggcctacgtcgcccggcccgaggactccnagggccgcgtcgtcctcgtcgccgacgtcttcggattcgaagcgccgaatatgaggaagatagccgacaaggttgcttcgtcagggtactttngtggtgtaccagattttgttcatgggggatcttatgcacctggagatggtgaggagccctttcctgtgtngataaagtcacatactccccggaaaagggggttgaggaaacaaaacaaggtattggggctctaaagggagaggggagtgtctgctgttggagctgcagggtattgctggggtgcaaaggttgttgtggagttggcaaaagctcatgagatcagggctgctgggctgtgcacccttcttttgttacggtgacgatatcaaaaagggcagggggcccatt

SEQ ID NO: 15910 - protein, 114 aa, Zea mays
  misc_feature: Ceres CLONE 1379200-F
  misc_feature (18)..(18): Xaa is any aa, unknown, or other
  misc_feature (40)..(40): Xaa is any aa, unknown, or other
  misc_feature (71)..(71): Xaa is any aa, unknown, or other
  misc_feature (94)..(94): Xaa is any aa, unknown, or other
MASSQCCDNPPALNPACXEGKVVDSFGGLKAYVARPEDSXGRVVLVADVFGFEAPNMRKIADKVASSGYFXGVPDFVHGGSYAPGDGEEPFPVXIKSHTPRKRGLRKQNKVLGL

SEQ ID NO: 15911 - DNA, 894 bp, Zea mays
  misc_feature: Ceres CLONE 1379201-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (25)..(25): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
nnnnnnnnnnnnnnnnncccacaancccncgggnnnggcgctnnnnaaaaagtggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaggctggtgttcaatcaaaggttaattaggctccctctacatctgatccagctaagtagctagccagcactacggaagggggggggcaagaatcaggagagagataagagggggggctacctaagtgaagctccgggggacaaaggaatggcccgaaattggcagggaacttggttggcccccggttcgggggggctccaccctcattaatggaacattcatccggcattcgggttttccggggaggttggagaacctggaaacccactttccatgcgggggggggaaaagaaccaatcttaccccccgcggggggggggggcccggagaaaacggggggcccgcgaaccgttttctcaactctttccctggggaggggtttcccggccacccctcctctgggccgccgggcccgggtgggtgggggcgccgcccgcctttcccacagagtttgtgggcggggcgaggtcccaccccacgtggggggccggccgcgtgggcggcccctcccaaagaaggctttggcgccaccaaaaaccgcggccgggtgcgatcgcgcgtctggtggcgccggtggggcataaatgcggggggccttcaccccttttgggcggttgggccccgggaggggggatccccccgctc

SEQ ID NO: 15912 - DNA, 669 bp, Zea mays
  misc_feature: Ceres CLONE 1379203-F
  misc_feature: Encodes the peptide sequence at SEQ ID NO. 15913
  misc_feature (396)..(396): n is a, c, t, g, unknown, or other
  misc_feature (411)..(411): n is a, c, t, g, unknown, or other
  misc_feature (426)..(426): n is a, c, t, g, unknown, or other
  misc_feature (572)..(572): n is a, c, t, g, unknown, or other
tccccgcggtggcggccgctctagaactagtggatcccccgggctgcaggaattcgcacgagaccattacctagaacatcctaatcgaaaaaaagcattaacctttcagaggtaaaagctctcgaacaaagagggtgtaccggcgccaccgccagcacacaccagctcgccggagatcacaagaagatacaggaccgtgctcctcgacgccgcccgacatggcggacgccgcctctggccgcggccacgtcgtctaccctccccgctccgccgaggacatcttcaaggactaccgcgcccgccggtccgccatcctccgcgccctcactcacgaggtcgaggacttctacgcgcagtgcgatccagacaaggagaacctgtgcctgtacggctacncgaaacgagcgtggnaaggtgcgctgccgncagaggaggtgcccacggagctgccggagcctgcgctggggatcaacttcgcgcgcgacgaaatgaaccgccgcgactggcttgcgctcgtcgccgtccactccgactcgtgggtcctctccgtcgccttttactatgccgctcgncttaatcgtaatgaccggaagcgcttatttggtatgattaatgaatggcaaactgttttttgaagttgtctcggtgcgagacacaacatcctaagag

SEQ ID NO: 15913 - protein, 138 aa, Zea mays
  misc_feature: Ceres CLONE 1379203-F
  misc_feature (60)..(60): Xaa is any aa, unknown, or other
  misc_feature (65)..(65): Xaa is any aa, unknown, or other
  misc_feature (70)..(70): Xaa is any aa, unknown, or other
MADAASGRGHVVYPPRSAEDIFKDYRARRSAILRALTHEVEDFYAQCDPDKENLCLYGYXKRAWXGALPXEEVPTELPEPALGINFARDEMNRRDWLALVAVHSDSWVLSVAFYYAARLNRNDRKRLFGMINEWQTVF

SEQ ID NO: 15914 - DNA, 695 bp, Zea mays
  misc_feature: Ceres CLONE 1379207-F
  misc_feature: Translation starting site: 203
  misc_feature (129)..(129): n is a, c, t, g, unknown, or other
  misc_feature (288)..(288): n is a, c, t, g, unknown, or other
  misc_feature (328)..(328): n is a, c, t, g, unknown, or other
  misc_feature (347)..(347): n is a, c, t, g, unknown, or other
tggagctccccgcggtggcggccgctctagaactagtggatcccccgggctgcaggaattcgcacgagaccattacctagaacatcctaatcgaaaaaccacagcatccgcagttccccgaccacaccngttcctccgagcccaggagcagccccgcgccaggaggaagtttgttcttttaacaatatgtcgagggaggagaatgtttacatggccaagttggctgagcaggctgaaaggtatgaggagatggttgagtatatgggagaaagtggctaagactgtagnatgcgaagagctcactgttgaggagcgtaaccttctgtcntgtgcatacaagaatgtgnattgggctcgccgcgcttcatgccccatggttgcgtgcatgggacaaaaggaggagtcccgtaagaacgaggagcatgggaaccttatcagggatatcgtggcaagatcgaggttgaactgaccaatatctgggatgaaatcttgagctggttgactcccacctagggccttcctctacggctgctgaatcaagggctttcaacccaaaaagaggggggactatcccgggtatctttggaaatttaaaatgggtgtcaaaaaaaaaaaatttccttaaaaaacatggggggccctaaaaggcgtgtcaaaaaatttttttggggtgaggggggcccccccccccgcgg

SEQ ID NO: 15915 - DNA, 710 bp, Zea mays
  misc_feature: Ceres CLONE 1379209-F
  misc_feature: Encodes the peptide sequence at SEQ ID NO. 15916
  misc_feature (618)..(618): n is a, c, t, g, unknown, or other
gctcagaactggtggatcccccgggctgcaggaattcgcacgagaccattacctagaacatcctaatcgaaaaaaaatcgaacccaagtcgaaaccctaacctcggccttctcgatgtcggccgccacaaccgccccaacccctgcggtggccaccccgatggcgccgcctccgtcgtacccggcctcctccacgatctccgcctccggtggcgcgtcggtcgaggaagaggacgacctctatgggccgctcaagtcgctccagcgccacatggagttcgtcgagatccaggaggagtacgttaaagacgaacagaagaacctcaagcgcgaacctcctcccgggggagggagaggtcaagggggatccagtcccggacccgctcgtcatcgggccaattttagggagatggccaacggcaaacaacggcatcgtggggttctactacggggcaacaaactactatgggggggaatcctcaggcacccttcaaccgggaggttggttcaagccgtcaagaatctggcccggtttgaatccggcccttcccacggcttttaatccaacgggggtgtcccgcccgaagggccaactcccggatttccctttgtgttgggnaatccgcgggaaaaacccccaaccgttcccccaaaaaaaggatttttgggggggttgccccactctccaaaacgcaaaaaaaaaaagggggg

SEQ ID NO: 15916 - protein, 148 aa, Zea mays
  misc_feature: Ceres CLONE 1379209-F
MSAATTAPTPAVATPMAPPPSYPASSTISASGGASVEEEDDLYGPLKSLQRHMEFVEIQEEYVKDEQKNLKREPPPGGGRGQGGSSPGPARHRANFREMANGKQRHRGVLLRGNKLLWGGILRHPSTGRLVQAVKNLARFESGPSHGF

SEQ ID NO: 15917 - DNA, 648 bp, Zea mays
  misc_feature: Ceres CLONE 1379210-F
  misc_feature: Encodes the peptide sequence at SEQ ID NO. 15918
  misc_feature (350)..(350): n is a, c, t, g, unknown, or other
  misc_feature (630)..(630): n is a, c, t, g, unknown, or other
tggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccgggcggctgtacccctacgcggagtacctgaggcagccgcagtgcagcccgctggcggcggcgccctactacnccccggtgtggcagccgagcgccatgttccagccgctcccggcacagtgctgccagcagcagatgaagatgatggacgtgcagtccgtcgcgcagcagctgcagatgatgatgcagcttgagcgtgccgctgcccgcagcagcagcctgtacgagccagctctgatgcagcagcagcagcagctgctggcagcccagggtctcaccccatgcccatgatgatggcgtaaacatgcgggccatggttgaactctaccagtacagttgcccaggtaccgcancaccccctgtggcgtctc

SEQ ID NO: 15918 - protein, 142 aa, Zea mays
  misc_feature: Ceres CLONE 1379210-F
  misc_feature (71)..(71): Xaa is any aa, unknown, or other
MKMVIVLVVCLALSAASASAMQMPCPCAGLQGLYGAGAGLTTMMGAGRLYPYAEYLRQPQCSPLAAAPYYXPVWQPSAMFQPLPAQCCQQQMKMMDVQSVAQQLQMMMQLERAAARSSSLYEPALMQQQQQLLAAQGLTPCP

SEQ ID NO: 15919 - DNA, 684 bp, Zea mays
  misc_feature: Ceres CLONE 1379212-F
  misc_feature: Encodes the peptide sequence at SEQ ID NO. 15920
  misc_feature (381)..(381): n is a, c, t, g, unknown, or other
ggagctccccgcggtggcggccgctctagaactagtggatcccccgggctgcaggaattcgcacgagaccattacctagaacatcctaatcgaaaagaagcctgtcagtgtcgccgaacacaacaaccaccagcctcgcctgcactcccccacgccggcgtcggcgaccaagatctcgatccccatctcttcgagcgaggcggcgctgttcgggaagggtaggtacaaggtgtgggccctcgcggccatcgcgctcctagcgctctggtccatgttcgccgcctccgtcacgctgcgcttgtcctccgtcgatctcgccaccacgttcggggacgcgagcgatccgctcatcgacgaacttgatcccctggagatggagcnaagagaaaagctagtgcgccggatgtgggatgtgtacacacgcccagataatcatgtacggctaccacggttctggcaagaggcatttgaggctgcatatgaggagcttgctggtgatgatacgcttactactgatgcagctatatctgagattgctcgcatgtcaatccataggcctgaggttgagcaatcgtcgaataggggttaggagatcagaggaacaggacagatatttggaaaggtgggaactggtacccctgaaggggaagaccgtaaaaatgggggccgtcccatctaaagacg

SEQ ID NO: 15920 - protein, 105 aa, Zea mays
  misc_feature: Ceres CLONE 1379212-F
  misc_feature (1)..(106): Pfam Name: DUF1195 Pfam Description: Protein of unknown function (DUF1195)
  misc_feature (37)..(37): Xaa is any aa, unknown, or other
MFAASVTLRLSSVDLATTFGDASDPLIDELDPLEMEXREKLVRRMWDVYTRPDNHVRLPRFWQEAFEAAYEELAGDDTLTTDAAISEIARMSIHRPEVEQSSNRG

SEQ ID NO: 15921 - DNA, 724 bp, Zea mays
  misc_feature: Ceres CLONE 1379214-F
  misc_feature (283)..(283): n is a, c, t, g, unknown, or other
aaagctggagctcaccgcggtggcggccgctctagactagtggatcccccgggctgcaggaattcgcacgagaccattacctagaacatcctagtcgaaaaggacccgaggcgctcaggctccctcctcgttcctcctccctgcaaatcctgcaggcaccaccgctcgttttcctgtccgggggataggagagaaggggagagaccgagagagggtgaggtgcgttgtccgcccgatctgctccgccccccaaagaaacctgtcacgtcgtccctcctctcancaaacaacgaaaaatggttgccggaggcagaatgaccgaaagggagggggaagaaccatgatcaggaggatgtccccccgaggtaaccgccggggggggcggggagggtaacggtccgccgttggaaaaacccccccctccaccgtggggaaagataaaagaaagggattcccgccggattggtttcaagggctccggggtggagggcccttccccgaagggggccccaaaaacttggcgcccggcgcggggggcttcccccaacctcgggggggggccggggaataggggggttaaccctgccccgtatccataaaaggggcctgtgcccgatgtttctgggggggccccacagggtgccttgtgccaccggccctgtggtggtgagaaaccccaacaagagtgtgacccaacacggatctttctccggaaacagggggg

SEQ ID NO: 15922 - DNA, 663 bp, Zea mays
  misc_feature: Ceres CLONE 1379216-F
  misc_feature: Encodes the peptide sequence at SEQ ID NO. 15923
  misc_feature (269)..(269): n is a, c, t, g, unknown, or other
tccccgcggtggcggccgctctagaactagtggatcccccgggctgcaggaattcgcacgagaccattacctagaacatcctaatcgaaaaacagtgcctctcgctcactgactgactactgtaataccagagatcgaacaacttggtcctgcagctcaagaagagagttttgtgcatttgggggccgggggcaagagagaagagagagccatggcggcggacagcagccgcagctgcaggaggagatgaacgacgctgccggcggcgncctcaggctgcctccagggttccgcttccacccgagcgacttcgagattgtcagcttctacctcaccagcaaggtgctcaacacgcgcttcacctgcaccgccatcacggaggccgacctaaacaagattgagccatgggacctcccgagcaggcgaagatgggcgagaaagagtgtacttctttctacagaaggacccgcagtacccgacggggctgagggcgaaacgggcccaccgaggccggttactgggagggcgacgggcagggacaaggagttctaccaccgcgcggaagggggggcggtactggtcggcatgaaaaaaacgctcgtcttctacgggggcaggcctcccaggggtggacaagacaaactggggtcatgcacgaatacg

SEQ ID NO: 15923 - protein, 139 aa, Zea mays
  misc_feature: Ceres CLONE 1379216-F
  misc_feature (11)..(134): Pfam Name: NAM Pfam Description: No apical meristem (NAM) protein
  misc_feature (8)..(8): Xaa is any aa, unknown, or other
MNDAAGGXLRLPPGFRFHPSDFEIVSFYLTSKVLNTRFTCTAITEADLNKIEPWDLPSRRRWARKSVLLSTEGPAVPDGAEGETGPPRPVTGRATGRDKEFYHRAEGGAVLVGMKKTLVFYGGRPPRGGQDKLGSCTNT

SEQ ID NO: 15924 - DNA, 725 bp, Zea mays
  misc_feature: Ceres CLONE 1379218-F
  misc_feature: Encodes the peptide sequence at SEQ ID NO. 15925
  misc_feature (374)..(374): n is a, c, t, g, unknown, or other
  misc_feature (421)..(421): n is a, c, t, g, unknown, or other
  misc_feature (422)..(422): n is a, c, t, g, unknown, or other
  misc_feature (449)..(449): n is a, c, t, g, unknown, or other
  misc_feature (608)..(608): n is a, c, t, g, unknown, or other
  misc_feature (641)..(641): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (664)..(664): n is a, c, t, g, unknown, or other
  misc_feature (665)..(665): n is a, c, t, g, unknown, or other
  misc_feature (670)..(670): n is a, c, t, g, unknown, or other
  misc_feature (674)..(674): n is a, c, t, g, unknown, or other
ggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcaccccttgtcctccnacaatcatcagccctattacagcagttacctttggtgcatttattgnncacaaacatcagggcacaacaactacnacaacttgtgctagcaaaccttgctgcctactctcagcaacagcagtttcttccattcaaccactagctgcattgaactctgcttcttatttgcacacaacaactaccattcagccagctatctgctgcctacccccagcaatttctttcattcaaccnactgacagcattgaactctcctgcttatttacngcagnnnacactactaccattcnngcagntagntggtgtgagccctgctaccttcctgaaacaacacagttggtgcccgtcaac

SEQ ID NO: 15925 - protein, 121 aa, Zea mays
  misc_feature: Ceres CLONE 1379218-F
  misc_feature (75)..(75): Xaa is any aa, unknown, or other
  misc_feature (91)..(91): Xaa is any aa, unknown, or other
  misc_feature (100)..(100): Xaa is any aa, unknown, or other
MAAKIFCLLMLLGLSASAATATIFPQCSQAPIASLLPPYLSPTVSSVCENPILQPYRIQQAIAAGILPLSPLVLXQSSALLQQLPLVHLLXTNIRAQQLXQLVLANLAAYSQQQQFLPFNH

SEQ ID NO: 15926 - DNA, 695 bp, Zea mays
  misc_feature: Ceres CLONE 1379220-F
  misc_feature: Translation starting site: 202
  misc_feature: SWISSPROT Homolog: EC 2.7.1.4 Fructokinase
gctctagaactagtggatcccccgggctgcaggaattcgcacgagaccattacctagaacatcctaatcgaaaaaacaccaccgcagccgcagcacaatcgcctcgccttcccttccccaccagcccccgtctctctctctctctctctgtctctctctcgtagccgcgtccatctcgcagcagcaagcaagcgcgaccaaatggcgcctctaggagacggcggagctgttgccgcggcggcgtccaacaacctggtggtgtcgttcggcgagatgctgatcgacttcgtcccccgacgtggccggtctgtccctggccgagtcgggcggcttcgtcaaggccccccggggggggggcccgccaacgtcgccctgccccatcgccaaggtcggggggctccctcccgccttcctcggaaagttccgggaacgacgaagttcggccacatggttggtgaacatcccggaagcagaacaaagtggaactcgggaggggtggcctggttccaaaaagaacgccggggacgggggtttggcccttcgtggacgcttcaagcaccaaacgggaagccccagagttcatgtttctaaagagaaacccggaacgcgggaaatgcttcgtttaacggaaggcggaaacttgaaaccctgggcccctggggggggcgcccgcccaagggtgttccccactaacg

SEQ ID NO: 15927 - DNA, 685 bp, Zea mays
  misc_feature: Ceres CLONE 1379222-F
  misc_feature: Encodes the peptide sequence at SEQ ID NO. 15928
ccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctataggctcccctttcttccccccatacttccatcatttatagctttcatatgggaaaacccagctcttcaccatataggcttcaacaagcaatcgcagaaggaacatacctttatcgccgtggtggttcaacatccccacccctatctttgggggagctttggaaaaaaccttaggaaaaaaggttggaaattcgggttaccttaaaaaaccagaatttgggaaaccttttccccaattccaaaaaaaaatttttcctttaacaaatggtaaaagggacccggggtgttttttgccaaaaaatttttactttttccgcgtgtgttggggctccttcccaaaaaaaattttttttttttataaaaaatgggcccccaaacccccccctttttttttttggaaaaaaaaaaaactactcttttgcgcggggggggg

SEQ ID NO: 15928 - protein, 44 aa, Zea mays
  misc_feature: Ceres CLONE 1379222-F
MATKIFSLLMLLALSTCVANATIFPQCSQAPIGSPFFPPYFHHL

SEQ ID NO: 15929 - DNA, 725 bp, Zea mays
  misc_feature: Ceres CLONE 1379227-F
  misc_feature: Encodes the peptide sequence at SEQ ID NO. 15930
  misc_feature (454)..(454): n is a, c, t, g, unknown, or other
  misc_feature (552)..(552): n is a, c, t, g, unknown, or other
  misc_feature (587)..(587): n is a, c, t, g, unknown, or other
tggagctccccgcggtggcggccgctctagaactagtggatcccccgggctgcaggaattcgcacgagaccattacctagaacatcctaatcgaaaacttttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatncagcataccctggagatcattcacctgctcaccgatgccaaccccatccaggtcgtcgtcgacgcgatcatcaacagtggcccccgtgaggatgccancccgtatggttcccgctgtgttgtgagaaggcagncccgtgatatctcacccctgaggagggtgaaacagccatctacctcctcacactggtgcccaggagagtgctttcgggacataaaaacattgccgagggcctgcaaatgactgatcaccctgccagggctcatccaaa

SEQ ID NO: 15930 - protein, 168 aa, Zea mays
  misc_feature: Ceres CLONE 1379227-F
  misc_feature (44)..(168): Pfam Name: Ribosomal_S7 Pfam Description: Ribosomal protein S7p/S5e
  misc_feature (88)..(88): Xaa is any aa, unknown, or other
  misc_feature (121)..(121): Xaa is any aa, unknown, or other
  misc_feature (133)..(133): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIXQHTLEIIHLLTDANPIQVVVDAIINSGPREDAXPYGSRCVVRRQXRDISPLRRVKQPSTSSHWCPGECFRDIKTLPRACK

SEQ ID NO: 15931 - DNA, 702 bp, Zea mays
  misc_feature: Ceres CLONE 1379228-F
  misc_feature: Encodes the peptide sequence at SEQ ID NO. 15932
  misc_feature (332)..(332): n is a, c, t, g, unknown, or other
  misc_feature (539)..(539): n is a, c, t, g, unknown, or other
  misc_feature (552)..(552): n is a, c, t, g, unknown, or other
aagctggagctccccgcggtggcggccgctctagaactagtggatcccccgggctgcaggaattcgcacgagaccattacctagaacatcctaatcgaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggttcggtccttcttctcgcgctcccgcagcggcaagcgcggcagcgcccggagagcaggctcgtcctcgccgcactcctccgcggncagcgcgccgccgtccccgtccccactcacgaggaggtcaccgtcgtcgtcgtcaaccacaacccaggacgagacggagcgcgtgttccgcaatgtcgacgcgaacggcgacgggcagatctcgcggtccgagcttggcgcgctgttcgagggcgtgggccacgcggtgacccaaacgagtgccgatgattttgggggagggagggntttttctaaaatnttaaattattaattaaaacgggtcaaaattcccccctgctcatggggaaccgcggccagcccaaccccccccccccgtggaggaaggaccttgtgccccccacttctgggtggttcagaaggccaaagaaaaaaggcctcccccttgccc

SEQ ID NO: 15932 - protein, 108 aa, Zea mays
  misc_feature: Ceres CLONE 1379228-F
  misc_feature (56)..(84): Pfam Name: efhand Pfam Description: EF hand
  misc_feature (32)..(32): Xaa is any aa, unknown, or other
  misc_feature (101)..(101): Xaa is any aa, unknown, or other
  misc_feature (105)..(105): Xaa is any aa, unknown, or other
MGKVRSFFSRSRSGKRGSARRAGSSSPHSSAXSAPPSPSPLTRRSPSSSSTTTQDETERVFRNVDANGDGQISRSELGALFEGVGHAVTQTSADDFGGGRXFSKXLNY

SEQ ID NO: 15933 - DNA, 656 bp, Zea mays
  misc_feature: Ceres CLONE 1379230-R
  misc_feature: SWISSPROT Homolog: EC 1.2.1.12 Glyceraldehyde-3-phosphate dehydrogenase (phosphorylating)
cgattgggtaccgggccccccctcgaggtcgacggtatcgataagcttttttttttttttttttgacagaggcaaaagagtgaactgatttgattaaaagtttcacggcgacacatagacctgacaaaatatgagccattaatgctcaaccaaccactaggatacacccaacatagtttcagacattccgatggaaaaaatttattctcggaagcacttttctcccgggggggaagaagacaactcgctcgtatcaccagaccttgacttgagttcttcatcttagttggtgctgttcatgtggcggatcaggtcgaccacgcgggtgctgtatccccactcgttgtcgtaccaggacacgagcttcacgaagttgccgttcaaggcaatgccagccttagcatcaaagatgctagacctgctgtcaccctggaaatcggtggaaacaaggtcctcctcaacgtaacccaggatgcccttgaggctaccttctgcctcggccttgaccgcagccttgatctcatcataggttgctgacttttcaagcctaacagtcaaatcaacaacagaaacatcgacggttgggacacggaaagacattccagtcaactttcccgtaaggacaggaagcactttgccaacagccttagcagctc

SEQ ID NO: 15934 - DNA, 700 bp, Zea mays
  misc_feature: Ceres CLONE 1379231-F
  misc_feature: Encodes the peptide sequence at SEQ ID NO. 15935
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaatttccactcgtatacaaccacccacctgagccgcacccacgctcaccgtacctcctccgaatccgccgaccgccggcgagcccctcctcctccacgacacgcgcttccccggctatcatggattcagatccatcatcacagaacccaacagatatgactgcatttgtccagaacctccttggacagatgcaaacaaggttcgagtccatgtcgcagaacattgtgtcaaagatagatgaaatgggaaccaagattgatgagctcgagcagagcatcaacgatctcnaagctgagatgggcactgagacgccggtcaagaagcctgacgagccaagcctgctgactctgcctaacttgggtgtacccagagattggtgagtgaagatttgatggatgtgtgacaatttcagcaggacgtggatcctccgatgatcgatctggtttcatgagcctggaaggtatggaaacaccacccatcgtatggagaagaatcataggttgggctctcagacatcaaggatggtcttagcttttctggcatctttcgcaactatttggtgactggtaaagatggatgcacatcacttcatttgaagaa

SEQ ID NO: 15935 - protein, 86 aa, Zea mays
  misc_feature: Ceres CLONE 1379231-F
  misc_feature (10)..(63): Pfam Name: HSBP1 Pfam Description: Heat shock factor binding protein 1
  misc_feature (57)..(57): Xaa is any aa, unknown, or other
MDSDPSSQNPTDMTAFVQNLLGQMQTRFESMSQNIVSKIDEMGTKIDELEQSINDLXAEMGTETPVKKPDEPSLLTLPNLGVPRDW

SEQ ID NO: 15936 - DNA, 728 bp, Zea mays
  misc_feature: Ceres CLONE 1379233-F
  misc_feature (361)..(361): n is a, c, t, g, unknown, or other
  misc_feature (393)..(393): n is a, c, t, g, unknown, or other
ccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcacccctacaggatccaacaggcaatcgcagcaggcatcttacctttatcacccttgntcctccaacaccgtcagccctattacagcagntacttttggggcattttgttgcaacaaaacatcaggcccacaactacaacactttgggctaggaaactttttggctacctccaaaaaaaggaagtttcttccttcaaccaaatggctggatggaaaccggctgcttatttggaaaaaaaactacctttagggcggtttggggggcccaccccccagattttttttccttttaaccactggggaaaattaaaaccctggtgtttttttaaaaagagagaggtcccccctttttccccctttttttgttggggccccttttttttcttaaaaaaaaaaaaagggttggccccccccccccccccccc

SEQ ID NO: 15937 - DNA, 906 bp, Zea mays
  misc_feature: Ceres CLONE 1379234-F
  misc_feature: Pfam Name: GATA-N Pfam Description: GATA-type transcription activator, N-terminal
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (27)..(27): n is a, c, t, g, unknown, or other
  misc_feature (33)..(33): n is a, c, t, g, unknown, or other
  misc_feature (35)..(35): n is a, c, t, g, unknown, or other
  misc_feature (36)..(36): n is a, c, t, g, unknown, or other
nnnnnnnnnnnttttnnnnaagcgggnggcggnanncaccaccaatcaaggtggagctccccgcggtggcggccgctctagactagtggatcccccgggctgcaggaattcgcacgagaccattacctagaacatcctaatcgaaaaccttcgcattaatggccgctctctccctatcccctttcgtctcgctctcggagtaggacactcgcccgcttccgggttaaccttcaagattctccctcctcctcctacttcttcccgcttgggcgggcgcggcacccttccggttctgggcctcctatatatatacgcgcgggaccgtccccccttccatactcccctagcatggcttccggctcgcaccccgggatggatcgaggttcgccccgtcgccgcgaggggaattcgggggcctttccccctcccctcctttcttaacccggggcccaaccggctggttccccgggctccctggctcggcccgcttttgaacccccccttgggggaaggggcgggggcgccgaggacaccccccgcccgcccaccccgggggggggacccggcccggagttgggggagcccttccgggggggcgcgcggggtcccaccctggggcgtgcttttcccgcgcggggcggggggggggttcacattgcgggccgggaaaagactctccaggtggggagggcgcttcccggtgggggggaagggccctcaccagaaaaagcggggaccttgtgttcccccggggagcggctcgggggctcccgcaaccagggtcctctgcgggaacgcaaagcccttttcctccccgtgtgggaggcgggtgttggaggtgtccttgagattcgaagaagtattgggggggggcgcacccccacttttccggcggcaagaaagacg

SEQ ID NO: 15938 - DNA, 725 bp, Zea mays
  misc_feature: Ceres CLONE 1379238-F
  misc_feature: Encodes the peptide sequence at SEQ ID NO. 15939
  misc_feature (219)..(219): n is a, c, t, g, unknown, or other
  misc_feature (330)..(330): n is a, c, t, g, unknown, or other
ggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacnacctgctgcaacaaacccccgatgtcgtccaccagttctacagcgaaagcagcaccatgggtccgcgtcgacgacctcaccggcacgaccgcggctgggcacacatgatgnacatacactcactcatcatgtctttgaacttcacccaaattgagaatcagactggccattttgggacttcatgggcgatggggggtagttaagggctcgggccaaggcaaacaaggggtacgcccccaagggatttttcccaagggttcttcttgcccccaaaaaagggtactttgccccaaagaatatttcacttcttagaaaaaaaaatggccccccggcccgggtttcccaagaaaaaaaaaaaaaatttggcccccacaaaggtgggagcaccccctggtggtcttccccgagaaaaaacccccaaaacccccggggagggttggggggggaaaatatattttttttgcgcacacaaaataggggggcccaaagtgggggagaaccccccc

SEQ ID NO: 15939 - protein, 86 aa, Zea mays
  misc_feature: Ceres CLONE 1379238-F
  misc_feature (20)..(20): Xaa is any aa, unknown, or other
  misc_feature (57)..(57): Xaa is any aa, unknown, or other
MASAAAATQVGTYFLRNYYXLLQQTPDVVHQFYSESSTMGPRRRPHRHDRGWAHMMXIHSLIMSLNFTQIENQTGHFGTSWAMGGS

SEQ ID NO: 15940 - DNA, 738 bp, Zea mays
  misc_feature: Ceres CLONE 1379242-F
  misc_feature: Encodes the peptide sequence at SEQ ID NO. 15941
  misc_feature (300)..(300): n is a, c, t, g, unknown, or other
  misc_feature (337)..(337): n is a, c, t, g, unknown, or other
ggagctccccgcggtggcggccgctctagaactagtggatcccccgggctgcaggaattcgcacgagaccattacctagaacatcctaatcgaaaaaggagcttcatccaacagcccaagtgtccctgctacccccactggatcagcaagctagctacccagtggagagccacagccgaagccgaagccgaagctagagctagcaagcaatggctgcggcggctcctcctgcgcgtcctactagcagcatcagcagctgctgctgctgcatctcgcggcgcgccgccgccgtcgtgccgncgctgctgctgctggcgacgatggccgcctcctcggnagacgcgcagccttccccggggtactacccgagctccaggttcaggccgggtgccgtcaaccgggcgtacaccaacaagtgggggccgcagaaccagacgctctccggagaccattccgccctcaccatctggatcgacaagacctgcgggagtggttccaagtcgaagcacgcgtaaaggaacggctacttctccactcgaatcaagctccccgccggaaaacaccgcggcacccaacaccgtctttctattctctcaaaaaaggaggcgcaccctgggttcccacgacgagaatcgaaggggagttcccggggcaccatcccggggggagcccctacacgctggaagaacaaggtggtacgggccgcggcagcggcaaacgggcgcattcgggggggga

SEQ ID NO: 15941 - protein, 101 aa, Zea mays
  misc_feature: Ceres CLONE 1379242-F
  misc_feature (31)..(31): Xaa is any aa, unknown, or other
  misc_feature (43)..(43): Xaa is any aa, unknown, or other
MAAAAPPARPTSSISSCCCCISRRAAAVVPXLLLLATMAASSXDAQPSPGYYPSSRFRPGAVNRAYTNKWGPQNQTLSGDHSALTIWIDKTCGSGSKSKHA

SEQ ID NO: 15942 - DNA, 715 bp, Zea mays
  misc_feature: Ceres CLONE 1379247-F
  misc_feature: Encodes the peptide sequence at SEQ ID NO. 15943
  misc_feature (497)..(497): n is a, c, t, g, unknown, or other
  misc_feature (568)..(568): n is a, c, t, g, unknown, or other
  misc_feature (577)..(577): n is a, c, t, g, unknown, or other
  misc_feature (634)..(634): n is a, c, t, g, unknown, or other
  misc_feature (645)..(645): n is a, c, t, g, unknown, or other
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaaatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtggccgaccctgatgctgcagcaactgttggcctcaccgcttcagccgtgccagatgccaatgatgatgccaggtatgatgccaccgatgacaatgatgccgatgccgaatatgatgccatcgatgatggtgccgactatgatgtcaccaatacgatagctagtatgatgccaccgatgatgatgccnaacatggtttcaccatgatgatgccgagtatgatgccttcgacgatgacgccgagtatgatgccaccgatnatgatgccnagtatgataccaccgatgatgatgccccagcatggtgtcattcatgataatgccaancatgatgacangtgcacnatggtactctgatttcctctcgcacatatacaacacacattttacatttctgtcagcccacac

SEQ ID NO: 15943 - protein, 108 aa, Zea mays
  misc_feature: Ceres CLONE 1379247-F
MAAKMFALFALLALCATATSATHIPGHLSPLLMPLATMNPWMQYCMKQQGVANLLAWPTLMLQQLLASPLQPCQMPMMMPGMMPPMTMMPMPNMMPSMMVPTMMSPIR

SEQ ID NO: 15944 - DNA, 749 bp, Zea mays
  misc_feature: Ceres CLONE 1379248-F
  misc_feature: Encodes the peptide sequence at SEQ ID NO. 15945
  misc_feature (190)..(190): n is a, c, t, g, unknown, or other
  misc_feature (245)..(245): n is a, c, t, g, unknown, or other
  misc_feature (248)..(248): n is a, c, t, g, unknown, or other
  misc_feature (274)..(274): n is a, c, t, g, unknown, or other
aaagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccacccgctcccgcngcgtctcccgaatcacctcccgcgggagggtcgtgcccgtggccctcgcactggncgnacgcggaaggctggtggcgcgtgcancagttacggcaaagggcgatgtacatcgagcaccgtcgacgggcatgaggtcttgctgttggaactcttcgggaggcctggatggaaaaaagggaattaatcccacgggggggggatttgggggaaaggttgccaattaacgggggccttaaaggggaaaaaaggttgggtgaaacgttggaaacccttcgggttgggaccccctttgggggaaacccctttagggggtgggggttgggggaaaaaaaaggggggagcccccccccaaaggagaaaaaaaggattttcgccctttggtaaaaaaaaaaaaaaaaggggggggggtggtttaaaacaccgggggggagaaaaaacactttttgtggggcgcccccggggggggggtttctctttttgagaaaaaacaccccccgggggggggtttttttcccccccccccggggggggggggggcgcgcccccccacaaagagagt

SEQ ID NO: 15945 - protein, 91 aa, Zea mays
  misc_feature: Ceres CLONE 1379248-F
  misc_feature (18)..(18): Xaa is any aa, unknown, or other
  misc_feature (36)..(36): Xaa is any aa, unknown, or other
  misc_feature (37)..(37): Xaa is any aa, unknown, or other
  misc_feature (46)..(46): Xaa is any aa, unknown, or other
MATAFSLRAAAPATRSRXVSRITSRGRVVPVALALXXRGRLVARAXVTAKGDVHRAPSTGMRSCCWNSSGGLDGKKGINPTGGGFGGKVAN

SEQ ID NO: 15946 - DNA, 749 bp, Zea mays
  misc_feature: Ceres CLONE 1379249-F
  misc_feature: Translation starting site: 169
  misc_feature (287)..(287): n is a, c, t, g, unknown, or other
  misc_feature (295)..(295): n is a, c, t, g, unknown, or other
  misc_feature (296)..(296): n is a, c, t, g, unknown, or other
  misc_feature (307)..(307): n is a, c, t, g, unknown, or other
  misc_feature (319)..(319): n is a, c, t, g, unknown, or other
tccccgcggtggcggccgctctagaactagtggatcccccgggctgcaggaattcgcacgagaccattacctagaacatcctaatcgaaaactagcttgccgcgccgcctggatcgagcagccgagcgactaagcgaagactcccttttccccgagcacaagagaaccatggcggcggcggcagtatacggcggcttcaaggggaagcttggcgtcgaggatgcccccgagctgcagctcaaccgcatccgcatcacactctcatccaagaaacgtcagaacttggnagaagttnngtgcggattgntaaagggagccnagggacagcatttgaggggtagggacctgtcaggatccctactaagggtctcacatcaccactcgcaagtcccctggcgtgaaggacaaacacatgggatcgggttggagtcccgcatccccagaggggggatgacctaatccgctcccctgatgggtggaacaaatcccctcccccacattgaaccccgggttgaaggtaaggggccctttccccacgtgtaaggaacgaaattctccaaagggcctccaaatttttttctttggggccccgggggggcccaaaaaaaaatttggggttttttttaaaaaaaaaattttcccccccaataatttgggggaagggggtgggagaattagggccgcaacatgaaaattttgaccaaaactctttggggggggaaaaaaagtgtggccccaccccggtgggg

SEQ ID NO: 15947 - DNA, 799 bp, Zea mays
  misc_feature: Ceres CLONE 1379250-F
  misc_feature (316)..(316): n is a, c, t, g, unknown, or other
  misc_feature (344)..(344): n is a, c, t, g, unknown, or other
  misc_feature (391)..(391): n is a, c, t, g, unknown, or other
  misc_feature (408)..(408): n is a, c, t, g, unknown, or other
  misc_feature (421)..(421): n is a, c, t, g, unknown, or other
  misc_feature (447)..(447): n is a, c, t, g, unknown, or other
  misc_feature (465)..(465): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (510)..(510): n is a, c, t, g, unknown, or other
  misc_feature (511)..(511): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (540)..(540): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (552)..(552): n is a, c, t, g, unknown, or other
  misc_feature (580)..(580): n is a, c, t, g, unknown, or other
  misc_feature (618)..(618): n is a, c, t, g, unknown, or other
  misc_feature (619)..(619): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (659)..(659): n is a, c, t, g, unknown, or other
  misc_feature (692)..(692): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
ggagctccccgcggtggggggcggttcagaactagtggatcccccgggctgccggagtgcggattcgaccattacttaccacaactcctatcgaaaatatgactctctccctagtccctacacttttctcccccgtgtcccgttgctaaaagcttagagaaaaacctaatcggacagcactgtggccaagcagggcgcgggagatcgtacgccggcggcgaggtcctgcggtggcgggcctcggcagagtggtggtgctagcacgagtgcagctgttgggttggtgggtaagagtgagaaggacatgaaaggcgtntgcggggatccagcaccctcgtcctcgncccgacgccgcgtcccttcccctccgtcctttcatcgtgagttccanccgcccgtcgctctcgnccgccgccgcgtncctcgtcctcgtctcctccttcgcangggtgcgcttgagccggngnnnttgtnnnnggtnnnnnnnngttgcgtggccgctcgcttctnncctnnnnngccgcgtcttctcgcgaattngnnnnaaaaaanggggggtgtctaaaaatctcatgggggncccccgaaggaaaagaaacgagcacttctcggaaaaannggggggnnnnaaaaagtttgttttcagcaatgggaacctncgtggagggggggggggaaagagttttttccangaaaaagtttccccaaggggtggcattgagcagacttttnnnngggggggggagtttggccctttcccactagggggggccctttggatttgaaataaccccgggaa

SEQ ID NO: 15948 - DNA, 697 bp, Zea mays
  misc_feature: Ceres CLONE 1379254-F
  misc_feature: Encodes the peptide sequence at SEQ ID NO. 15949
  misc_feature (207)..(207): n is a, c, t, g, unknown, or other
  misc_feature (302)..(302): n is a, c, t, g, unknown, or other
  misc_feature (361)..(361): n is a, c, t, g, unknown, or other
  misc_feature (661)..(661): n is a, c, t, g, unknown, or other
  misc_feature (662)..(662): n is a, c, t, g, unknown, or other
tccccgcggtggcggccgctctagaactagtggatcccccgggctgcaggaattcgcacgagaccattacctagaacatcctaatcgaaaaatcacagctagctagcatacagacgaataatctcttcttcacctcactaacaccagctagcaactctttctctcctgcaataatggccgctcgctcctcctcctcccagccgcagntggtcgcggcggcggcggtcctggcagcgacgctgctgctgctgacgacgagggcccggaacggcgtcgcggcggtgatctgcggcgatgtgacntcgtcggtggcgcccgtgctcggttacgcgatgggcagcgcggcgtccccctccgcggngtgctgcagcggggtgcgctccctcaaaagccgggggtcgtcaacgggggacggaaggccacctgcactggctaagagcatgacgggccggttcagttggggcgtcaaatgggcaacgccgccacatcccctcaagtgcggggtctccgtggggatgccatcagcccaccgtcgaatggaccaggaaaaatggatgatggaaccataggggaagtgactcgctcgtggatggaagggaactgggcataacattatgaagccgcggctgaaaaaaaatggccaagattggggggggggctnngggttcaacggggaccttataaaaaagtgagcccc

SEQ ID NO: 15949 - protein, 131 aa, Zea mays
  misc_feature: Ceres CLONE 1379254-F
  misc_feature (12)..(12): Xaa is any aa, unknown, or other
  misc_feature (63)..(63): Xaa is any aa, unknown, or other
MAARSSSSQPQXVAAAAVLAATLLLLTTRARNGVAAVICGDVTSSVAPVLGYAMGSAASPSAXCCSGVRSLKSRGSSTGDGRPPALAKSMTGRFSWGVKWATPPHPLKCGVSVGMPSAHRRMDQEKWMMEP

SEQ ID NO: 15950 - DNA, 724 bp, Zea mays
  misc_feature: Ceres CLONE 1379255-F
  misc_feature: Encodes the peptide sequence at SEQ ID NO. 15951
  misc_feature (605)..(605): n is a, c, t, g, unknown, or other
  misc_feature (710)..(710): n is a, c, t, g, unknown, or other
acccgcggtggcggccgctctagaactagtggatcccccgggctgcaggaattcgcacgagaccattacctagaacatcctaatcgaaaactctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggccgcgccccacctccgccctctcctcctccagggggatcggatacgccacaggctgcgcgatggtgctgtgggtcttcggctacggctccctcatctggaaccccggcttcgacttcgacgacaaaatcctcggcttcatcaggggctacaagcgcacctttaatctcgcttgcattgaccacagaggcacaccggagcatccggcgaggacctgcacgcttggaaccgacgacgaggccatatgctggggaattgcatattgtgtcaagggtggtccagaaaagagctaaaagcaatacagtacttggagagaagagagtgtgagtacgaccagaaaatatccattgatttctacnaggaaagagatcccttgaaaaccagctgtgacggcgtctttagtgttccgttccactccagattcaattgggcacaagtactatcttggccctgctcctctgcangatatggcaaggca

SEQ ID NO: 15951 - protein, 76 aa, Zea mays
  misc_feature: Ceres CLONE 1379255-F
  misc_feature (3)..(76): Pfam Name: ChaC Pfam Description: ChaC-like protein
MVLWVFGYGSLIWNPGFDFDDKILGFIRGYKRTFNLACIDHRGTPEHPARTCTLGTDDEAICWGIAYCVKGGPEKS

SEQ ID NO: 15952 - DNA, 708 bp, Zea mays
  misc_feature: Ceres CLONE 1379260-F
  misc_feature: Encodes the peptide sequence at SEQ ID NO. 15953
  misc_feature (381)..(381): n is a, c, t, g, unknown, or other
  misc_feature (502)..(502): n is a, c, t, g, unknown, or other
  misc_feature (527)..(527): n is a, c, t, g, unknown, or other
  misc_feature (570)..(570): n is a, c, t, g, unknown, or other
  misc_feature (576)..(576): n is a, c, t, g, unknown, or other
  misc_feature (581)..(581): n is a, c, t, g, unknown, or other
  misc_feature (648)..(648): n is a, c, t, g, unknown, or other
  misc_feature (655)..(655): n is a, c, t, g, unknown, or other
tggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacnacatccagaaggagtcaaccctccacttggtgctgcgccttaggggaggcatgcagatctttgtcaagaccttgactggcaaacaatcacccttgaggtggagtcctcagacaccattgancatgtcaaggcaaagatccaggacnaggagggcatcccacctgggacagcacgtctcatctttgccgncaagcnagtgnaggatgggaggacccttgctgactacacatccagaagagagcaccctccacttgtgctgcgccttangggtggnatgcagatcttggggaaaaccttactggcagactcccctcttgggaggggagt

SEQ ID NO: 15953 - protein, 168 aa, Zea mays
  misc_feature: Ceres CLONE 1379260-F
  misc_feature (6)..(74): Pfam Name: ubiquitin Pfam Description: Ubiquitin family
  misc_feature (60)..(60): Xaa is any aa, unknown, or other
  misc_feature (100)..(100): Xaa is any aa, unknown, or other
  misc_feature (123)..(123): Xaa is any aa, unknown, or other
  misc_feature (125)..(125): Xaa is any aa, unknown, or other
  misc_feature (126)..(126): Xaa is any aa, unknown, or other
  misc_feature (149)..(149): Xaa is any aa, unknown, or other
  misc_feature (151)..(151): Xaa is any aa, unknown, or other
MQIFVKTLTGKTITLEVESSDTIDNVKAKIQDKEGIPPDQQRLIFAGKQLEDGRTLADYXIQKESTLHLVLRLRGGMQIFVKTLTGKQSPLRWSPQTPLXMSRQRSRTRRASHLGQHVSSLPXSXXRMGGPLLTTHPEESTLHLCCALXVXCRSWGKPYWQTPLLGGE

SEQ ID NO: 15954 - DNA, 715 bp, Zea mays
  misc_feature: Ceres CLONE 1379262-F
  misc_feature: Encodes the peptide sequence at SEQ ID NO. 15955
  misc_feature (180)..(180): n is a, c, t, g, unknown, or other
  misc_feature (251)..(251): n is a, c, t, g, unknown, or other
  misc_feature (259)..(259): n is a, c, t, g, unknown, or other
  misc_feature (260)..(260): n is a, c, t, g, unknown, or other
  misc_feature (325)..(325): n is a, c, t, g, unknown, or other
  misc_feature (386)..(386): n is a, c, t, g, unknown, or other
  misc_feature (484)..(484): n is a, c, t, g, unknown, or other
ccccgcggtggcggccgctctagaactagtggatcccccgggctgcaggaattcgcacgagaccattacctagaacatcctaatcgaaaactgtccgcgccaccgctcctcgacccccgcccaacactcccagccgtcacgccgtcgccgccgcgagtccttcattcaccatgatcatcntccagaagaaccgccgcgagatctgcaagtacatcttccatgagggggttctatatgccaagaaagactancacctggnncagcaccccaagcttgacgtgcccaacctggaggtgattaagctcatgcagagcttcaagtccanggagtatgtcagggagaccttctcctggcagtactactactggtaccctcacaacgatggnattgagcacctccgcagcttcctcaaccctgcgtcagaggttgtgcccaacacccctcagaaagtctccaagcccccgtcccgtcccttttgctctgncccaccgggtgaccgccccaggggtcccccctcgcttttgggaagacagaacttaggtttgggaatagggatgtttacagaggaggccacggaggtgcatgggttggattttgggggggaaaaaggggtatggctccttggcgatttccagccttcttttaaggggtaacaaacttgggtttgggccggggtgccggcaagcgtttttggggccagtggatccttccaggg

SEQ ID NO: 15955 - protein, 160 aa, Zea mays
  misc_feature: Ceres CLONE 1379262-F
  misc_feature (3)..(98): Pfam Name: S10_plectin Pfam Description: Plectin/S10 domain
  misc_feature (4)..(4): Xaa is any aa, unknown, or other
  misc_feature (27)..(27): Xaa is any aa, unknown, or other
  misc_feature (30)..(30): Xaa is any aa, unknown, or other
  misc_feature (52)..(52): Xaa is any aa, unknown, or other
  misc_feature (105)..(105): Xaa is any aa, unknown, or other
MIIXQKNRREICKYIFHEGVLYAKKDXHLXQHPKLDVPNLEVIKLMQSFKSXEYVRETFSWQYYYWYPHNDGIEHLRSFLNPASEVVPNTPQKVSKPPSRPFCSXPPGDRPRGPPSLLGRQNLGLGIGMFTEEATEVHGLDFGGEKGVWLLGDFQPSFKG

SEQ ID NO: 15956 - DNA, 725 bp, Zea mays
  misc_feature: Ceres CLONE 1379263-F
  misc_feature: Translation starting site: 254
  misc_feature (628)..(628): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccaccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccaattgggtgagggctccgctggtcaggtcacaaggaacatgcttgcaaatggagggtgtccgttctttctacaagggtttgtctgccggattgctgaggcaagcgacgtacacgactgctcgtcttggatccctttaggggtctaactaaacaagcagttgaaaagaatgaagggagccattgcctctattcagaaagcttttattggtctgatgtgnnagcattggtgctttggttttggaaaccccggctgatctggcactcattaaaatgaagccgactccaccctgccagctgcacacgacgaaactaata

SEQ ID NO: 15957 - DNA, 712 bp, Zea mays
  misc_feature: Ceres CLONE 1379264-F
  misc_feature: Encodes the peptide sequence at SEQ ID NO. 15958
  misc_feature (286)..(286): n is a, c, t, g, unknown, or other
  misc_feature (295)..(295): n is a, c, t, g, unknown, or other
  misc_feature (414)..(414): n is a, c, t, g, unknown, or other
ggagctccccgcggtggcggccgctctagaatagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggagaagatgagggagtgcatctccgtcccacatcggcaggncggcatccnaagtcggcacgcgtgctgggaactttactggctcgagcacggcatccagcctgatgggcaagtgcctggagataagaccgcgggacatcacgatgatgccttcagcacccttcttcagncaagaatggggctgggaagcacggtccccggggcatacttcgttgatttaaaccccacgtgggatccatggggtgggcaaattggaacgaaaccgccggttctttccaccctggaaaagtctctccagggggaaggggggaggcccgctaaaaattttcggccgggggccctaaaacaatttgggaaagggaatttggtaaatttggggccctttacccaaatccccgaaggtttggggaaaaatgggcccgggccccccggggggtttccgggggttttaaaagggggggggggggt

SEQ ID NO: 15958 - protein, 153 aa, Zea mays
  misc_feature: Ceres CLONE 1379264-F
  misc_feature (12)..(12): Xaa is any aa, unknown, or other
  misc_feature (15)..(15): Xaa is any aa, unknown, or other
  misc_feature (55)..(55): Xaa is any aa, unknown, or other
MRECISVPHRQXGIXSRHACWELYWLEHGIQPDGQVPGDKTAGHHDDAFSTLLQXRMGLGSTVPGAYFVDLNPTWDPWGGQIGTKPPVLSTLEKSLQGEGGRPAKNFRPGALKQFGKGNLVNLGPFTQIPEGLGKNGPGPPGGFPGVLKGGGG

SEQ ID NO: 15959 - DNA, 733 bp, Zea mays
  misc_feature: Ceres CLONE 1379265-F
  misc_feature: Encodes the peptide sequence at SEQ ID NO. 15960
  misc_feature (424)..(424): n is a, c, t, g, unknown, or other
  misc_feature (605)..(605): n is a, c, t, g, unknown, or other
  misc_feature (665)..(665): n is a, c, t, g, unknown, or other
tccccgcggtggcggccgctctagaactagtggatcccccgggctgcaggaattcgcacgagaccattacctagaacatcctaatcgaaaaacgagactgcgccgccgttgccgtctcctcctccgtcccatcactctctgctcgcgcactctcacctgcccgcgccgtcttcgaccgccaccaagatgaacaaggagaggctcatgaagatggccggcgccgtccgcaccggcggcaagggcaccatgcgcaggaagaagaaggctgtacacaagacggtcaccacggacgacaagaggctgcagggcactctcaagagagtaggggtcaacaccatccctgcaatcgaggaggtgaacatattcaaggacgatctcgtcatccagttcttgaaccccaaagtgcaagcttccatcgcagcanacacatgggtggtcagtggatctccacagacgaaaaagctacaggatgttctccctgggatcattaaccagcttggccctgacaacatggagcacctgaagaggattgccgaggagatgcaaaagcaggtggctgctgccggtgcggcagcacaggtcaaggaaagacacgatgacgatgntccagagcttggtcctggagagacttttgaaagagtagctcaggagacaaaagcctgatncatagctctaaaatagtgaaatgtactgcaccaatgtgtgaaggtcatggttttcgtgtgatggcacc

SEQ ID NO: 15960 - protein, 158 aa, Zea mays
  misc_feature: Ceres CLONE 1379265-F
  misc_feature (34)..(92): Pfam Name: NAC Pfam Description: NAC domain
  misc_feature: The sequence is a functional homolog of SEQ ID NO 1614 in the 11/479,226 US patent application
  misc_feature: The sequence is a functional homolog of SEQ ID NO 784 in the 10/412,699 US patent application
  misc_feature: The sequence is a functional homolog of SEQ ID NO 1617 in the 11/479,226 US patent application
  misc_feature: The sequence is a functional homolog of SEQ ID NO 786 in the 10/412,699 US patent application
  misc_feature (80)..(80): Xaa is any aa, unknown, or other
  misc_feature (140)..(140): Xaa is any aa, unknown, or other
MNKERLMKMAGAVRTGGKGTMRRKKKAVHKTVTTDDKRLQGTLKRVGVNTIPAIEEVNIFKDDLVIQFLNPKVQASIAAXTWVVSGSPQTKKLQDVLPGIINQLGPDNMEHLKRIAEEMQKQVAAAGAAAQVKERHDDDXPELGPGETFERVAQETKA

SEQ ID NO: 15961 - DNA, 719 bp, Zea mays
  misc_feature: Ceres CLONE 1379266-F
  misc_feature: Encodes the peptide sequence at SEQ ID NO. 15962
  misc_feature (594)..(594): n is a, c, t, g, unknown, or other
  misc_feature (602)..(602): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaaatcagaggccacaaacctcaccccacctatattatcccgtgccccttgtctttcttcctccacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaaccttggtggtccctgggtcatttctggacactctgaaaggagagctctgctgggagatcaaatgaaatttgtgnagacaggntgcgtatgccctgtctcaggnactaaaggtcatggcatgtggttgtgagacactgacagagggagctggtctaaccatggaaggtgttgctgcacaacaaagcattggtggaaagac

SEQ ID NO: 15962 - protein, 97 aa, Zea mays
  misc_feature: Ceres CLONE 1379266-F
  misc_feature (5)..(98): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVKPWWSLGHFWTL

SEQ ID NO: 15963 - DNA, 716 bp, Zea mays
  misc_feature: Ceres CLONE 1379269-F
  misc_feature: Translation starting site: 283
  misc_feature (406)..(406): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaaaaaaattccaaatttgttgttgtacacacggcacaccctaaccaaaacatcctgccgtttcccgttcacccagcgtgcgctccatcttggcgaggccgcgagggcgaccgctacagcagcagccgccgccgccgccagatccccaggccttcgttgaacccttcgccgtaacgagatcagatggctgggtatatgtcaagagggccccaaaatggttctgtgtatgtctgcaatctacctcctggaactgatgaaaatatgttggctgaatattttggcaccatagtgtcctataaaggtatgnntcttaccagaaggacaaaaggactgggcgtccaaaaatttggatatacagggacaaagttactaatgaaccaaagggtgatgcaacagtcacctatgaggatccacatgctgcttcagctgctgtggaatggttcgataacaaggatttccatgggagcactattcaggttcacatagctgagtcaaaaagcaaagatgcattcgataaccccacaagtttgaacatcattggtggtgttggtgaacaagatgaactggataatggagcaggcagaggcaaagggcgtggggatggcccagcaaagctt

SEQ ID NO: 15964 - DNA, 735 bp, Zea mays
  misc_feature: Ceres CLONE 1379273-F
  misc_feature: Translation starting site: 218
  misc_feature (461)..(461): n is a, c, t, g, unknown, or other
  misc_feature (470)..(470): n is a, c, t, g, unknown, or other
  misc_feature (474)..(474): n is a, c, t, g, unknown, or other
aaagctggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgttttttgttgaccttgaacccactgtcatcgatgaggtgaggactggnaccctacgncagntctttcaccctgagcaggtcatcagtggggagggagatgcagcccaacactttgcccgtgggcactaaccccattggcaaaggagattgttgaacctatgccttgatcgcatcaggaagtttggccaaaaatggcatggtcctccagggtttcctcgtcttcacgtttgttgggggaagaaacgggctccggccttgggtccccccctccaaaaaggcctgcttggtgaaaaacccaaaaaaaccaaggtttgggttcccg

SEQ ID NO: 15965 - DNA, 750 bp, Zea mays
  misc_feature: Ceres CLONE 1379274-F
  misc_feature: Encodes the peptide sequence at SEQ ID NO. 15966
  misc_feature (460)..(460): n is a, c, t, g, unknown, or other
  misc_feature (591)..(591): n is a, c, t, g, unknown, or other
  misc_feature (694)..(694): n is a, c, t, g, unknown, or other
  misc_feature (702)..(702): n is a, c, t, g, unknown, or other
  misc_feature (703)..(703): n is a, c, t, g, unknown, or other
  misc_feature (727)..(727): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagncgcgtggacgcctacgtctcccgctccgggaggggcgagtgcccgcgccagtgcctgcgccgccacgaggggcaggcgtgggaggaccaggagtgcatggaggggtgccgcccgccgcggactggccgtcnacatggagcaaagtaacgtcgccggagcgaaagccgcggccagtgcccggaaaagtgcaagggcaccaccgcggaattgtgggaaaagcaacctgctgagcgnaaaaaaannccggggagggaaaaaaaaaggccnaaacggccccccccccccgaaaa

SEQ ID NO: 15966 - protein, 130 aa, Zea mays
  misc_feature: Ceres CLONE 1379274-F
  misc_feature (82)..(82): Xaa is any aa, unknown, or other
  misc_feature (126)..(126): Xaa is any aa, unknown, or other
MGKGSVGASWWAFLLLAGVLLVVAATAGAEDGVVERDRKEDLRWCKQACEWQYGKDTPRKRECESECRERHQQADAGEDGDXRVDAYVSRSGRGECPRQCLRRHEGQAWEDQECMEGCRPPRTGRXHGAK

SEQ ID NO: 15967 - DNA, 694 bp, Zea mays
  misc_feature: Ceres CLONE 1379285-R
  misc_feature (430)..(430): n is a, c, t, g, unknown, or other
cgattgggtaccgggccccccctcgaggtcgacggtatcgataagcttttttttttttttttttgacaacatcattaccgtttgatttctatttcccttctccaaggctgatgctaaccctttcctaatccttatcacaaaactgctaacgcgaacgacaggacaaaaacacatcggaacacggatctggtgaccctgaactggcgaatttgatttcatcacttatgaccacaacgactaccacttgacccgacatatcacggctgaagccgaatgcaatggcatgggcagctccggccgcagcacgagccacagaggctgctgctcctgcccggatgcgaggctgtgtgcggtgctctccctcatacggacgatcagcatccacgggacagagaggatctcgctccacatgcttccgggcagggcagtngcgcaccgctgctgcacatgtatgatccgcttgggtgaagcgactccatgagaggttactggtcgtacattgcacacgagtactcgtcgctgagcatgtccgccacttatgcgctgataaccagcacactgatcctgcggcttcacgatgtgcctcctggccctacaaggaatgccactttcccgccctgaccccttaatttccaccagccgaaaatcccccagcgcccctgggacagggagctaacccttccttccccaaaac

SEQ ID NO: 15968 - DNA, 671 bp, Zea mays
  misc_feature: Ceres CLONE 1379285-F
  misc_feature: Encodes the peptide sequence at SEQ ID NO. 15969
tccccgcggtggcggccgctctagaactagtggatcccccgggctgcaggaattcgcacgagaccattacctagaacatcctaatcgaaaagataggagggctgtcctgccgactgcggcgaaacaaacaccgaggaacaacagatgattactagagcgcttcctctacgcctgctcccccaaatcctcgcggtaggacctctcctccttcgtctctcagactctccacctcctcctcctccaaagccgtcattctacacgaggagggtgaatatcaagtgagttgaagatgcttcttagggattccagtcagccagggaatgtctctgcttgtttatctcactttgagaaagctgaggatatgccaagtgccagaaacagccactggtgtcacagatgccaacgagctgttcgactccacgccccagaccctggatggtcttattgtgaaggaggagacgttgaggagcttgtcacacctcatgtcatagccgacccgtttgatatctttacatctcacaggtatgctgcagaacgtgatcccgcttttgatctcatggacgcatgctccgccttaatgagaaaccgcttagccgaccgagaactcagaggaagaaccatcacttctcgtcctgaaagcgttcccggacttactccactgctggatcttg

SEQ ID NO: 15969 - protein, 56 aa, Zea mays
  misc_feature: Ceres CLONE 1379285-F
MSLLVYLTLRKLRICQVPETATGVTDANELFDSTPQTLDGLIVKEETLRSLSHLMS

SEQ ID NO: 15970 - DNA, 720 bp, Zea mays
  misc_feature: Ceres CLONE 1379288-F
  misc_feature: Encodes the peptide sequence at SEQ ID NO. 15971
  misc_feature (453)..(453): n is a, c, t, g, unknown, or other
aaagctggagctccccgcggtggcggccgctctagaactagtggatcccccgggctgcaggaattcgcacgagaccattacctagaacatcctaatcgaaaaaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgccgccacctgcgaaggccgactccagcacgaagaccttctcgatctaccggtgggacccggactcgccgtcgacgaagccgcacctcaaggactaccaggtggacctgtccgactgcgggccgatggtgctggacgcgctgctcaagaatcagaacgagcaggacccgtcgctcaccttccgncgcagctgccgggaaggcatctgcgggagctgcggcatgaacatcgacggggacaacggcctccctggctcacaaaaattccggggcctcctccggggtcaaggtttcgccggttcccaaatgggtcccccccaaggaaccgggggggggaaatgaccaacttcctaacgccgaaaaaaaggtccaagcctgggtttagggcaaaggccaaccccccgagagggaaaggaaacccccaaaaacaaggggcacgggggaaaatttcga

SEQ ID NO: 15971 - protein, 148 aa, Zea mays
  misc_feature: Ceres CLONE 1379288-F
  misc_feature: SWISSPROT Homolog: EC 1.3.5.1 Succinate dehydrogenase (ubiquinone)
MAAALLRRSPAARALLSPALSSRLVASKPHSSSPAPPPPAKADSSTKTFSIYRWDPDSPSTKPHLKDYQVDLSDCGPMVLDALLKNQNEQDPSLTFRRSCREGICGSCGMNIDGDNGLPGSQKFRGLLRGQGFAGSQMGPPQGTGGGK

SEQ ID NO: 15972 - DNA, 737 bp, Zea mays
  misc_feature: Ceres CLONE 1379289-F
  misc_feature: Encodes the peptide sequence at SEQ ID NO. 15973
tggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgggtacgtcgtgtgggtcgcctcggcgctcggcccctactggggattccagcaagggtgggtgaagtggctcagtggcgtcatcgacaatgccctgtaccccgtcctcttcctggactacctcaagtccgccgtgcctgccctgggcggcggcccgccgagggcgttcgcggtgctcggactcacggcggtgctgacgctgctcaactacagggggctcaccgtcgtcg

SEQ ID NO: 15973 - protein, 167 aa, Zea mays
  misc_feature: Ceres CLONE 1379289-F
MGECRTEYRGLPDANGEDAGTVPAALRKVSIVPLVFLIFYEVSGGPFGIEDSVGAAGPLLAIVGFLVLPVIWSIPEALITAELGTMFPENGGYVVWVASALGPYWGFQQGWVKWLSGVIDNALYPVLFLDYLKSAVPALGGGPPRAFAVLGLTAVLTLLNYRGLTVV

SEQ ID NO: 15974 - DNA, 867 bp, Zea mays
  misc_feature: Ceres CLONE 1379292-F
  misc_feature (49)..(49): n is a, c, t, g, unknown, or other
  misc_feature (662)..(662): n is a, c, t, g, unknown, or other
ggtggggggggggggggggggaaaggagggggggggggggggggccctnttttaaattgggggtccccgcgggggcgggcgctctagaactagtggatcccccgggctgcgggaattcgcacgagaccattacctagaacatcctaatcgaaaagagaaggaaaagacaattttctcggagacttccggggtcctcttcctctcctcgcggtcccccaccaaaccctaatccgagcacccagcccctacccgcttccgctcgcggcgggctttggggctctcaccctgagcggcaggaatccgcaggggtccgggtgggtgcgagagaggatccacgcccttggcgggaggagcggcaaatggcggaaatagaggggggggaaagggtcctcacggaaacaaacggaacaacggggaggagggaaggcgggggggggggggggggggggggcgaagtgtcctgggtcttccgactggaccgccaacattcgggcccccgggggggctgggaaagggggggggggggaacggcccgggggggggggggcctcctcagggggacccccctgtccggctggccggaacgggggggccccggggggacacaaccacagtgttggcgcccccgaaggggctggggtccgtggggaccggcccccaanaaaaaagaagaggcgggcgggcgcagcggctccccggcgagagagggggccaggggaacgttcacgccggccggagaaagagtacgccccattcgaggggagcgcgggcgcgaggggtagggggcggtccgccggcagcgcccccgggctgtggacgcccacccgcgtcgggcgcggcgcccgccccgcagaggcgagggcgccg

SEQ ID NO: 15975 - DNA, 692 bp, Zea mays
  misc_feature: Ceres CLONE 1379300-F
  misc_feature: Encodes the peptide sequence at SEQ ID NO. 15976
  misc_feature (398)..(398): n is a, c, t, g, unknown, or other
  misc_feature (399)..(399): n is a, c, t, g, unknown, or other
  misc_feature (482)..(482): n is a, c, t, g, unknown, or other
  misc_feature (488)..(488): n is a, c, t, g, unknown, or other
  misc_feature (512)..(512): n is a, c, t, g, unknown, or other
  misc_feature (527)..(527): n is a, c, t, g, unknown, or other
  misc_feature (540)..(540): n is a, c, t, g, unknown, or other
  misc_feature (541)..(541): n is a, c, t, g, unknown, or other
  misc_feature (546)..(546): n is a, c, t, g, unknown, or other
  misc_feature (662)..(662): n is a, c, t, g, unknown, or other
tgagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnnagagcgagtgccgcgagcggcaccagcaagcttgacgcgggcgaggacggcgacccagcggcgtgggacgcctacgtctccgnctccgnaaaagggggcgaagagtgcccggncgccagtgcctgcgnccgccacgagggnncaagnccgtggaggaacccaggagggcaaattgaaggcggtgcccgccgccgccgggactggccgtcgacatggaaaacaaggaagtacggtcgcggcagccgagagccgcgggcaagggncccccgggaagaaggtgcgagcgccaccac

SEQ ID NO: 15976 - protein, 161 aa, Zea mays
  misc_feature: Ceres CLONE 1379300-F
  misc_feature (64)..(64): Xaa is any aa, unknown, or other
  misc_feature (92)..(92): Xaa is any aa, unknown, or other
  misc_feature (94)..(94): Xaa is any aa, unknown, or other
  misc_feature (102)..(102): Xaa is any aa, unknown, or other
  misc_feature (107)..(107): Xaa is any aa, unknown, or other
  misc_feature (111)..(111): Xaa is any aa, unknown, or other
  misc_feature (113)..(113): Xaa is any aa, unknown, or other
  misc_feature (152)..(152): Xaa is any aa, unknown, or other
MGKGSVGASWWAFLLLAGVLLVVAATAGAEDGVVERDRKEDLRWCKQACEWQYGKDTPRKRECXERVPRAAPASLTRARTATQRRGTPTSPXPXKGAKSARXPVPAXATRXQXRGGTQEGKLKAVPAAAGTGRRHGKQGSTVAAAESRGQGXPGKKVRAPP

SEQ ID NO: 15977 - DNA, 666 bp, Zea mays
  misc_feature: Ceres CLONE 1379301-F
  misc_feature: Encodes the peptide sequence at SEQ ID NO. 15978
  misc_feature (478)..(478): n is a, c, t, g, unknown, or other
ggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagcactacggctaccacttctccgcagcagcaggtcaacagccagaatncatcccgtcggggtgcaagcttatgcgccagcacaacctgtgcacccagcaaacgctgggccctgtcgtccttccaacgcagccaaggtttagctggtaccaagcattcctggctgcaggctctttgccttttgggtttggtgcttagcgctgctgtctttatccagaaactgttccttctaagtccc

SEQ ID NO: 15978 - protein, 167 aa, Zea mays
  misc_feature: Ceres CLONE 1379301-F
  misc_feature (37)..(132): Pfam Name: Pex14_N Pfam Description: Peroxisomal membrane anchor protein (Pex14p) conserved region
  misc_feature (105)..(105): Xaa is any aa, unknown, or other
MASGIGSGQQQPPAPAADADPGAVGDKLVFEAPPQPVREDYVQNAVKFLSHPKVRGSPVVYRRSFLEKKGLSTEEIDEAFRRVPDPQPSTTATTSPQQQVNSQNXSRRGASLCASTTCAPSKRWALSSFQRSQGLAGTKHSWLQALCLLGLVLSAAVFIQKLFLLSP

SEQ ID NO: 15979 - DNA, 707 bp, Zea mays
  misc_feature: Ceres CLONE 1379306-F
  misc_feature: Encodes the peptide sequence at SEQ ID NO. 15980
  misc_feature (520)..(520): n is a, c, t, g, unknown, or other
  misc_feature (521)..(521): n is a, c, t, g, unknown, or other
  misc_feature (608)..(608): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactacccccggcgtggccggcaacgggcgcgacttcaacctttcctggtgtccctcctgggccccccccnngggggggggcccgcgtttcaaaaattttgggggggcggtgcacccacgtagcgcgcctgggcgccacgacagcctggccaccaaaanggccggcgtcgtcggcttcatcggcctgaagccattcacggcgccttcggccctttccggcttgcccctctcggaaagggagatcccacattcggggga

SEQ ID NO: 15980 - protein, 79 aa, Zea mays
  misc_feature: Ceres CLONE 1379306-F
  misc_feature (63)..(63): Xaa is any aa, unknown, or other
MAGIGRNMVAPLLVLNLIMYIIVIGFASWNLNHFINGQTNYPRRGRQRARLQPFLVSLLGPPXGGGPAFQKFWGGGAPT

SEQ ID NO: 15981 - DNA, 645 bp, Zea mays
  misc_feature: Ceres CLONE 1379310-F
  misc_feature (645)..(645): n is a, c, t, g, unknown, or other
tccccgcggtggcggccgctctagaactagtggatcccccgggctgcaggaattcgcacgagaccattacctagaacatcctaatcgaaaaaatagttcggtgcctttttctagcggggaggaggcaggcggcgcgatctggcaccggccatcacgttccctcccgccgcttccccctccctgccctcccgttccccagatctgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcgggcaggcgccgggggcccaggatcctgtgtggccacgaggcggatgtacgcgtgactcctcggcacggacaaagctggcgcggattccgggcagtcacgggaaggatgatgctggactcctctgactgtgcctctgctgccgccgccgcggaaggtggggcaggtgcagccgcagcgccgtggcgggtggggggccgtgcccctggcgcacgacgctggctaccccagcggcgggatgggaagagagaagatggcaaacctgagttgtgggatactccaggttttgaaggcaagagagctan

SEQ ID NO: 15982 - DNA, 675 bp, Zea mays
  misc_feature: Ceres CLONE 1379314-F
  misc_feature (535)..(535): n is a, c, t, g, unknown, or other
  misc_feature (543)..(543): n is a, c, t, g, unknown, or other
  misc_feature (599)..(599): n is a, c, t, g, unknown, or other
  misc_feature (600)..(600): n is a, c, t, g, unknown, or other
  misc_feature (620)..(620): n is a, c, t, g, unknown, or other
  misc_feature (675)..(675): n is a, c, t, g, unknown, or other
gctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctccttccgcggcttcggatactgcatgcagggctggtaccaccgctgcatcggtctcgacccctgaaccccgccgccacttgcttctttgatttgatttcattcggtctcgttcggcgcccctcccgtccatggatctgttgcgcgagagcgcggcagcgcgcgagattcgcccccttctcttctccctaggaagcagggaagcaagccgaccgctcgctgagcgcccgcgnccgagggnccgtcccggggtgccgatgaactctctggaaagggtggagacccgcggcaggcccnnccccccgggggggcccgagnccccctgggcggtttttggggggagggggggacccctccccccggggggacgccn

SEQ ID NO: 15983 - DNA, 677 bp, Zea mays
  misc_feature: Ceres CLONE 1379319-F
  misc_feature: Encodes the peptide sequence at SEQ ID NO. 15984
  misc_feature (553)..(553): n is a, c, t, g, unknown, or other
  misc_feature (554)..(554): n is a, c, t, g, unknown, or other
  misc_feature (583)..(583): n is a, c, t, g, unknown, or other
  misc_feature (597)..(597): n is a, c, t, g, unknown, or other
  misc_feature (638)..(638): n is a, c, t, g, unknown, or other
  misc_feature (660)..(660): n is a, c, t, g, unknown, or other
  misc_feature (663)..(663): n is a, c, t, g, unknown, or other
  misc_feature (669)..(669): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (676)..(676): n is a, c, t, g, unknown, or other
ggagctccccgcggtggcggccgctctaaactagtggatcccccgggctgcaggaattcgcacgagaccattacctagaacatcctaatcgaaaaacaaacttcccctgtcacgagagtacgagaccacgccttctgtgggatcaatcggctagggtttcggagatgttcggccgcgcgccgaagaaaaacgacaacacccggtactacgagatcctgggggtttccaaggacgcgtcacaggatgacctcaagaaggcctaccgcaaggccgccatcaagaaccaccccgacaagggcggcgaccccgagaagttcaaggagctagctcaggcttatgaggtcctcagcgaccctgaaaagagagagatctattgaccagtatggcgaggatgccctcaaggagggaatgggaggcggtggtgggatgcatgatccctttgacatattccagtcattctttggtggtggaagccctttttggaggtggcagcagtaggggcagaaggcaacgacggggaggaatgatgtggttcatccctctgaaggtttcnntctggaggatttgtacaatggcacatcanagaagcttctctcntgtcccgcaatgtcctctgctccagtgcaaatgtaaagggnttccaagtttgagctttcctcnagnaggggngnnnttnt

SEQ ID NO: 15984 - protein, 70 aa, Zea mays
  misc_feature: Ceres CLONE 1379319-F
  misc_feature (13)..(71): Pfam Name: DnaJ Pfam Description: DnaJ domain
MFGRAPKKNDNTRYYEILGVSKDASQDDLKKAYRKAAIKNHPDKGGDPEKFKELAQAYEVLSDPEKREIY

SEQ ID NO: 15985 - DNA, 736 bp, Zea mays
  misc_feature: Ceres CLONE 1379320-F
gctcagaactagtggatcccccgggctgcaggaattcgcacgagaccattacctagaacatcctaatcgaaaaaggtattatgccgttgcacacctcttctctctcgccgccccgagaccaccatgcttccctctccatcgctgaattgaggtgcctcctgccggcggcggatcaataacactcaccgcagaacctcatcacgctcatgactaaaggtgatatcaggaggtgctaaatctcactgagcgattagcctcgtcttgaacgagtggaagtacgaatatactgtgacgatgacctgagtccggcgaccccccccaagggggtggaaaacgtccaaggggcctggagggggggggggggggaaccaaactcccaacatcggtttgcccccaccaaagacgggcgtaaaaggggcacggccccccccttgatcggacagggaaaagggggggagaaaccaattttccctggatcacgcgggaggccaccgcgccaaccgggggggggatcccgcccaccccggtttttgtaacgggggcgcaccctcctttgctttccgcgcccccaggttttccgggggacccccgcttctccccggaaaaaccccccccccagtggataacccccgccccccgggggcgcgcgcgaaaacaaaagggaatttttaacccttcccaacccccccgccaaacacccggtgtttcggcctttctgcccgcaatcccgggggag

SEQ ID NO: 15986 - DNA, 648 bp, Zea mays
  misc_feature: Ceres CLONE 1379324-F
  misc_feature: Encodes the peptide sequence at SEQ ID NO. 15987
  misc_feature (26)..(26): n is a, c, t, g, unknown, or other
aaactggagctccccgcggtggcggncgcttcatactaccggatcccccgggctgcaggttttcccacgagaccattacctagaacatcctaatcgaaaattttccataactgcaaaaatctccccggacagagaagcgttcgcctgactcgcccccactcccgagtggccgaagccccgaccggcgaccccgcagatctgtcccattgttctccgtcctccccgtcgtgtcctccttgatccttcttcgagtggcaagtgctgacctcgcctcctattcctccggtagccctactggagcgccgggcgcacagatctgcccacccctggacgctaggcgctgcccagctcttccctgccagccggtcgcggcggctggcagccagcacggcagggctgctgttgcctgctcttgtcctccggcacagcgcagggtgtcggggtcgctcccagctggccatcctctcggcccccttgttgcacagcgagtcagtcggatacatcttttatcagatttggtgaatccccctcccctctcacgctccaccactgatcatggggctactcagcattatccgcaagatcaagcgcaaggagaaggagatgcgcatcctcatggttggcctggacaactcagggaagacaacc

SEQ ID NO: 15987 - protein, 31 aa, Zea mays
  misc_feature: Ceres CLONE 1379324-F
MGLLSIIRKIKRKEKEMRILMVGLDNSGKTT

SEQ ID NO: 15988 - DNA, 628 bp, Zea mays
  misc_feature: Ceres CLONE 1379325-F
  misc_feature: Encodes the peptide sequence at SEQ ID NO. 15989
  misc_feature (472)..(472): n is a, c, t, g, unknown, or other
gctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgcctgccatcccggtggtggacctctcggtgacgcggcgcgaggacctagtcgagcaggtgaggcacgcggccggggacggtgggcttcttctggctgggaaaccacggagtgccggaggagctgatgggcggcatgctccgcggngtgcgcatatcaggggccccccgggggggggggcaaaaccggggggcttaactcggaggggccctgccctcgaaagcggggggttccgggcccaaattagaacttcttgtaggggggggggggggtcggacggggagcaaaccgctcctttggggg

SEQ ID NO: 15989 - protein, 110 aa, Zea mays
  misc_feature: Ceres CLONE 1379325-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGACHPGGGPLGDAARGPSRAGEARGRGRWASSGWETTECRRS

SEQ ID NO: 15990 - DNA, 643 bp, Zea mays
  misc_feature: Ceres CLONE 1379326-F
  misc_feature: Encodes the peptide sequence at SEQ ID NO. 15991
  misc_feature (638)..(638): n is a, c, t, g, unknown, or other
ggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccgtgggaggcgaagcaggcgctctactcgagggacctcgctcgcaacctgcgcttcgcctccaacttcgacctcttcaaggctgctgcggccgactggcgcgacacgtccttcctgcgaggtggctccgaacccgccnccgcg

SEQ ID NO: 15991 - protein, 172 aa, Zea mays
  misc_feature: Ceres CLONE 1379326-F
  misc_feature: SWISSPROT Homolog: EC 1.14.11.20 Desacetoxyvindoline 4-hydroxylase
  misc_feature (171)..(171): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPVGGEAGALLEGPRSQPALRLQLRPLQGCCGRLARHVLPARWLRTRXR

SEQ ID NO: 15992 - DNA, 509 bp, Zea mays
  misc_feature: Ceres CLONE 1379333-F
  misc_feature: Encodes the peptide sequence at SEQ ID NO. 15993
  misc_feature (26)..(26): n is a, c, t, g, unknown, or other
aaactggagctccccgtggtggcggnggttctctaactaacccctcccccgggctgcaggttctcccacgagaccattacctagaacatcctaatcgaaaaatctgcctttgctcccccacccgcaggcagcgagcgacagcgacggcgagggatggccaaggccaggtcgttggcgaagcaaaagcaggcgcagcaatcaaacggcggcggcggccacgcgctgtcctccaagctcgcccggtacctcgacccggaggcctccttggacaaggaccaactgctggacgcgtgcactggatccgccaggcggtggggctcatatgcggcctgctctggggaggccgtccccctcctcgggtcccccctggatccgggggggggggggggcgcctcccccccgggggaaatttaatcttttggggggcccaccccccccccttttggtaagagggtccccccggggggaaaatttttggggggccccttgggggccccggtttttctttc

SEQ ID NO: 15993 - protein, 86 aa, Zea mays
  misc_feature: Ceres CLONE 1379333-F
MAKARSLAKQKQAQQSNGGGGHALSSKLARYLDPEASLDKDQLLDACTGSARRWGSYAACSGEAVPLLGSPLDPGGGGGASPPGEI

SEQ ID NO: 15994 - DNA, 684 bp, Zea mays
  misc_feature: Ceres CLONE 1379334-F
  misc_feature: Encodes the peptide sequence at SEQ ID NO. 15995
  misc_feature (389)..(389): n is a, c, t, g, unknown, or other
  misc_feature (469)..(469): n is a, c, t, g, unknown, or other
aaagctggagctccccggcggtggcggccgctctagaactagtggatcccccgggctgcaggaattcgcacgagaccattacctagaacatcctaatcgaaaaattccccggttggcttggttaccattcctccccaaaacacatcctgcgatcctcgaaacctccgccgagcatcgattatggcggcctactgcggcaagtacgcggatgagctcatcaagaatggtgcctacatcggcacccctggcaagggtatccttgctggtgatgagtcaactggcaccattggcaagcgcctttccagcatcaatggcgagaacgtggaggagaaccggcgggctctccgtgagctcctgttctggctggcctggtggcctccagtacatcnagcggtgtgatcctctttcgaggagagcctctaccagaagaacaaggatggcaagcctttttggcccagggcctcgaggnagggaggcggcctccctggcatcaagggcgacaagggcacccattgaggttggtggcaccgacaaggagaccaccacccagggccacgatgacctcggcaagcgctgcgctaagtactaacgaggccggtgcccgcttttgcccagtggcgtgctggctctcaagattggcccccaacgagccgtcacagcttggcattggactgaatggctcag

SEQ ID NO: 15995 - protein, 72 aa, Zea mays
  misc_feature: Ceres CLONE 1379334-F
  misc_feature: SWISSPROT Homolog: EC 4.1.2.13 Fructose-bisphosphate aldolase
  misc_feature (70)..(70): Xaa is any aa, unknown, or other
MAAYCGKYADELIKNGAYIGTPGKGILAGDESTGTIGKRLSSINGENVEENRRALRELLFWLAWWPPVHXAV

SEQ ID NO: 15996 - DNA, 738 bp, Zea mays
  misc_feature: Ceres CLONE 1379336-F
  misc_feature: Encodes the peptide sequence at SEQ ID NO. 15997
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (28)..(28): n is a, c, t, g, unknown, or other
  misc_feature (45)..(45): n is a, c, t, g, unknown, or other
nccccccnnnnnnnnnnnnnncccnatnaaataagagaaggcggntccttccaccctggcactccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttacgtgtggagtgatgcagaggatctcaatctttatggagaatgggactttgaggtgatatgactggtttcctgcaggccctgggggtggtaatgctatgtgattatcatgcctacgtggatcatatcaaaatgatgaactctatcagctactgcccgccctcgggatcctaaaaattctggtggcgaccacgcaccatgaaatc

SEQ ID NO: 15997 - protein, 134 aa, Zea mays
  misc_feature: Ceres CLONE 1379336-F
  misc_feature (19)..(118): Pfam Name: AIG2 Pfam Description: AIG2-like family
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTRTRVEISLADSSENMLADTYVWSDAEDLNLYGEWDFEVI

SEQ ID NO: 15998 - DNA, 650 bp, Zea mays
  misc_feature: Ceres CLONE 1379342-F
  misc_feature: Encodes the peptide sequence at SEQ ID NO. 15999
tccccgcggtggcggccgctctagaactagtggatcccccgggctgcaggaattcgcacgagaccattacctagaacatcctaatcgaaaaacagctagcatcgatccgccattgctcaccgcacaagtggacgctcacctcacacacgcagctaagtagctaacgccgaaggcgacaacaagaaaaggctcgacatggccgaggagaagaagcagggcctgcagctgctggacttctgggtgagcccattcgggcagcgctgccgcatcgcgctggacgagaagggcctggcctacgagtacctggagcaggacctgaggaacaagagcgagctgctcctccgcgccaacccggtgcacaagaagatccccgcgctgctgcacgacggacgccccgtctgcgagtccctcgtcatcgtgcagtacctcgacgaggcgttcccggcggcggcgccggcgctgctccccgccgacccctacgcgcgcgcgcaggtccgcttctgggcggactacgtcgacaagaagctctacgactgcggcacccggctgtggaagctcaaggtggacggccaggcgcaggcgcgcgccgagatgctcgagatcctccgcacgctggagggcgcgctcggggacgggcccttcttcggagg

SEQ ID NO: 15999 - protein, 151 aa, Zea mays
  misc_feature: Ceres CLONE 1379342-F
  misc_feature (7)..(80): Pfam Name: GST_N Pfam Description: Glutathione S-transferase, N-terminal domain
  misc_feature: SWISSPROT Homolog: EC 4.4.1.5 Lactoylglutathione lyase
MAEEKKQGLQLLDFWVSPFGQRCRIALDEKGLAYEYLEQDLRNKSELLLRANPVHKKIPALLHDGRPVCESLVIVQYLDEAFPAAAPALLPADPYARAQVRFWADYVDKKLYDCGTRLWKLKVDGQAQARAEMLEILRTLEGALGDGPFFG

SEQ ID NO: 16000 - DNA, 671 bp, Zea mays
  misc_feature: Ceres CLONE 1379347-F
  misc_feature: Translation starting site: 162
  misc_feature (385)..(385): n is a, c, t, g, unknown, or other
  misc_feature (435)..(435): n is a, c, t, g, unknown, or other
tggagctccccgcggtggcggccgctctagaactagtggatcccccgggctgcaggaattcgcacgagaccattacctagaacatcataatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaggccgccgccgccgtggaacccaagttctaccctgccgacgacgtcaagccccgcgttcccagcacccgcaagcctaagcctaccaagctcaggtcgagcatncacgcctgggacggtgctgatcctcctcgcagggcgcttcatggggaagnaggagtggtgtttctcaagcagctcaagtctggcctgctccttatctctgggcctttcagaatcaatggagtaccgattccgccgtgtgaaccagacctatgtcattgctacatcaaccaagtgacatctctgggggggtgatggtcgcccagtttgatgacaagtactttgcccagggagaagaagcagaaaggtgaagaaagaccgaagggcgagctttttgagacagaaaagg

SEQ ID NO: 16001 - DNA, 682 bp, Zea mays
  misc_feature: Ceres CLONE 1379354-F
  misc_feature: Translation starting site: 191
  misc_feature: SWISSPROT Homolog: EC 2.5.1.47 Cysteine synthase
  misc_feature: SWISSPROT Homolog: EC 4.2.1.22 Cystathionine beta-synthase
  misc_feature (394)..(394): n is a, c, t, g, unknown, or other
  misc_feature (511)..(511): n is a, c, t, g, unknown, or other
  misc_feature (521)..(521): n is a, c, t, g, unknown, or other
  misc_feature (596)..(596): n is a, c, t, g, unknown, or other
gcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccngggcgtgagtgttctgattgaaccaactagcggcaacacaggcattggactggcctttatggctgctgccaagggctacaaacttacactcacaatgcctgcctccatgagcatggnagaggaggtncatattgaaagggcttttgggtgctgaacttgtccttactgacccactcctgggaatggaaaggagctgtcaagnaaagcggaagagatacaagcaaagacacccaactcttacatccttcaacaatttgaaaatccagctaacccaaagattcactatgg

SEQ ID NO: 16002 - DNA, 669 bp, Zea mays
  misc_feature: Ceres CLONE 1379355-F
  misc_feature: Translation starting site: 293
  misc_feature: Pfam Name: GSHPx Pfam Description: Glutathione peroxidase
  misc_feature: SWISSPROT Homolog: EC 1.11.1.12 Phospholipid-hydroperoxide glutathione peroxidase
cgctcagaactagtggatcccccgggctgcaggaattcgcacgagaccattacctagaacatcctaatcgaaaagcccactattctctcgcctgcgcttccgcctcccgagttgcgccgccgtctccatctccacccctccatcctccgcggcgcccctgcactacggccatcgcactcccctcgctagcccttttcctctgtccccaccttgcccgcgcatcctccgtgcggccgtcgcggtttcttcgctggatctgcgcccgatcaccggcggcttcgcgctattcagcatggctgctgcctcctccgccacctccgtccacgacttcaccgtcaaggatgctagcgggaaagatgtggaccttagcacctatataccgggaaggttctgctcatagtcaatgttgcatctcagtgtggcttaaccaattccaactacacagagctgagccagttgtatgagaaacaagggaacagggggtttgagatccttgcatcccaatgacaacaaattaagggtgttcaggagcctggcctaaatggagggaacccgcccccggttgatttgaactcgctgtcaaggatgagtatacatttttcgccaaaaggatggccggacatcgggagacaatactgcacccatttaccaaggtcctagacaaacaaa

SEQ ID NO: 16003 - DNA, 693 bp, Zea mays
  misc_feature: Ceres CLONE 1379356-F
  misc_feature: Translation starting site: 259
aaaactggagctccccgcggtggcggccgctctaaaacaagtggatcccccgggctgcaggaattcgcacgagaccattacctagaacatcctaatcgaaaattcggcgactatggcggcggcaccggcaggcggcggccctcgggcattgtcccagcgggagcaggacatccagatgatgctcgccgccgatgtccacctcggcaccaagaactgcgaactccaggtggagcgcttacgtgtacaagcgccgcactgatggtatctatattattaaccttggaaagaccttgggacaagcttcagttggccgccagggtcatcgttgccattgagaaatccgcaggacattatcgtgcagtcttgctaggccctatggccagaaggctgtcctcaagtttgcgcagtacactggtgcccattgccattgctggcaggcacactcctggtacattcaccaaccagttgcaaacctccttcagtgagccacgccttcttaaccttactgacccgaggacttgattcatcagcccattaaggagtctgcgcttggaaacattcccaccattcgcatttctgtgatactgactcccctatgcgctattgttgatatttggcattccccgccaataacaaggggaaacagaagcatttggtttgtctgtttctggttgcttcgccccgaatggtcct

SEQ ID NO: 16004 - DNA, 682 bp, Zea mays
  misc_feature: Ceres CLONE 1379357-F
  misc_feature: Translation starting site: 345
  misc_feature (602)..(602): n is a, c, t, g, unknown, or other
aaactggagctccccgcggtggcggccgctctagaactagtggatcccccgggcttgcaggaattcgcacgagaccattaccttaaacatcctaatcgaaaaatcgatcgtcaatgcaagtttgtccatttcgcattggtctgaatactgtagctactagcgcgagtgccactgtgccgcagctgcctgctcgccattactgcaagctgtgttcaatcaaagcttaattaggctctctctacatctgatccagctaagtagctagccagcactacagaagggcgtggcaagaatcaggagagagatagcaggggggctagctagctgagctcgtgcaacgaagaatggccggaattggcaggaacatggtggcgccgctcctggtgctcaacctcatcatgtacatcatcgtcatcggcttcgcgagctggaacctgaaccactttcattcaacgggcagaccaacttaccccggcgtggccggcaacggcgcgacgttctactttcctggtgttcgccatccttggccggcgtggtggggcgcggcgtccaagcttggcgggcgtgcaccacgtgcgcgcctggcgccacgacagcctggncatccaacgccgcgtcgtcgctcttcgcctgggccatcacggcgcttgcctttcgggcttgccttgcaagagatccacat

SEQ ID NO: 16005 - DNA, 678 bp, Zea mays
  misc_feature: Ceres CLONE 1379363-F
  misc_feature: Encodes the peptide sequence at SEQ ID NO. 16006
  misc_feature (562)..(562): n is a, c, t, g, unknown, or other
  misc_feature (584)..(584): n is a, c, t, g, unknown, or other
  misc_feature (592)..(592): n is a, c, t, g, unknown, or other
  misc_feature (641)..(641): n is a, c, t, g, unknown, or other
  misc_feature (645)..(645): n is a, c, t, g, unknown, or other
aaagctggagctccccgcggtggcggccgctcaaaaacaagtggaacccccgggccgcaggaatcctctgcgatttctctagaactcgacaaccccaactagttttggttcctcccctcgttcgagagagcgtttctagtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctaagtcggcttcaccgacaccgagcggctcatccggcgacgcttgccaagaaccaggtcgccatgaaccccaccaacaccgtcttcgatgccaagcggttgatcggcaggaggttctcttgacccgtcagtgcagagtgacattgaagctattggccgttcaaggtcattcccagggcctggtgacaaacccattgattgtagtcaacttacaagggcgaggaagaagcagtttgcttgctgaggagatctccctccatggtcctccatcaagatgaaggagattgctgaanccctaccttggttccccatcanaaaaccantggtggacagtgccggcctatttcaacgacttcgcagaggcagcaccangggnaccccgggggtgtcatgcgggcctcaaatgtga

SEQ ID NO: 16006 - protein, 42 aa, Zea mays
  misc_feature: Ceres CLONE 1379363-F
MAKSEGPAIGIDLGTTYSCVGVWQHDRVEIIANDQGNRTTPS

SEQ ID NO: 16007 - DNA, 666 bp, Zea mays
  misc_feature: Ceres CLONE 1379364-F
  misc_feature: Translation starting site: 165
  misc_feature: SWISSPROT Homolog: EC 1.3.1.9 Enoyl-[acyl-carrier-protein] reductase (NADH)
cgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcaatatcggaagagtgtggcccgcagggacttcccattgatctcagaggtaaaagggcattcgattgctggagttgctgatgataatgcgctatggatgggcaattgcgaaggcacttgctgcggctggtgctgaaattcttggggggtaacatgggtgccggcacttaacatatttgagacaagtctggggccggtgaaaaggtttgatgaatcacggaagctggccagatggatctcctttatgaaaaattgggtaaagtctatcccccttgatgctggctacgaatccccctggaggtggtccccctga

SEQ ID NO: 16008 - DNA, 723 bp, Zea mays
  misc_feature: Ceres CLONE 1379365-F
  misc_feature (645)..(645): n is a, c, t, g, unknown, or other
ctctagaactagtggatcccccgggctgcaggaattcgcacgagaccattacctagaacatcctaatcgaaaaattccgtcgtcgtcgtcagcagcttctgcttgctctggtgcgaaggagagatacagagcgcgacagagatctagtagagaggctagctaggtggtcctcgaacgaagatgttgggggagttcaccgtttaggcggtggaggtgccgccgcatctggtgtcggcgggcagccgtacgccgtcctcccaagacaaaggcgtcgcagctgatggtgcgcttcctgcccgactccaagccggccgtggccgtgcagctcggagaccacttacacctcgcctactcccacgccaagcaggggctcctccgccccagaccgttcgccggccaaggaccgaggtgctctggcctggtcccagggggtcgctgccacaacctgggggtcgtctggagccagcacgcaccggcgctgttaacgcaaggggcgcccaagcgaagtggttccctcgtcttgtcgaggccctacaaggtacgctggctcgaaccgcggcgccccctaccccggcccagctctccatggctcgagccaggctaaccgggttcccttccccctttcgggcctccttggaaaaaggnccacccatctcccctggttgatccgggataccgcacccccaaagttcctgggtggccgcctgctttctgggtcggaac

SEQ ID NO: 16009 - DNA, 756 bp, Zea mays
  misc_feature: Ceres CLONE 1379367-F
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaaattaccatttcgctatctccatatcacttggtcccggtagctaggacagagagctttgtttacgcggcagctagatgaacaggaagccaggagactggcactggaggacgtgccaggacctcaacttcagccggcgggatgcatgaccgcgcttgagggaaccacgtgtacctggtgatcgtaccatcactggtggcgacttgagagggcgtggtggctcctccttcggcggtggctttggtgctgcctctgatgtccgccctgcagactggaactgctcctgcggcgcacacaacttcgccagccgatccaactgcttcacgagctctgcctacaaggacgaggctgccggcgcctttgatagtgacatggcacgctcacgcggctacgccgtgtttcgccaggggcgctgccggccgtaccaaccgctccaggttgtaagcctggagactggatctgcgacangtcccggttcggacggaggacaacttccgctaccagggatggaattggttccaggggcaacgtgggcacggggactccgggatccggctgccccggaggccccaacggaaaacttactttgcggcgggagggggttaggggggaggccaagggttaacgggctttatggcgcgcgggtcacgcaaagccc

SEQ ID NO: 16010 - DNA, 714 bp, Zea mays
  misc_feature: Ceres CLONE 1379368-F
  misc_feature: Encodes the peptide sequence at SEQ ID NO. 16011
  misc_feature (96)..(96): n is a, c, t, g, unknown, or other
  misc_feature (117)..(117): n is a, c, t, g, unknown, or other
  misc_feature (340)..(340): n is a, c, t, g, unknown, or other
  misc_feature (354)..(354): n is a, c, t, g, unknown, or other
aaagctggagctccccgcggtggcggccgctctagaactagtggatcccccgggctgcaggaattcgcacgagaccattacctagaacatcctaantcgaaaactttttcctagggntttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacacgnggggcgctactccnagagcgggtccgcaagcgcaaggcccgaatcgtgagcgcttacaaactccctccatgatggacgggggccacaacggaaaaaaggcagtgggtggcccgatactcaaagaaacccggggaaaaatttacccggtgtcccgagagcaaccccctcgggggtggggggaaaaggaaatttaaaaagggggccccggggggggaccccccccattggccccccccgggggtggaaaaaaaaaccccccgggtatttcccccccctcgggggggggaaaaaatttttttcccccccccccccggggggggagggggaggttttcttaaaaaaaaaaaaaaatggggggggggggggggggaggg

SEQ ID NO: 16011 - protein, 111 aa, Zea mays
  misc_feature: Ceres CLONE 1379368-F
  misc_feature (48)..(48): Xaa is any aa, unknown, or other
MAEVEQQQDTPKLFNRWTFDDVQVNDISLNDYLAVNATKHAMYLPHTXGATPRAGPQAQGPNRERLQTPSMMDGGHNGKKAVGGPILKETRGKIYPVSREQPPRGWGEKEI

SEQ ID NO: 16012 - DNA, 652 bp, Zea mays
  misc_feature: Ceres CLONE 1379369-F
  misc_feature: Encodes the peptide sequence at SEQ ID NO. 16013
  misc_feature (436)..(436): n is a, c, t, g, unknown, or other
  misc_feature (602)..(602): n is a, c, t, g, unknown, or other
  misc_feature (615)..(615): n is a, c, t, g, unknown, or other
  misc_feature (620)..(620): n is a, c, t, g, unknown, or other
  misc_feature (634)..(634): n is a, c, t, g, unknown, or other
gctctagaactagtggatcccccgggctgcaggaattcgcacgagaccattacctagaacatcctagtcgaaaaatcccgacattcgccgctctttctccacgcgccggtcgccgcagacgcaagcccgcccgccgcagctgacgccgcgatccgcgagggtgcaagctagctctggccccgctggcggtgccgactgagatggacccgcgcttcacgctgccggccgccattggcggcggcgccggtcgggtgcaccaccggcgggcccactcggagtcgttcctatgcttctccgacgcggacctgctcctcgacccggacggggacctctccttctccgacctcgacttcccctccctctccgacgactccccggccgcctccgaccctaccccgcccccgccgctgccgcagccggtcccggccccccgccncggccggcggggcccacacgcggagcctctccctcgacgccgccttcttcgagggcctccgcgtttcagggacccagcgggagccggcccggggggtgggccccgggcacaagaggagcggctcccatgggatggggccacctcaaccgttttggagggcgagtcnggcgcttctccangcggnctgccggactaacncccaagaaggccatgccc

SEQ ID NO: 16013 - protein, 143 aa, Zea mays
  misc_feature: Ceres CLONE 1379369-F
  misc_feature (79)..(79): Xaa is any aa, unknown, or other
  misc_feature (139)..(139): Xaa is any aa, unknown, or other
MDPRFTLPAAIGGGAGRVHHRRAHSESFLCFSDADLLLDPDGDLSFSDLDFPSLSDDSPAASDPTPPPPLPQPVPAPRXGRRGPHAEPLPRRRLLRGPPRFRDPAGAGPGGGPRAQEERLPWDGATSTVLEGESGASPXGLPD

SEQ ID NO: 16014 - DNA, 623 bp, Zea mays
  misc_feature: Ceres CLONE 1379370-F
  misc_feature: Encodes the peptide sequence at SEQ ID NO. 16015
  misc_feature (509)..(509): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
ggcggccgctctagaactagtggatcccccgggctgcaggaattcgcacgagaccattacctagaacatcctaatcgaaaaaaggggggagagcatcgtcagctagcagagagagtgcgtagcaactagctagcaatggcggagaaccctgctccgagttccccgctagtgacttctcccgacgccgctgcgccgcctctgccagcggagttcaccaagctcaccttccgtagcctgtacatccgtcggacaggtccaggcagccgggagatgactgtggacgggaggccgtctgaccagctgggacgacggttcgtgagcgactttcccatatacgatggccgtggctccggcgcccgcctcgtcgctcgcttgcagggagtcactgtccaaatcggcagctcgcaccagctagtcagcatcgtcttcgaggccgagaggcttaagggctccacgctgctcaccaacggagtgataacggatgggtcagacgagtgggcgatctacgnggccaaccggggtgttcgcctgggccaccgggtcatacccaaagaaaggtttgtcgccggttagcaacgacggcaactctgatgagtccccnnnnntttcggaggtttttgggc

SEQ ID NO: 16015 - protein, 145 aa, Zea mays
  misc_feature: Ceres CLONE 1379370-F
  misc_feature (125)..(125): Xaa is any aa, unknown, or other
MAENPAPSSPLVTSPDAAAPPLPAEFTKLTFRSLYIRRTGPGSREMTVDGRPSDQLGRRFVSDFPIYDGRGSGARLVARLQGVTVQIGSSHQLVSIVFEAERLKGSTLLTNGVITDGSDEWAIYXANRGVRLGHRVIPKERFVAG

SEQ ID NO: 16016 - DNA, 651 bp, Zea mays
  misc_feature: Ceres CLONE 1379371-F
  misc_feature: Encodes the peptide sequence at SEQ ID NO. 16017
  misc_feature (502)..(502): n is a, c, t, g, unknown, or other
cgctctagaactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctactacgagagctagcagcggtagcggccgttatcttgtcgctccggctccgttcgtgtacccgagtcccagcctagatgccgcagatggaggggtccactgatcagatcgccgccggctggttcgctaaggagccggcttccgagcggcccgtgggcttgccgaggaccggctcttccagtcgcctcaacgcgcaggcgccggagttcgtgccgcgggggccgccgccaccggcgccggaggttgtgctgccgcctccgccgcaggtgatccgcatgttcgccgcgcctcccccgccgccgcgtgggggcttcttctccgcgccgcagccccggncgttcgagtactattcgcctatcggcgaacgcagcggatttgctgccaaggagcaacaggcgccggagctggaagcggagatgtcccacccgccgcggtgaaacccagccggttggtgcatggcatccaccaacgaggtggtgcacaga

SEQ ID NO: 16017 - protein, 119 aa, Zea mays
  misc_feature: Ceres CLONE 1379371-F
  misc_feature (32)..(49): Pfam Name: PAM2 Pfam Description: Ataxin-2 C-terminal region
  misc_feature (87)..(87): Xaa is any aa, unknown, or other
MPQMEGSTDQIAAGWFAKEPASERPVGLPRTGSSSRLNAQAPEFVPRGPPPPAPEVVLPPPPQVIRMFAAPPPPPRGGFFSAPQPRXFEYYSPIGERSGFAAKEQQAPELEAEMSHPPR

SEQ ID NO: 16018 - DNA, 672 bp, Zea mays
  misc_feature: Ceres CLONE 1379378-F
  misc_feature: Encodes the peptide sequence at SEQ ID NO. 16019
  misc_feature (358)..(358): n is a, c, t, g, unknown, or other
  misc_feature (410)..(410): n is a, c, t, g, unknown, or other
gctctagaactagtggatcccccgggctgcaggaattcgcacgagaccattacctagaacatcctaatcgaaaaaccaaaggtaccttgcaatcacaacgaacagaagctctcgatctcaccgacaccgaggaagaagagatcaatggcgtccgagcagggagtcgtgatcgcgtgccacagcaaggctgagttcgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaagncagtcaccgcggtctacgaggtcgagggcgatgccgacctttcacttcgtcnagaacggcagacggtcgcgaccatcgtgggttgcaggaaagacgagctcctgggcccagatcgagaagcatgccgcgccctgcgcctgcgtctgcgtctggctaaggagatcaggcctccgcgtcaataagggcagcacgtatgggtggaaatggggcccttatcaggtctgggctttgtcgggtggggggggatgtgaataaaagaaggggtttggtctatcccaggccggggggggtattaacccgaaaaaaaaaaaaag

SEQ ID NO: 16019 - protein, 131 aa, Zea mays
  misc_feature: Ceres CLONE 1379378-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
  misc_feature (72)..(72): Xaa is any aa, unknown, or other
  misc_feature (89)..(89): Xaa is any aa, unknown, or other
MASEQGVVIACHSKAEFDAHMTKAQEAGKLVVIDFTAAWCGPCRAIAPLFVEHAKKFTQVVFLKVDVDEVKXVTAVYEVEGDADLSLRXERQTVATIVGCRKDELLGPDREACRALRLRLRLAKEIRPPRQ

SEQ ID NO: 16020 - DNA, 693 bp, Zea mays
  misc_feature: Ceres CLONE 1379379-F
  misc_feature (446)..(446): n is a, c, t, g, unknown, or other
  misc_feature (458)..(458): n is a, c, t, g, unknown, or other
  misc_feature (459)..(459): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaatatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaacatcaggncacaacactacnnacacttgtgctagcaaaccttgctgcctactctcagcaacagcaagtttctccatttcaaccactagctgcattgaactctgcttcctatttggaacaacacaactaccattcagccaggtatcttgctgcctaaccccagnattttcttcattcaaccaactggacagatttgaactctcctgctttattacagggagaaaatttattaccttttgcccggtaaatggggggg

SEQ ID NO: 16021 - DNA, 670 bp, Zea mays
  misc_feature: Ceres CLONE 1379387-F
  misc_feature: Encodes the peptide sequence at SEQ ID NO. 16022
gctcagaatagtggtcccccgggctgcaggaattcgcacgagaccattacctagaacatcctaatcgaaaaacagaaatccagtcggcggggctggcggctggcgcatcctcccctcgcccaccggcgacgacttgatcccctcccaccggtgagggcgcctcctcacggcagcgagccagcgactcctctcttcttcgtctcctacaagtagccagacaccactccgactttgccggcaacccgtcgacagcgacgaggcgcagcataaggcatacgggcacggcggccatggcgaccagctccaaacccgccgcgcccgtggaccccatggtcgtgctcgcccacgagttccccgaggtggcattcgactacgacgagagggatgtagcgttgtacgcgctcggggttggtggctgcggcgatgacgccgtcgacgagaaggagcttcacttcgtgtaccacagggatgggcagccacacattaagacccttcctacttttgtttctttatttcccaacaagaacagcaatgggcttggatttgtggatgtggctgggcttaactttgatgcaagccttctactgcatggtcaacaatacatagagatctatagggcaatcccttcggatgccagtgttggaaacagggttaaagtagctgggtttgg

SEQ ID NO: 16022 - protein, 126 aa, Zea mays
  misc_feature: Ceres CLONE 1379387-F
MATSSKPAAPVDPMVVLAHEFPEVAFDYDERDVALYALGVGGCGDDAVDEKELHFVYHRDGQPHIKTLPTFVSLFPNKNSNGLGFVDVAGLNFDASLLLHGQQYIEIYRAIPSDASVGNRVKVAGF

SEQ ID NO: 16023 - DNA, 782 bp, Zea mays
  misc_feature: Ceres CLONE 1379388-F
  misc_feature: Encodes the peptide sequence at SEQ ID NO. 16024
  misc_feature (257)..(257): n is a, c, t, g, unknown, or other
  misc_feature (292)..(292): n is a, c, t, g, unknown, or other
  misc_feature (293)..(293): n is a, c, t, g, unknown, or other
  misc_feature (342)..(342): n is a, c, t, g, unknown, or other
aaagctggagctccccgcggtggcggccgctctagaactagtggatcccccgggctgcaggaattcgcacgagaccattacctagaacatcctaatcgaaaaataagaaaaaaacacacacacacacacacacaaagcgcacttttcaaatcgacaaaggggaaaggttcgcttcttctcgcatcttgctttacttcgagtgccatggccgatccggcggaggagaacgttgtctcgccgccaccgacccctgcggncccagccgtgggcgcctcagactcgcccctgcagnnctgtgctgacggcgcctcaaacgagaaagtgtctgccccggcgcccgangtaaagtcccgggggatcaggcttcttggaaagaacacttcgtgcaccaatcccttggggcgggaaaactgctgacgttctggaaggaaaaaacaaaaaactctcggtgtggaaaaggcgggcaaacttgcttcggggttctttccaaaaggttttataacccccccggcccggagaaccccggagggaggggggggttgcgccctttacccgggggggcaaaaaacccctttttttaaaaaaaccccccccgtttttcccaagggggggtttttgagcccctttggggaattttctcccgtatttaaaagaaaaaaaaaaaaggttttttcttttctcgggaaaaaagggggggggaaacaaaaaaatttttttggggaaaagggttttttctctccccccccgaggagaaggagggcctcttcccccccctcactctc

SEQ ID NO: 16024 - protein, 70 aa, Zea mays
  misc_feature: Ceres CLONE 1379388-F
  misc_feature (18)..(18): Xaa is any aa, unknown, or other
  misc_feature (30)..(30): Xaa is any aa, unknown, or other
  misc_feature (46)..(46): Xaa is any aa, unknown, or other
MADPAEENVVSPPPTPAXPAVGASDSPLQXCADGASNEKVSAPAPXVKSRGIRLLGKNTSCTNPLGRENC

SEQ ID NO: 16025 - DNA, 653 bp, Zea mays
  misc_feature: Ceres CLONE 1379393-F
  misc_feature: Encodes the peptide sequence at SEQ ID NO. 16026
  misc_feature (542)..(542): n is a, c, t, g, unknown, or other
  misc_feature (543)..(543): n is a, c, t, g, unknown, or other
  misc_feature (607)..(607): n is a, c, t, g, unknown, or other
gctctagaactagtggatcccccgggctgcaggaattcgcacgagaccattacctagaacatcctaatcgaaaaagattagtcacactacttcgcaagcaaaaaaaaaaaaaaaaaatccccaaatttcggataagcctcgccggcgacgaaatcagggtttcatcgaacaacaagatggctcacgcttgcgtctccacatcagcttcctctctcaggttcacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatggctggactccggagactccttcacctcaaggagtttggtccatcagagatgatttacaagtcccttcttcgccgtattttcctgtgtacgctcaaggacaaggaccacctcctatggtgcaagagcgtttccagagtatcataagccagctcttccaatataggattattccnntggggccgggggctgtggatgatgatatggccaacataatcgtagctcagcttcttaccctcgnatgctgttgatcctactaagggaatttggctatgtatgtgactctc

SEQ ID NO: 16026 - protein, 146 aa, Zea mays
  misc_feature: Ceres CLONE 1379393-F
  misc_feature: SWISSPROT Homolog: EC 3.4.21.92 Endopeptidase Clp
  misc_feature (123)..(123): Xaa is any aa, unknown, or other
  misc_feature (144)..(144): Xaa is any aa, unknown, or other
MAHACVSTSASSLRFTAGFVSASPNASSFDSQKLSLPFEPLRSRKTKKLVSGRKTAPKAVYSGNGWTPETPSPQGVWSIRDDLQVPSSPYFPVYAQGQGPPPMVQERFQSIISQLFQYRIIPXGPGAVDDDMANIIVAQLLTLXCC

SEQ ID NO: 16027 - DNA, 693 bp, Zea mays
  misc_feature: Ceres CLONE 1379394-F
  misc_feature: Encodes the peptide sequence at SEQ ID NO. 16028
  misc_feature (377)..(377): n is a, c, t, g, unknown, or other
  misc_feature (392)..(392): n is a, c, t, g, unknown, or other
  misc_feature (403)..(403): n is a, c, t, g, unknown, or other
  misc_feature (455)..(455): n is a, c, t, g, unknown, or other
  misc_feature (461)..(461): n is a, c, t, g, unknown, or other
  misc_feature (549)..(549): n is a, c, t, g, unknown, or other
  misc_feature (550)..(550): n is a, c, t, g, unknown, or other
  misc_feature (660)..(660): n is a, c, t, g, unknown, or other
aagctggagctccccgcggtggcggccgctctagaactagtggatcccccgggctgcaggaattcgcacgagaccattacctagaacatcctaatcgaaaaactgcttcctagcttcgttcgttccggagcgccagagagagaaagaaaaggaaaagaagcgcctttgcccaccgcgcgatcaatcaatccggggtccggcggcctgccatggtgaagctggcgacggccagggaggcgcggctgtacgggccggcgctggcggcaaggcggtgggagtacatcaacgcgggaacatacgtgttcgcggcgctgctcctggtcctggcggcggcgctgtccatgtccgtgtccggcggccagggcggggcctcgccngtaagcgcccgtggncgctggcgggncgtgggcggccgtcaaacgcgcacgaacctcgccgcggcaccctgggctggncgtcgnactgggcgccgtgggaactgggcgaaggtacgatggccccagctcgggcttcggtggaagttcctcgttggccggccgtgcaccgcannccgggttggcgcgcttcggcggccggccggcctgggggggttgctgggccccccccccactttcccaggccccagcagaggggaacgcggggggaccatggctgtgtcgntcgcgggggctttgtttttgggggtgccttgga

SEQ ID NO: 16028 - protein, 161 aa, Zea mays
  misc_feature: Ceres CLONE 1379394-F
  misc_feature (65)..(65): Xaa is any aa, unknown, or other
  misc_feature (114)..(114): Xaa is any aa, unknown, or other
  misc_feature (151)..(151): Xaa is any aa, unknown, or other
MVKLATAREARLYGPALAARRWEYINAGTYVFAALLLVLAAALSMSVSGGQGGASPVSARGRWRXVGGRQTRTNLAAAPWAGRRTGRRGNWAKVRWPQLGLRWKFLVGRPCTAXRVGALRRPAGLGGLLGPPPTFPGPSRGERGGTMAVSXAGALFLGVPW

SEQ ID NO: 16029 - DNA, 715 bp, Zea mays
  misc_feature: Ceres CLONE 1379395-F
  misc_feature: Encodes the peptide sequence at SEQ ID NO. 16030
  misc_feature (477)..(477): n is a, c, t, g, unknown, or other
  misc_feature (574)..(574): n is a, c, t, g, unknown, or other
  misc_feature (585)..(585): n is a, c, t, g, unknown, or other
  misc_feature (586)..(586): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (613)..(613): n is a, c, t, g, unknown, or other
  misc_feature (715)..(715): n is a, c, t, g, unknown, or other
tccccgcggtggcggccgctctagaactagtggatcccccgggctgcaggaattcgcacgagaccattacctagaacatcctaatcgaaaaatccgcgtcactcaccagtctcctcccctaatcccactccgccgccgccagcttgcccatggcggcgacaacccacgccgcctccatgtcgttcctcctctctcacccccagtcgcgctctgccaccccaagccgccacctcccgctccgtccggcagcccgccgcgtccagtgcgccaccgacgccgccgccctttccccggcggtcaccaccaagcaccggcgcgcggcggatgagaacatccgcgaggaggcggcgcggcacccggccccgaagcagggcctggtcggcgtggtacgagcccttcccgccggccccgaacggcgaccccaacgagcgctactcccctggacgagattcgtgtaccggtccaagctcggggggncctcctcgacgtgcggacggacattgggaggcgctgccccggctttctccgggcggcctactgggcgcgacctcttcgaactcccgcatcgggcgancactggggcgnnacggggnnncccggggtgggccccacnaaaggggagatttcggtgttcccccgaagacggagcccgaccacttcgtctcccccgggttcgagggcaactcgaaaacctgttctggggcccagagcggcn

SEQ ID NO: 16030 - protein, 188 aa, Zea mays
  misc_feature: Ceres CLONE 1379395-F
  misc_feature (110)..(110): Xaa is any aa, unknown, or other
  misc_feature (142)..(142): Xaa is any aa, unknown, or other
  misc_feature (146)..(146): Xaa is any aa, unknown, or other
  misc_feature (149)..(149): Xaa is any aa, unknown, or other
  misc_feature (155)..(155): Xaa is any aa, unknown, or other
MAATTHAASMSFLLSHPQSRSATPSRHLPLRPAARRVQCATDAAALSPAVTTKHRRAADENIREEAARHPAPKQGLVGVVRALPAGPERRPQRALLPWTRFVYRSKLGGXSSTCGRTLGGAAPAFSGRPTGRDLFELPHRAXTGAXRGXPGWAPXKGRFRCSPEDGARPLRLPRVRGQLENLFWGPER

SEQ ID NO: 16031 - DNA, 522 bp, Zea mays
  misc_feature: Ceres CLONE 1379397-F
  misc_feature: Encodes the peptide sequence at SEQ ID NO. 16032
  misc_feature (358)..(358): n is a, c, t, g, unknown, or other
aagctggagctccccgcggtggcggccgctctagaactagtggatcccccgggctgcaggaattcgcacgagaccattacctagaacatcctaatcgaaaactttttcctagggtttcgtcgcttccagccgccgccgcgtccgcctcgccaagcgcagcagccgccgcagcacatctctctctcgatctcagccatggcggaggtggagcagcaacaggacacgccgaagctgtcaccgctggaccttcgatgatgtccaggtgaacgacatctcgctgaacgactacctcgctgtgaacgcgacgaagcacgcgatgtacctgccgcacaccgggggcggtactcccagaagcggntccccaaaggccaaggggcccatcgcaagcgctaaaactcctcatgatgccggcgcacaacgcaaaagggcaggttgcccaatcttaggaaacccggaaaaaattccctgtcaccagggcaacccttccagggggggccgaggggatttcaaaggggccccggg

SEQ ID NO: 16032 - protein, 68 aa, Zea mays
  misc_feature: Ceres CLONE 1379397-F
MYLPHTGGGTPRSGSPKAKGPIASAKTPHDAGAQRKRAGCPILGNPEKIPCHQGNPSRGGRGDFKGAP

SEQ ID NO: 16033 - DNA, 651 bp, Zea mays
  misc_feature: Ceres CLONE 1379399-F
gctctagaactagtgggtcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctggtgatcaaccctgccgcgtccgtattatgcacgccaggtcctggacgcgccctccctgcaggacgacttctatctcaacctcgtcgactggtcctcgcagaacgtgctcgctggcggcctcggcacctgcgtctacctctggtccgcgtccaatagcaaggtcaccaagctctgcgatttgggggctagggacagcgtatgcgcagtgcattggtcacgggaaggctcttatctttccattggcaccggccttggagatggccagatttgggatagttctcgttggaagcggattagaaatatg

SEQ ID NO: 16034 - DNA, 679 bp, Zea mays
  misc_feature: Ceres CLONE 1379404-F
  misc_feature: Encodes the peptide sequence at SEQ ID NO. 16035
  misc_feature (351)..(351): n is a, c, t, g, unknown, or other
  misc_feature (414)..(414): n is a, c, t, g, unknown, or other
  misc_feature (514)..(514): n is a, c, t, g, unknown, or other
  misc_feature (515)..(515): n is a, c, t, g, unknown, or other
  misc_feature (578)..(578): n is a, c, t, g, unknown, or other
cgcggtggcggccgctctagaactagtggatcccccgggctgcaggaattcgcacgagaccattacctagaacatcctaatcgaaaaatggcaactagcatgtatgtcactcacaccaggggagaccgactaagatttgtgagggtgatccgcgctgagaagagatggctaagatcgccgcggcggcggcggcgtcgctgtgcttcgcggccctggtggccgcggccgcctgccaaggggaggtcgagcggcataggctcagggacctgcagaggtggcaggaggtccaggagagcccgctcgacgcgtgccgccaggtcctcgaccggcagctaaccggtgaggtgcccnaccgtgcggcgttggcccgattccggagacccaccggcctccaggatgctcagctgcccttanctccaggacgagaaggcgcgagagccgctgcgtctccactgcgtgagcatgcgccggggcatagaacgagctaatggcgacgctgaagaacggtaggggnncccggggaaggatccgtgaagccgaatgtggacgggtgatggccagatcaacctacggatgangttcgtgaaaggtgagtgatggccaagtgagatatggcccgccgattttttaagctagttcctcgtcctgatggtagcaaccttagtctagcttttggaga

SEQ ID NO: 16035 - protein, 107 aa, Zea mays
  misc_feature: Ceres CLONE 1379404-F
  misc_feature (63)..(63): Xaa is any aa, unknown, or other
  misc_feature (84)..(84): Xaa is any aa, unknown, or other
MAKIAAAAAASLCFAALVAAAACQGEVERHRLRDLQRWQEVQESPLDACRQVLDRQLTGEVPXRAALARFRRPTGLQDAQLPLXPGREGARAAASPLREHAPGHRTS

SEQ ID NO: 16036 - DNA, 672 bp, Zea mays
  misc_feature: Ceres CLONE 1379404-R
  misc_feature: Encodes the peptide sequence at SEQ ID NO. 16037
ccgattgggtaccgggccccccctcgaggtcgacggtatcgataagcttttttttttttttttttctttttttttttttttttttttttttttttttttttttttttttttttttttttttttttttttttttttttttttttttttttttttttaaccggggaaaattcccaaatttttcccccaaagtttttatcatttttggaaaaaaacccccaaaaatttgggagcccccccaaaaacaacctcttttgggatttgcccccccaaaaaaaaaagggggggttttgcccccccccccaaccccttttaaccagggaaacaaaaacgggccccccccgaaaaaaaagctcccccccggggggcccaaaagccgggaaataatgggaaaccccggggggaacccccgggccttttaaagccccacggggcaaaaccttggcccccccccgggggggccgggaaaaaccggggaaaaaatttgccgggggccacccggacggaaaccgtatccctcccctggccggttggaggggaaaaaaaaccccccctgtccccctccttttccttgtgggggggggttgctttttccccccccatggccaccagcctttttccggggggggaagggcctcctcaaaccccaaaaaaatgctccgggaggggggcccc

SEQ ID NO: 16037 - protein, 138 aa, Zea mays
  misc_feature: Ceres CLONE 1379404-R
DWVPGPPSRSTVSISFFFFFFLFFFFFFFFFFFFFFFFFFFFFFFFFFFFFNRGKFPNFSPKVFIIFGKKPPKIWEPPQKQPLLGFAPPKKKGGVLPPPPTPFNQGNKNGPPPKKKLPPGGPKSREIMGNPGGNPRAF

SEQ ID NO: 16038 - DNA, 663 bp, Zea mays
  misc_feature: Ceres CLONE 1379410-F
  misc_feature: Encodes the peptide sequence at SEQ ID NO. 16039
  misc_feature (626)..(626): n is a, c, t, g, unknown, or other
tggcggccgctctagaactagtggatcccccgggctgcaggaattcgcacgagaccattacctagaacatcctaatcgaaaatttttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaaagagagtggtgtttctcaagcagctcaagtctggcctgctccttatctctgggcctttcaggatcaatgggagaccccgatccgccgtgtgaaccagacctatgtcattgctacatcaaccaaagttgacatctctggggtggtgatggtcgccaagttttgatgacaagtactttgcccagggagaaagaagcagaaagggtgagnaagaccgagggggcgagcttttttgagaacagaaaag

SEQ ID NO: 16039 - protein, 144 aa, Zea mays
  misc_feature: Ceres CLONE 1379410-F
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTVLILLAGRFMGKESGVSQAAQVWPAPYLWAFQDQWETPIRRVNQTYVIATSTKVDISGVVMVAKF

SEQ ID NO: 16040 - DNA, 677 bp, Zea mays
  misc_feature: Ceres CLONE 1379412-F
  misc_feature: Translation starting site: 146
  misc_feature: Pfam Name: Ricin_B_lectin Pfam Description: Ricin-type beta-trefoil lectin domain
  misc_feature (453)..(453): n is a, c, t, g, unknown, or other
  misc_feature (487)..(487): n is a, c, t, g, unknown, or other
  misc_feature (574)..(574): n is a, c, t, g, unknown, or other
  misc_feature (595)..(595): n is a, c, t, g, unknown, or other
  misc_feature (598)..(598): n is a, c, t, g, unknown, or other
  misc_feature (599)..(599): n is a, c, t, g, unknown, or other
  misc_feature (645)..(645): n is a, c, t, g, unknown, or other
cgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagccngaccaagggaacgcggtcggggctgtggacgagnaagcaaggacgtgggcaagggcttccgctgcatccgcatggtcaacaacacccgcctcaacttcgacgccttccacggcgacaggancaccggggggggggtgccganggnnaacccgcgtcgtggtcttttgggaagtggtgcaagggcgagaacanaagctgaagatcctcggggccgtgggggtccc

SEQ ID NO: 16041 - DNA, 662 bp, Zea mays
  misc_feature: Ceres CLONE 1379413-F
  misc_feature: Encodes the peptide sequence at SEQ ID NO. 16042
cgcggtggcggccgctctagaactagtggatcccccgggctgcaggaattcgcacgagaccattacctagaacatcctaatcgaaaaattagggagttttcttctcccgtccaccttgcgtgctcgcgcgcgagctctcgtggcgcagccacaactaggcgaccgccgccgcccctacgccacgtgctcgagtctagcctcgtcgattacttccccagtttaattgatctacaagcttcagaacatgttcaagaatacatttcagtctgggttcctgtccattctttatagcctcgggaccaagccattgcagatatgggataaggaagttgtgaatgggcacattaaacgaccccaagatgaagatatccaatctaatgtacttgaaattgttggaacaaatgtacagtcaacttacatcacatacccagctgatccttctgctactcttgggattaagcttccatttctggctattattgtgaaaaatcttaagaaatacttcacgttggaagatcccaggttctgatggacagaaaatgtccggacgtcgatttcgagcatcaaattttcatctgtcaccaagggtgaagccatatatctgcaccgatgccgtggaaacctccgacgatggctggaacaaacatccagtggaaactttg

SEQ ID NO: 16042 - protein, 94 aa, Zea mays
  misc_feature: Ceres CLONE 1379413-F
  misc_feature (1)..(95): Pfam Name: DUF667 Pfam Description: Protein of unknown function (DUF667)
MFKNTFQSGFLSILYSLGTKPLQIWDKEVVNGHIKRPQDEDIQSNVLEIVGTNVQSTYITYPADPSATLGIKLPFLAIIVKNLKKYFTLEDPRF

SEQ ID NO: 16043 - DNA, 710 bp, Zea mays
  misc_feature: Ceres CLONE 1379416-F
  misc_feature: Encodes the peptide sequence at SEQ ID NO. 16044
  misc_feature (299)..(299): n is a, c, t, g, unknown, or other
  misc_feature (330)..(330): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (440)..(440): n is a, c, t, g, unknown, or other
  misc_feature (455)..(455): n is a, c, t, g, unknown, or other
  misc_feature (538)..(538): n is a, c, t, g, unknown, or other
  misc_feature (544)..(544): n is a, c, t, g, unknown, or other
  misc_feature (587)..(587): n is a, c, t, g, unknown, or other
  misc_feature (594)..(594): n is a, c, t, g, unknown, or other
  misc_feature (600)..(600): n is a, c, t, g, unknown, or other
  misc_feature (615)..(615): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggagngacctgcggtggtgcaagcaggcgtgcgagtggcagtacggaaaggacccccgcggaagagggatgcnnnagagcgagtgccgcgagcggcaccagcaagctgacgcggngcgaggacgggaccngccggcgtggacgcctacgtctcccgctcggaaaagggggggaagaaggggccggcgccagtgcctgcgcccgccacgagggnccaggnccgtggagaaacccagagggccttggagggcggtgccgccggnccgcggnactggnccgtcgactgggagnaaaaaaagttacgggtccgcggcagccgagagccgcgggcaaagtggccccggaaaaagaggtgcgagcgccaccacccgcggggggatttgggg

SEQ ID NO: 16044 - protein, 158 aa, Zea mays
  misc_feature: Ceres CLONE 1379416-F
  misc_feature (22)..(22): Xaa is any aa, unknown, or other
  misc_feature (32)..(32): Xaa is any aa, unknown, or other
  misc_feature (55)..(55): Xaa is any aa, unknown, or other
  misc_feature (56)..(56): Xaa is any aa, unknown, or other
  misc_feature (69)..(69): Xaa is any aa, unknown, or other
  misc_feature (74)..(74): Xaa is any aa, unknown, or other
  misc_feature (102)..(102): Xaa is any aa, unknown, or other
  misc_feature (104)..(104): Xaa is any aa, unknown, or other
  misc_feature (118)..(118): Xaa is any aa, unknown, or other
  misc_feature (127)..(127): Xaa is any aa, unknown, or other
MVGVPPARRRAAGRSSHGRGGXTEWSNGTARXDLRWCKQACEWQYGKDPRGRGMXXSECRERHQQADAXRGRDXPAWTPTSPARKRGGRRGRRQCLRPPRGXRXVEKPRGPWRAVPPXRGTGPSTGXKKSYGSAAAESRGQSGPGKRGASATTRGGIW

SEQ ID NO: 16045 - DNA, 654 bp, Zea mays
  misc_feature: Ceres CLONE 1379424-F
  misc_feature (336)..(336): n is a, c, t, g, unknown, or other
ggagctccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctggtaccccgtcccctgcagcctgtgctctgggatgcaggcagatgagctgcaatgcatcgcgtaggacgcgaggagatgctagtcagattgggcgagtaatacacttgcatagctgagcttgcttctcctggcggagcacgtcttccgccctcgncgggtccggtgaaggtaggcctgctcaccaatgaagactctgagaagcactctgcgtcgcctttgtacaatctgcctctgtcgctgagggagatcgacgtccctgactgactgatcacgggacgttagactcatttcgaaggccacaccaggggggcatgatcctgattgctcccatggagaccatggcgctggggtaggcaatgttgctacttttgttgaggggggggacatggacaaggctccgagtatgatatcacattcactgctagccgggactgggaccaaaggaggtactggaagtttccgccgtagggag

SEQ ID NO: 16046 - DNA, 646 bp, Zea mays
  misc_feature: Ceres CLONE 1379426-F
  misc_feature: Encodes the peptide sequence at SEQ ID NO. 16047
  misc_feature (317)..(317): n is a, c, t, g, unknown, or other
  misc_feature (646)..(646): n is a, c, t, g, unknown, or other
aagctggagctccccgcggtggcggccgctctagaactagtggatcccccgggctgcaggaattcgcacgagaccattacctagaacatcctaatcgaaaagcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtggaaaaccaattcttcancccttacaggatccaccaggcaaatcacagctgggatccttacctttatcaccctggtccttccacaatcatcagccctattaaatcaggtaccttggggggatttatttggaccaaacatcaggcccacaactacaacaactgggttacaaactttgttgctacttttagaaaaggaatttctttctttccaccattaattggttgaaccctgcttcccaatttgaaaaaaaaaaatataaccttttagccggttacctggtggccaaaccccaaaaaattttttcccattaacccaaagtgggaaattttaaccccccccggtttan

SEQ ID NO: 16047 - protein, 81 aa, Zea mays
  misc_feature: Ceres CLONE 1379426-F
  misc_feature (54)..(54): Xaa is any aa, unknown, or other
MAAKIFCLLMLLGLSASAATATIFPQCSQAPIASLLPPYLSPAVSSVCGKPILXPLQDPPGKSQLGSLPLSPWSFHNHQPY

SEQ ID NO: 16048 - DNA, 664 bp, Zea mays
  misc_feature: Ceres CLONE 1379430-F
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (593)..(593): n is a, c, t, g, unknown, or other
  misc_feature (597)..(597): n is a, c, t, g, unknown, or other
  misc_feature (599)..(599): n is a, c, t, g, unknown, or other
  misc_feature (606)..(606): n is a, c, t, g, unknown, or other
  misc_feature (607)..(607): n is a, c, t, g, unknown, or other
  misc_feature (623)..(623): n is a, c, t, g, unknown, or other
  misc_feature (629)..(629): n is a, c, t, g, unknown, or other
  misc_feature (630)..(630): n is a, c, t, g, unknown, or other
  misc_feature (640)..(640): n is a, c, t, g, unknown, or other
  misc_feature (664)..(664): n is a, c, t, g, unknown, or other
aaagctggagctccccgcggtggcggccgctctagaactagtggatcccccgggctgcaggaattcgcacgagaccatacctagaacatcctaatcgaaaaacgattccttccgttccatctccaccggctaaactgccctcgcctccgatcgaacagacgttcctcctccgtcgccgccgcggccgtttgatcctccttgcgagtccgaacctccccacgacggcacgcggccggatccagatcgggagtactccccactccccgcgcttctccttcgcatcacaagcggcccggccccagaccctagcggatcgatctcgcgcggcgccgtgccggagatgatgtcgtcgtcgtcggacgcggcagcggcgctggactgcagatccgggttgggaaggactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnncnnncnnnnnccccccccccccncccncnccccccnncccccccccccccccncccccnncccccccccncccccccccccccccccccccccn

SEQ ID NO: 16049 - DNA, 709 bp, Zea mays
  misc_feature: Ceres CLONE 1379436-F
  misc_feature: Encodes the peptide sequence at SEQ ID NO. 16050
  misc_feature (558)..(558): n is a, c, t, g, unknown, or other
  misc_feature (632)..(632): n is a, c, t, g, unknown, or other
  misc_feature (644)..(644): n is a, c, t, g, unknown, or other
  misc_feature (645)..(645): n is a, c, t, g, unknown, or other
tggagctccccgcggtggcggccgctctagaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagcgcacagagcagccccgactcccggcccgatccgcgctctcctctccgtcgcttcagtcatggcaggaatggcacctgagggttctcagttcgatgctaagcactatgattctaagatgcaggagctgctgagcactggtgagactgaggagttcttcacttcatatgatgaagtttttgagagttttgatgatatgggcctccaagagaatcttctgagaggcatttatgcttatggttttgagaagccctctgcaattcagcagagaggaattgttcccttctgcaagggtcttgatgtcattcagcaagcacaatctggtacaggaaagacagcacccttctgtttctggatcttgcagcagctggactaatggctggnttgatggcaggccctggtccttgctcccacccgtgagcttgcacagcaaattgagaagtcatgcgggcgctggnggatactttggnngtagggccatgcatgggtgggagggacatccgtccgggaggacaagggatcttggagggggggt

SEQ ID NO: 16050 - protein, 104 aa, Zea mays
  misc_feature: Ceres CLONE 1379436-F
MAGMAPEGSQFDAKHYDSKMQELLSTGETEEFFTSYDEVFESFDDMGLQENLLRGIYAYGFEKPSAIQQRGIVPFCKGLDVIQQAQSGTGKTAPFCFWILQQLD

SEQ ID NO: 16051 - DNA, 716 bp, Zea mays
  misc_feature: Ceres CLONE 1379444-F
  misc_feature: Encodes the peptide sequence at SEQ ID NO. 16052
  misc_feature (317)..(317): n is a, c, t, g, unknown, or other
  misc_feature (400)..(400): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtacatcgagcacgtccgacggncatgagggcttgctgtttgaagctcttcgtgagggccttgatggaagagatggaattaaaatcccacaggggggtgaatttgntgaagaatgtgggccattacgggtgggtcttaccagggggacaaaagggtttggcttgatacgtttggaagacctttcgaggtcctgaacaccccctatggcggagaaacttcgtttacctggcattggngagttggaaccgggaatgaaaagggctgagggccccgccgttgaaaggaatgaaccatgggaatccctgcttccttggttaacaaccagattcccaaataactggggggaatgggttaattaaccctttcccggggggccaggtccaaaaatccccctttgggaatccgtggggcccccggtgggg

SEQ ID NO: 16052 - protein, 106 aa, Zea mays
  misc_feature: Ceres CLONE 1379444-F
  misc_feature (60)..(60): Xaa is any aa, unknown, or other
  misc_feature (88)..(88): Xaa is any aa, unknown, or other
MATAFSLRAAAPATAPRAVSRSTSAARVVPVASALAGRGRLVARAAVTAKADVHRARPTXMRACCLKLFVRALMEEMELKSHRGVNLXKNVGHYGWVLPGGQKGLA

SEQ ID NO: 16053 - DNA, 724 bp, Zea mays
  misc_feature: Ceres CLONE 1379446-F
  misc_feature: Translation starting site: 440
  misc_feature: SWISSPROT Homolog: EC 2.5.1.67 Chrysanthemyl diphosphate synthase
  misc_feature (339)..(339): n is a, c, t, g, unknown, or other
  misc_feature (724)..(724): n is a, c, t, g, unknown, or other
aggggggggctccccggggggggcggccgctctagaactagtggatcccccggggctgcaggaattcgcacgagaccattacctagaacatcctaatcgaaaaaccctgctgtctccctccctccttccttccttcccccgccactgcgcagcgcgagtgcggcgacgggcagtcacacactcacactccctcggaccgctctcgggcccgtccgcgtcgccgcagggcgaggaggcaatggcggggggcgagaatggcgccgggcgggacaccaggggggccttcgcgcggatctacaagacgctcaaggagggggctgctcaccgacccgggcttcnagggcaccgaggagtcacgccaggggatcgaccgcatgggtgacgggggggggtcggaggcaggtgtaaccgtggggctctctgggggcgacagggtacaatgtggtcaggggggggtgatgctctgggggaggagggaaaggttcttggttgcagcctcgggtggggcattgggtggcttcgggctgtctgtcttgggcttgaggatatcatggatgactcgcgcaccgcggggggggcagccctggtgggggcaggggggcctcacggtgggcttagttggtggggagggaggggaagatccttgggcaggcataacggcgcgggtgcgcgttcgcggcgcctttagggggcaggcctgactaatgcggggcgcccctggagn

SEQ ID NO: 16054 - DNA, 694 bp, Zea mays
  misc_feature: Ceres CLONE 1379447-F
tccccgcggtggcggccgctctagaactagtggatcccccgggctgcaggaattcgcacgagaccattacctagaacatcctaatcgaaaaattggggcaggatcccgcgatggctcccagctcggtggcgtggaacccgtccgtggcgcccgcgaggccgaggtcgagctcggtgagcgccgcggctgctgccgggtgcgctgcgagcgccggcccgatgtcctccgtccagcagtagaactcggagaggtcgagcgccctgagcgctgggcagtccccgaggagcggctcgagatccgcgccggcgtcgaggcccggcgggcgctggtgccagcgcacgagcttgacgctgcggaggcgggacctccagtgcggggtgaggctgacgagcgtggtggggtcgcggcagtagacggcgagcgaggacacggcggggaagcagtaggcgaggcgcgccgcgaccagctcgttctgctccgcgacctgctgcggcgtcacggacggcgcgacggcgtcggccgacggcgccgcggaggagaggaacggttggccccacggggacgccagcgagaggtcgagccgctccagcgccgggaagcaaacgccggcctgaggaagatgaacgcgggcgaccgtgggtccccgcgcagcgacagcgcggcccgtgtgcccgctccgccgcgagaggcggcg

SEQ ID NO: 16055 - DNA, 745 bp, Zea mays
  misc_feature: Ceres CLONE 1379449-F
  misc_feature (300)..(300): n is a, c, t, g, unknown, or other
  misc_feature (368)..(368): n is a, c, t, g, unknown, or other
aagctggagctccaccgcggtggcggccggctctagaactagtggatcccccgggctgcaggaattcgcacgagaccattacctagaacatcctaatcgaaaaaacaacggtcaagggcctagctatttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggnccgcctcctctctgttcgttctgtcttggtcgccgaagctcaagaccacagtgtcaggaagttctccnatcttcgagggggaggcaatcatcagtcagatacactttgacggaggaattattcaaaatcactcccgaaaggatcggcttttcgaagctagagaagcaagctctaaccaacgggcagggacgctctcaaatccccagttcaaaactggctaactgtaagaaaagggaaaagaatggaaaacgcgggccttaaagggaaccccccgaaaagtggaaaaagaattggccctgaaaaccgtttggggggggggggcaaaggcaaattctctgccttggcccccccaacccaaaattttcccccccgcccccggggggcccgacccccagagggggtcttttttgggggaagggggtcttatgggaaaaaaacaattttt

SEQ ID NO: 16056 - DNA, 706 bp, Zea mays
  misc_feature: Ceres CLONE 1379453-F
  misc_feature: Encodes the peptide sequence at SEQ ID NO. 16057
  misc_feature (578)..(578): n is a, c, t, g, unknown, or other
ggagctccccgcggtggcggccgctctagaactagtggatcccccgggctgcaggaattcgcacgagaccattacctagaacatcctaatcgaagaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcgggactggcgctgacggcctccgtggtggggctggccgtggccacgccggtgttcctgatcttcagccccgtgctggtccccgccgcgctgctcatcgggacggacgtcatgggggtcctcacgtcgggcgcgctggggctcggtggcctgtcctcgctcacgtgcctcgccaacacggggcggnaggggttccagcgcacccgggactacggtggaggaggcgcaccgcagggatgtcggaaggcgcggcgcacgctgttcacaagactgcgcaggcaggccaggccatccagggcagggcgcaggaggccg

SEQ ID NO: 16057 - protein, 169 aa, Zea mays
  misc_feature: Ceres CLONE 1379453-F
  misc_feature (44)..(164): Pfam Name: Oleosin Pfam Description: Oleosin
  misc_feature (127)..(127): Xaa is any aa, unknown, or other
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTDVMGVLTSGALGLGGLSSLTCLANTGRXGFQRTRDYGGGGAPQGCRKARRTLFTRLRRQARPSRAGRRRP

SEQ ID NO: 16058 - DNA, 663 bp, Zea mays
  misc_feature: Ceres CLONE 1379454-F
  misc_feature (357)..(357): n is a, c, t, g, unknown, or other
aagctggagctcaccgcggtggcggccgctctagaactagtggatcccccgggctgcaggaattcgcacgagaccattacctagaacatcctaatcgaaaataactcctcaaggcacgatacagcacagtgctctctttccccgggaacatcaccacaacccagggtacacaggcaagcaacggagcggtgaacaacactgcagagaatcatcggagagatgctctggcttcgaaaatctggcacctggtgctgaacacgcggtctctgtccggggcctggtgatgaggcgccgcgcgctgacatacctcgccgaatctcgtcgccgctcgtagcagagtaccttcctcctcccggngtcccacccctaggagcatcctccagcacgagctcctgatgccaggacctcatttcgaccccttcgatgtcgataccgacccgacatctgggacttgagctgactacccgaacacatcgggatctgcggtgacgcgctcacccatttcgagtacaatgcgaagggcacgcatgacttgtctgacgagttcacaggctctcgtatcggatatcagaatatgaaaccaccagggagctcattatctgttatagagaaagaacgaatatgatggctacatttgagtacagagtaattaaaacccacacg

SEQ ID NO: 16059 - DNA, 718 bp, Zea mays
  misc_feature: Ceres CLONE 1379456-F
  misc_feature: Encodes the peptide sequence at SEQ ID NO. 16060
  misc_feature (316)..(316): n is a, c, t, g, unknown, or other
  misc_feature (330)..(330): n is a, c, t, g, unknown, or other
  misc_feature (349)..(349): n is a, c, t, g, unknown, or other
  misc_feature (404)..(404): n is a, c, t, g, unknown, or other
  misc_feature (405)..(405): n is a, c, t, g, unknown, or other
  misc_feature (449)..(449): n is a, c, t, g, unknown, or other
  misc_feature (450)..(450): n is a, c, t, g, unknown, or other
  misc_feature (510)..(510): n is a, c, t, g, unknown, or other
  misc_feature (512)..(512): n is a, c, t, g, unknown, or other
gctctagaactagtggatcccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggncaccagacgtcggncgagtcctggggtaccggncgcgccgtgtctcgtatcccccgcgtccccggggggcggcacccaccgcgccggnncagggagcgttcggcaacatgtggccgcggcgggcgcatgttcnncgccaccaagatctggcgcaggtgggaccggccgggttaacatcaaccttcggccgggtngncggtcgcctccgggggtcgccggcaccgggcggtcccggccctctgttcagggggggggggccaccgcgaattgaggcttgtccccgaaatggcccctgggcttttcggaactccggggggggccctttgggaaaaacccccccgggggctctaagaacctcaaagggaattggggccccacgcccaaccccgaagaagcccaaga

SEQ ID NO: 16060 - protein, 119 aa, Zea mays
  misc_feature: Ceres CLONE 1379456-F
  misc_feature (67)..(67): Xaa is any aa, unknown, or other
  misc_feature (92)..(92): Xaa is any aa, unknown, or other
  misc_feature (107)..(107): Xaa is any aa, unknown, or other
MVAVNRPLVSVKALEGDMVTDAPGIALPPVFGAPIRPDVVRFTHKLLSCNKRQPYAVSRRAGHQTSXESWGTGRAVSRIPRVPGGRHPPRRXRERSATCGRGGRMFXATKIWRRWDRPG

SEQ ID NO: 16061 - DNA, 677 bp, Zea mays
  misc_feature: Ceres CLONE 1379457-F
  misc_feature: Encodes the peptide sequence at SEQ ID NO. 16062
  misc_feature (428)..(428): n is a, c, t, g, unknown, or other
ggagctccccgcggtggcggccgctctagaactagtggatcccccgggctgcaggaattcgcacgagaccattacctagaacatcctaatcgaaaaatgttgaacagtcccaatgcttgtctcacacgctcagatccacaagatactaccccagaaccgctacaccaaaccgagacgctaacccaaacggacaaacccaatcagaccgaatgggcaccgcatcaccggactccggcgaccttatcgaggtggggccggcgaggccgggatctccggtagccgtggtgaccatcaaccggccttcggcgctcaacgcgctgacgaagcccatgatgatctccatggcggctgcgttccggcggctgggtgccgacgacgccgtggcagcggtggtgctcgcgggccgcggtcgcgcgttctgctccggngtggacctgacggcggcggcggaggtgttcaagggcgatgtgaaggacgtccccacggacccccgtccggcaaatggaagttccggcggaaaacccattggggggggccaatcgccgggggttcccccgcccgggggggggtttagagaaaccccccctccccgggggaaaaccccccgggggggggggggcccccccccccaattttttggcccccccccccgggggggggaaagtctttcccgcggg

SEQ ID NO: 16062 - protein, 156 aa, Zea mays
  misc_feature: Ceres CLONE 1379457-F
MGTASPDSGDLIEVGPARPGSPVAVVTINRPSALNALTKPMMISMAAAFRRLGADDAVAAVVLAGRGRAFCSGVDLTAAAEVFKGDVKDVPTDPRPANGSSGGKPIGGGQSPGVPPPGGGFRETPPPRGKTPRGGGGPPPQFFGPPPRGGESLSRG

SEQ ID NO: 16063 - DNA, 705 bp, Zea mays
  misc_feature: Ceres CLONE 1379461-F
  misc_feature: Encodes the peptide sequence at SEQ ID NO. 16064
  misc_feature (352)..(352): n is a, c, t, g, unknown, or other
  misc_feature (354)..(354): n is a, c, t, g, unknown, or other
  misc_feature (382)..(382): n is a, c, t, g, unknown, or other
  misc_feature (389)..(389): n is a, c, t, g, unknown, or other
  misc_feature (475)..(475): n is a, c, t, g, unknown, or other
tggagctccccgcggtggcggccgctctagaactagtggatcccccgggctgcaggaattcgcacgagaccattacctagaacatcctaatcgaaaaagtactcgacagtcgacacagcccctctgatatggctcaggcacgcgtgcgccttactccggccggccgcacgccggccgccacgttcctctcgggctccaaccccagacccgcccacctcaccttcttcccgaagcttacccctacctccctctccgccgccgcagctgcgaatgcgccgccgccccacatcgtcgtcgtgggctccgccaacgccgacatctacgtcgaggtcgaccgtctcccgctcatcgncnagaccgtggcggcccgcgcgggacgcancctcgcnggcggcaagggcgcaacccaggccgctgcggtgggccgctcgcgctgggcctaactacctcgtggcgcgcgtgggggatgacgccnacggccgactcctagagggcgccctaccgacgccggtggtgccccaccgaccggttccccggggggcggtgggccatcgggaacggcgtcgtttggtatggcccaagggaaactccttatcatcggggggggcgaaaatgggggctgggcgggggatcgtttcgggacttgaataatccaaaggaggctttttcttttaaagaaaaaaccattggccaccccgggggccg

SEQ ID NO: 16064 - protein, 104 aa, Zea mays
  misc_feature: Ceres CLONE 1379461-F
  misc_feature (75)..(75): Xaa is any aa, unknown, or other
  misc_feature (76)..(76): Xaa is any aa, unknown, or other
  misc_feature (85)..(85): Xaa is any aa, unknown, or other
MAQARVRLTPAGRTPAATFLSGSNPRPAHLTFFPKLTPTSLSAAAAANAPPPHIVVVGSANADIYVEVDRLPLIXXTVAARAGRXLAGGKGATQAAAVGRSRWA

SEQ ID NO: 16065 - DNA, 729 bp, Zea mays
  misc_feature: Ceres CLONE 1379466-F
  misc_feature: Encodes the peptide sequence at SEQ ID NO. 16066
  misc_feature (361)..(361): n is a, c, t, g, unknown, or other
  misc_feature (370)..(370): n is a, c, t, g, unknown, or other
  misc_feature (453)..(453): n is a, c, t, g, unknown, or other
tggagctccccgcggtggcggccgctctagaactagtggatcccccgggctgcaggaattcgcacgagaccattacctagaacatcctaatcgaaaaatcagtctcccctcccaaaaccggatttgcgaaccacacctagcagccgaggttagcacgcggcgcgtcctgcggccatggaggacgaggagcacgaggtgtacggccaggagattcccgttgacggcgaggacgtcgacatggctgccggcgacgatgccaccaagctgcaggaacttgacgatatgaagcgccggctcaaggaaatggaggaggaggccgccgcgctccgcgagatgcaggccaaggttgccaaggagatgncaggtgtanatcccaatgcgacccacatctgaaacaaggaggagatggattctcgggcagtattcatttggaatgtggactatgcgtgcacntccagaggagggcagcagcacttcatttctggtggactggccacggaggtaccatcctgactgacaggtttgggccccaaaagggtttggcttacggggattttgttgaagttgaggttgtcaggagcttttcaagttaaacgagtcaagtttgccggtccccaattcagggtggccccaaaaagaactaaggttcctgggataaaccaacccccggggcggggtttcatccggaccggggccccccccaatgggggggggggggttaaagccctt

SEQ ID NO: 16066 - protein, 72 aa, Zea mays
  misc_feature: Ceres CLONE 1379466-F
  misc_feature (63)..(63): Xaa is any aa, unknown, or other
  misc_feature (66)..(66): Xaa is any aa, unknown, or other
MEDEEHEVYGQEIPVDGEDVDMAAGDDATKLQELDDMKRRLKEMEEEAAALREMQAKVAKEMXGVXPNATHI

SEQ ID NO: 16067 - DNA, 539 bp, Zea mays
  misc_feature: Ceres CLONE 1379468-F
  misc_feature: Encodes the peptide sequence at SEQ ID NO. 16068
  misc_feature (394)..(394): n is a, c, t, g, unknown, or other
  misc_feature (395)..(395): n is a, c, t, g, unknown, or other
  misc_feature (418)..(418): n is a, c, t, g, unknown, or other
cgctctagaactagtggatcccccgggctgcaggaattcgcacgagaccattacctagaacatcctaatcgaaaaagcatttgtgctacgagggcttttgcaatggcggcttcggggttcggcggcggcgaggcgttccggctctcggccgcgccgggggccggcttactgaagctgcacaagggcgacatcaccctctggtccgtcgactgcgccaccgacgccatcgttaatgctgctaatgagcgaatgttaggtggcggaggtgttgatggagctatacattcagggctgctgggaccaaaacttaggggcaagcattgcccggaaaaattccccaaggggcaaaaccccgggggccccccggggggcccccctcgggggagaaaaaagnngggggaaaccccccccccgtgtnttttttatctcccgcccccgggggaaaaccccgggggcccctttattttttgcacaaacccccggggggggtataaaaaggcgcccaaaaaaaagggggttggggggagagaagggggccc

SEQ ID NO: 16068 - protein, 145 aa, Zea mays
  misc_feature: Ceres CLONE 1379468-F
  misc_feature (98)..(98): Xaa is any aa, unknown, or other
  misc_feature (106)..(106): Xaa is any aa, unknown, or other
MAASGFGGGEAFRLSAAPGAGLLKLHKGDITLWSVDCATDAIVNAANERMLGGGGVDGAIHSGLLGPKLRGKHCPEKFPKGQNPGGPPGGPPRGRKKXGETPPPCXFYLPPPGENPGGPFIFCTNPRGGYKKAPKKKGVGGREGG

SEQ ID NO: 16069 - DNA, 630 bp, Zea mays
  misc_feature: Ceres CLONE 1379469-F
  misc_feature: Encodes the peptide sequence at SEQ ID NO. 16070
gctctagaactagtggatcccccgggctgcaggaattcgcacgagaccattacctagaacatcctaatcgaaaaaaacccaccgatcgccgactaggcttcctcctctcccgctcaaactccggtcgctgaggtctaacccgagcgccgcgccgcagcgtcacgatggtgaacgacgccgcggcgatggtcgtcgtgagggcggagcgcccagccctccgtggcgcccacgatggcgtcgccttcgacgcccacgccgtcttcctggccgatggtactcgctctgcgccgtctccctgtcgagctcgacgactcctcgcccttatagatcacctacctgcgattgatgtctgcaacatcatgcacaattgttacgcctttttgtataggaaggtgcacatcgccaagaatatcaggctactagtgaactgtctgccgatcgatgaagtacttgcaattgatgtcttgcatcttgatctagcatatacgcgcgcttataatatccatattgctgcgacagacttctttgttcaatagagtctaggattattagcatatgtatacgatttttgaagtccattgacactgggactcaaatgtgtttgccattggtatgataccttccgggctg

SEQ ID NO: 16070 - protein, 123 aa, Zea mays
  misc_feature: Ceres CLONE 1379469-F
MVNDAAAMVVVRAERPALRGAHDGVAFDAHAVFLADGTRSAPSPCRARRLLALIDHLPAIDVCNIMHNCYAFLYRKVHIAKNIRLLVNCLPIDEVLAIDVLHLDLAYTRAYNIHIAATDFFVQ

SEQ ID NO: 16071 - DNA, 796 bp, Zea mays
  misc_feature: Ceres CLONE 1379476-F
  misc_feature: Encodes the peptide sequence at SEQ ID NO. 16072
  misc_feature (339)..(339): n is a, c, t, g, unknown, or other
  misc_feature (350)..(350): n is a, c, t, g, unknown, or other
  misc_feature (691)..(691): n is a, c, t, g, unknown, or other
tccccgcggtggcggccgctctagaactagtggatcccccgggctgcaggaattcgcacgagaccattacctagaacatcctaatcgaaaagcttcaatactagctcgctcaccactcaccagtcaccagtccagcaagcaacaacaaaggcgcaggaggaagcttgttttggaccgagcaagcgagccagccgagcgtgggagagagagagagaggaattaattgatgggcgaggaggccagctgcgacgccgtcagcctgacggaggccggcaccaacgccaagccggtgggcaaggagaacggccgcgagccggctgcggctcccgccgccgcggncgacccccggntgcagggcatctccggaggcatccgcgtcgtgccgcacttcccaaggcaggggatcatgttcaacgacttcaacacgctgctggtggcgccccagggggttcagggacgccgtcaaactggtccctcaaaggggtaccgggggatgggccatcaacccccctcccccggaattgaggcccggggctttcgggtgtccggcccggggaatccgccttggaaatttggggcctaaaataaaaccctcttgggaaagccaaggaaagccccccggggggggggtgtcccccaaaaaaaccctttcccaaaaaaaaaaatatttttccctcgaaagaaagttttnggggcccaccaaaaaaaccccgagggagggggttttttctcacctaaaacccctgttgtggacaggagaggaacacctctggggggggaaaaggggtattaaaaa

SEQ ID NO: 16072 - protein, 118 aa, Zea mays
  misc_feature: Ceres CLONE 1379476-F
  misc_feature: SWISSPROT Homolog: EC 2.4.2.7 Adenine phosphoribosyltransferase
  misc_feature (38)..(38): Xaa is any aa, unknown, or other
  misc_feature (42)..(42): Xaa is any aa, unknown, or other
MGEEASCDAVSLTEAGTNAKPVGKENGREPAAAPAAAXDPRXQGISGGIRVVPHFPRQGIMFNDFNTLLVAPQGVQGRRQTGPSKGYRGMGHQPPSPGIEARGFRVSGPGNPPWKFGA

SEQ ID NO: 16073 - DNA, 757 bp, Zea mays
  misc_feature: Ceres CLONE 1379478-F
  misc_feature: Encodes the peptide sequence at SEQ ID NO. 16074
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (17)..(17): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnnnccccccccccccncccacccccccccgcccccccccctctnnnnnnnnnaaagctggagctccccgcggtggcggccgctctagaactagtggatcccccgggctgcaggaattcgcacgagaccattacctagaacatcctaatcgaaaatcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggtaggaacatggtggcgccgctcctggtgctcaacctcatcatgtacatcatcgtcatcggcttcgcgagctggaacctgaaccacttcatcaacgggaaaaccaactaccccggcgtggccggcaacggcgccgacgttctactttcctggtgtccgcccatcctggcccggcggggttgggcgcgaccgcccaagcttggcggggcgtgcacccacgtgcgcgccctgggcgccaccgacaggcttggccccccaaacgcccgcggtggtctccttcattcggcctggggccaatccacgggggctcggcctttcggggtttggcccttggaaggggaaaaccc

SEQ ID NO: 16074 - protein, 119 aa, Zea mays
  misc_feature: Ceres CLONE 1379478-F
  misc_feature (14)..(101): Pfam Name: AWPM-19 Pfam Description: AWPM-19-like family
MAGIGRNMVAPLLVLNLIMYIIVIGFASWNLNHFINGKTNYPGVAGNGADVLLSWCPPILARRGWARPPKLGGACTHVRALGATDRLGPPNARGGLLHSAWGQSTGARPFGVWPLEGEN

SEQ ID NO: 16075 - DNA, 706 bp, Zea mays
  misc_feature: Ceres CLONE 1379483-F
  misc_feature: Encodes the peptide sequence at SEQ ID NO. 16076
  misc_feature (278)..(278): n is a, c, t, g, unknown, or other
  misc_feature (287)..(287): n is a, c, t, g, unknown, or other
  misc_feature (296)..(296): n is a, c, t, g, unknown, or other
  misc_feature (337)..(337): n is a, c, t, g, unknown, or other
  misc_feature (340)..(340): n is a, c, t, g, unknown, or other
  misc_feature (364)..(364): n is a, c, t, g, unknown, or other
  misc_feature (397)..(397): n is a, c, t, g, unknown, or other
  misc_feature (436)..(436): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacgnccggggcgnaggacggagtggtctaacgggacccgcaggaggacctgcgntgntgcaagcaggcgtgcgagtggcantacgaaaaggacaccccgcgaaagaggaatgcnagagcgagtggctcgagcggcacatcaagctgaccgggncgaggacgggaaaggcggggtggaccctactttcccgttcccgaaaggggagagggcccggcccagtgcttggccccccacgaggccccaccgggggaaaacccagaggtgtttagggggggccccccccccgaaatggccttaaaattaaaaaaaaaacacccccccgcaaaaaagagccgggaaatagccccggggagggggagggcccccccccccggggaaatttgggtggaaagagccctcctctttgggggtaaaaagggggga

SEQ ID NO: 16076 - protein, 34 aa, Zea mays
  misc_feature: Ceres CLONE 1379483-F
  misc_feature (24)..(24): Xaa is any aa, unknown, or other
  misc_feature (27)..(27): Xaa is any aa, unknown, or other
  misc_feature (30)..(30): Xaa is any aa, unknown, or other
MGKGSVGASWWAFLLLAGVLLVVXATXGAXDGVV

SEQ ID NO: 16077 - DNA, 656 bp, Zea mays
  misc_feature: Ceres CLONE 1379485-F
  misc_feature: Encodes the peptide sequence at SEQ ID NO. 16078
  misc_feature (656)..(656): n is a, c, t, g, unknown, or other
tcagaactagtggatcccccgggctgcaggaattcgcacgagaccattacctagaacatcctaatcgaaaaaaaagagtgtgtgctgtgtgttatccatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcggccatgcgctcgcgcttgcgcttgggcccccctcgcagcgaccgcagcaaggggcactcgtcagcctcaagccttgcggctcactggcaccacaagctcctctgtggcgcgcggagtcgaatgccgcggggggtggtgccgccgccggcgatgtcatgggcctcctcctccgggagcgcatagtcttcctcggcaacgagaatcgaggacttccttcgcggacggcgtcgtcagccagctcctccctccttgacgccatcgacccggactctgacatccgcctcgtcgtcaactcaccaggggggatccccttaccgcaacaatgggccatctatggatgtaatggagcttggggaggccagacgtggtcccctattgggaatgggn

SEQ ID NO: 16078 - protein, 77 aa, Zea mays
  misc_feature: Ceres CLONE 1379485-F
MGLLLRERIVFLGNENRGLPSRTASSASSSLLDAIDPDSDIRLVVNSPGGIPLPQQWAIYGCNGAWGGQTWSPIGNG

SEQ ID NO: 16079 - DNA, 680 bp, Zea mays
  misc_feature: Ceres CLONE 1379491-F
  misc_feature: Translation starting site: 224
  misc_feature (516)..(516): n is a, c, t, g, unknown, or other
agagctggagctccccgcggtggcggccgctctagaactagtggatcccccgggctgcaggaattcgcacgagaccattacctagaacatcctaatcgaaaatttgcacttctcgccttctctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacgggatgtgaagaagttctatcagcaagtgcgattcagaagaaagaaaaacttgtgcctttatggtttgcccaatgagacttgggaaggcactccttcagctgaggaagtaccctcctgagcttccagaccagcactggggataaaactttgcccgtgatggaatgtccaaaaagactggntgcctcctagtgcaggtcaaaaggatgcatggtcctgtctggtgcattcaacttttgagctcgttttggaattgacaaagatgccaggagaaggtctttcccatgattaacaccctgcccacggttattgaagtgtgacggggtttcctaaaaacaaatcgaac

SEQ ID NO: 16080 - DNA, 695 bp, Zea mays
  misc_feature: Ceres CLONE 1379492-R
  misc_feature: Encodes the peptide sequence at SEQ ID NO. 16081
  misc_feature (443)..(443): n is a, c, t, g, unknown, or other
cgattgggtaccgggccccccctcgaggtcgacggtatcgataagcttttttttttttttttttcgcggcaacgtcgtatactggaacttcatgcaggtcccttttcagaatcccatgtaaaagaaagaatactcgggaatgatactgaaacgatcaacttccacgactcaccactcacgagcgaatacctctggatcaaaggacccactggccacacattactacatagagagagtacacagacggaagcgcacacatcggttcatgcctacgtactctgctcgcggcaacatgcatccacgatacaccggtttacgaactggtgtagacggatcgcataaacacatatatgactaagagacaggctcacctcgatctagcttaaaatgccaggagcgtgactttataactcgtcggcatgcatgcattcctcgcccggacngcgcacagacgcctcattaaatcaacgtgttgaaataaacgtagtgctgatcttgtacggaagggcacgtcccacttgctgggcagaccgacgctcgccgatctatgggccgctcccgttggcccgttggcaactttcttgaggcaaccccaatgtgcagccatcgggggtgtttttgcctgctgccacaggtaccaatgctacccactacggctggggggcatggccctgcccttttggacaaaaggagga

SEQ ID NO: 16081 - protein, 113 aa, Zea mays
  misc_feature: Ceres CLONE 1379492-R
RLGTGPPLEVDGIDKLFFFFFSRQRRILELHAGPFSESHVKERILGNDTETINFHDSPLTSEYLWIKGPTGHTLLHRESTQTEAHTSVHAYVLCSRQHASTIHRFTNWCRRIA

SEQ ID NO: 16082 - DNA, 713 bp, Zea mays
  misc_feature: Ceres CLONE 1379494-F
  misc_feature: Encodes the peptide sequence at SEQ ID NO. 16083
  misc_feature (686)..(686): n is a, c, t, g, unknown, or other
tccccgcggtggcggccgctctagaactagtggatcccccgggctgcaggaattcgcacgagaccattacctagaacatcctaatcgaaaagaagcttggctttgtgaagcaggttgctaagaggaacccttggatagggcagaagctcttcggttttgtcctgcagagggccgaaaacacgaaggcgcagtatcggagaaaccagctgctggagttggcagagttcatactgaaatcatgggccgatggcacgccagagatgttcttgaaccatctgtctcagctgtgcgggttgatacaagcagccctttcagccgttgccgaaaacaagtcgcgccgcaaggaagtgcgcaacttctgcactgggatcctgcagacggtgctgaagcttggtctcaaagaccagttccagaacgcgttgagtcctgaaacttattccctctgcgaggccaagctaggggctgcgtttaccgccttcaaaaagtgatcatgtgggacaccgattaaattcatttcaccacagaccgtggatcccttggaagttttataagaagaattagtgtatcttctagtttttgagctcggggagagtaggatcaatcaaattaatgtgtgcttgtgctagactttttcaccgcagggagagatgcatggtacaaagttgttggggcccttagtggatacnaaatggttttaaaaaaaaaaaaaaaga

SEQ ID NO: 16083 - protein, 75 aa, Zea mays
  misc_feature: Ceres CLONE 1379494-F
MFLNHLSQLCGLIQAALSAVAENKSRRKEVRNFCTGILQTVLKLGLKDQFQNALSPETYSLCEAKLGAAFTAFKK

SEQ ID NO: 16084 - DNA, 728 bp, Zea mays
  misc_feature: Ceres CLONE 1379496-F
  misc_feature: Encodes the peptide sequence at SEQ ID NO. 16085
tccccgcggtggcggccgctctaaaacaagtggatcccccgggctgcaggaattcgcacgagaccattacctagaacatcctaatcgaaaaacctcagcactagtctcctcttcgcacgagcgcaacaccatccacccaccagttcgaagcggaggcgaccggcaacctgcggcggagatgtcaggcaggggcaagggcggcaaggggctcgggaagggcggcgcgaagcgtcaccggaaggtgctgcgcgacaacatccaggggatcacgaagccggcgatccggaggctggcgaggaggggtggcgtgaagcgcatctccgggctgatctaacgagagacccgcggcgtgctcaagatctttctcgagaatgtcatccgcgacgctgtgacctacacggagcacggccgtcgcaaaacgtcaccgctatggacgtcgggtacgccctcaaacggcaggggcgcactctctatgggctcggcgcctaggttagggggtggtaatggctgggcagggggcccggaacgggggaactagtttggctgccttctgggggcgaatttgaaaaattgggggaatgggttgcttttgccccccggaacgggggtcttttgggcttgaaaaacccttgtttccaggggattggtttgcccggagaaaaaagaaggggggattttaaatttttcccagggggggggggccccaaaatgaggccccccagaatttt

SEQ ID NO: 16085 - protein, 51 aa, Zea mays
  misc_feature: Ceres CLONE 1379496-F
MSGRGKGGKGLGKGGAKRHRKVLRDNIQGITKPAIRRLARRGGVKRISGLI

SEQ ID NO: 16086 - DNA, 678 bp, Zea mays
  misc_feature: Ceres CLONE 1379497-F
  misc_feature: Encodes the peptide sequence at SEQ ID NO. 16087
  misc_feature (457)..(457): n is a, c, t, g, unknown, or other
  misc_feature (609)..(609): n is a, c, t, g, unknown, or other
aagctggagctccccgcggtggcggccgctctagaactagtggatcccccgggctgcaggaattcgcacgagaccattacctagaacatcctaatcgaaaaatcgcacatattattgagaccaactagcaacatagaaagcacaatattgtaccaataatggcagccaaaatattttgcctcattatgctccttggtctttctgcaagtgctgctacggcgagcattttcccgcaatgctcacaagctcctatagcttcccttcttcccccatacctctcaccagcgatgtcttcagtatgtgaaaatccaattcttctaccctacaggatccaacaggcaatcgcagcaggcatcttacctttatcacccttgttcctccaacaatcatcagccctattacaacagttacctttggtgcatttattggcacaaaacatcagggcacaacaactacnacaactcgtgctagcaaaccttgctgcctactctcagcaacagcagttacctttggtgcatttgtttgcacaaaacatcagggcacaacactaccacaactcgtgctagcaaaccttgctgcctactctcagcaacacagtttctgccattncacccactagctgcattgaactctgctgcttatttgcagcaacacaactactacattccagcaggtagg

SEQ ID NO: 16087 - protein, 92 aa, Zea mays
  misc_feature: Ceres CLONE 1379497-F
  misc_feature (57)..(57): Xaa is any aa, unknown, or other
MSSVCENPILLPYRIQQAIAAGILPLSPLFLQQSSALLQQLPLVHLLAQNIRAQQLXQLVLANLAAYSQQQQLPLVHLFAQNIRAQHYHNSC

SEQ ID NO: 16088 - DNA, 697 bp, Zea mays
  misc_feature: Ceres CLONE 1379498-F
  misc_feature: Translation starting site: 248
  misc_feature (396)..(396): n is a, c, t, g, unknown, or other
ggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtgncaaactcagcagcagaagcaggtctaggagttccagaagtagcagagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaaacaacggttgggtggaaatgccccactggagtatgccagctttacaataagattgggctcatggaatgtgacccaatgctttactcggtcacaaacatcttgaagca

SEQ ID NO: 16089 - DNA, 679 bp, Zea mays
  misc_feature: Ceres CLONE 1379502-F
  misc_feature: Translation starting site: 264
  misc_feature: SWISSPROT Homolog: EC 1.1.1.22 UDP-glucose 6-dehydrogenase
  misc_feature (327)..(327): n is a, c, t, g, unknown, or other
  misc_feature (352)..(352): n is a, c, t, g, unknown, or other
  misc_feature (581)..(581): n is a, c, t, g, unknown, or other
aagctggagctccccgcggtggcggccgctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaccatgggcgtcattgcccntcagtgcccagacatttgaggtcgntccgtcgttgacattctccaagccccggcatttgaggcctgggacaggtgacaccctggccaatctacgaggctgggtcttcaatgatggtggggaagccagtgcagggggcagggacccttctcctccagcactggatgttgagaaagcaccgccctgagggctgacataatcttttggctcgggggacaacccccacccagacccggggccttggagctggaaaggntgccgacctcactactgggagagcgctgcccccatgattgcggatgtctccagcctgacaggatggtgttgagagtccactgttcctggcagaacgtt

SEQ ID NO: 16090 - DNA, 596 bp, Zea mays
  misc_feature: Ceres CLONE 1379503-F
  misc_feature: Encodes the peptide sequence at SEQ ID NO. 16091
  misc_feature (256)..(256): n is a, c, t, g, unknown, or other
  misc_feature (460)..(460): n is a, c, t, g, unknown, or other
  misc_feature (532)..(532): n is a, c, t, g, unknown, or other
  misc_feature (533)..(533): n is a, c, t, g, unknown, or other
  misc_feature (556)..(556): n is a, c, t, g, unknown, or other
  misc_feature (594)..(594): n is a, c, t, g, unknown, or other
  misc_feature (595)..(595): n is a, c, t, g, unknown, or other
aagctggagctccccgcggtggcggccgctctagaactagtggatcccccgggctgcaggaattcgcacgagaccattacctagaacatcctaatcgaaaaatcgcttgtttgctgctgccttttcctttccgccgcggcaaaagtgaggagcgcgcgggcgagttgggggagacgaacccgtcataactccttcgcttaatcgcgtctcgtgctcctgcctcctgcgtatataaacgcggcaatcgcgacgcccnggggagggcgttcgttctcccttctccatcccacgggggggggaaagtccaaggggccgggatcgggggggccctcttcaaaaactttccccggggccgcgccgggagaaaaaaaaaaaccgaaaaggggggggttttaaccgccgggtgccccccggggggggggggggaggttgtgtttttccgcccccccccccccccccncaaaaaaaaaaaggggggggggggggggggggcccccccccacgaaaagggggggggtgtcccccccccccnnacccggggcggaatatttttccncccccccccccccccccccccccggcgcgggcggcgcnnc

SEQ ID NO: 16091 - protein, 61 aa, Zea mays
  misc_feature: Ceres CLONE 1379503-F
AGAPRGGGRSRTSGSPGLQEFARDHYLEHPNRKIACLLLPFPFRRGKSEERAGELGETNPS

SEQ ID NO: 16092 - DNA, 668 bp, Zea mays
  misc_feature: Ceres CLONE 1379504-F
  misc_feature: Encodes the peptide sequence at SEQ ID NO. 16093
  misc_feature (302)..(302): n is a, c, t, g, unknown, or other
  misc_feature (340)..(340): n is a, c, t, g, unknown, or other
  misc_feature (495)..(495): n is a, c, t, g, unknown, or other
  misc_feature (594)..(594): n is a, c, t, g, unknown, or other
aaagctggagctcaccgcggtggcggccgctctagaactagtggatcccccgggctgcaggaattcgcacgagaccattacctagaacatcctaatcgaaaaccgctcgttccaacatcacaaactccacacggctctcctgtctccgctgcccgctccacctccctccatgccgtcggcttccctccgcctcgccgtcgtcggcgcgggcgcggcgggcctggttgccgcccgcgagctacgccgcgagggccatgcgcccgtcgtcttcgagcgcgccgccgccgttgggggcacttggntctacacgcctcccgccacgtcctccgacccgctcggngccgcggcgacgcattccagcctctacgcatcgctccgcaccaacctgccacgcgagaccatgggcttcctcgacttccccttcgccgctggcgccgcgggctcccgagacccccgccggtttcccgggcacgaggaggtgctccgctacctggnagcgttcgcgcgccggttcgacctgctcccggtcgtccgcttcgagacggaggtgctcagtgtgaggagggaaaacggagggaagtgggctgtgacgtncaagaagctcggggataggggagcggcgaggaggagtctatgatgccgtcgtggcctgcatggtcacacacgga

SEQ ID NO: 16093 - protein, 155 aa, Zea mays
  misc_feature: Ceres CLONE 1379504-F
  misc_feature: SWISSPROT Homolog: EC 1.14.13.8 Flavin-containing monooxygenase
  misc_feature (45)..(45): Xaa is any aa, unknown, or other
  misc_feature (109)..(109): Xaa is any aa, unknown, or other
  misc_feature (142)..(142): Xaa is any aa, unknown, or other
MPSASLRLAVVGAGAAGLVAARELRREGHAPVVFERAAAVGGTWXYTPPATSSDPLGAAATHSSLYASLRTNLPRETMGFLDFPFAAGAAGSRDPRRFPGHEEVLRYLXAFARRFDLLPVVRFETEVLSVRRENGGKWAVTXKKLGDRGAARRSL

SEQ ID NO: 16094 - DNA, 657 bp, Zea mays
  misc_feature: Ceres CLONE 1379505-F
  misc_feature: Encodes the peptide sequence at SEQ ID NO. 16095
  misc_feature (283)..(283): n is a, c, t, g, unknown, or other
  misc_feature (366)..(366): n is a, c, t, g, unknown, or other
  misc_feature (411)..(411): n is a, c, t, g, unknown, or other
  misc_feature (443)..(443): n is a, c, t, g, unknown, or other
  misc_feature (453)..(453): n is a, c, t, g, unknown, or other
  misc_feature (460)..(460): n is a, c, t, g, unknown, or other
  misc_feature (602)..(602): n is a, c, t, g, unknown, or other
  misc_feature (608)..(608): n is a, c, t, g, unknown, or other
  misc_feature (625)..(625): n is a, c, t, g, unknown, or other
  misc_feature (649)..(649): n is a, c, t, g, unknown, or other
aagctggagctccccgcggtggcggccgctctagaactagtggatcccccgggctgcaggaattcgcacgagaccattacctagaacatcctaatcaaaagactcgatacggcaagatcgacagagagaccgacgcgccggcagatcccaagctcaccggagagggggaagagggcgaccgaaggcggcgatgggtttcatcatggacttcgcggagaatctgatcctccgtctgatggaggacccggaaagcgcgaccaggttcggcgggagcatgtctacnagatgaaggagcggtgcgagcgcactaaggcggcgtggagcctccctctgcgcccctacggcttctggaccttcgaccgcttncactcgcagctctcctgggatccccagatcagccaggccgccggncttcgggacccctacgacgacctcatcgcccngcactctggntcgccgncgtcttccctgacacccgttccgatctttgcccagaaggtctacttgggcatcaataagaaactctttcccctcaaactggatgtggttccatcctcttctgtctggaaaatggtgtcaccaaactaccctatttccctgtncagttnggcatggaaagtatagntggtgacttctattttctcagtgntgtctttg

SEQ ID NO: 16095 - protein, 112 aa, Zea mays
  misc_feature: Ceres CLONE 1379505-F
  misc_feature (27)..(27): Xaa is any aa, unknown, or other
  misc_feature (53)..(53): Xaa is any aa, unknown, or other
  misc_feature (59)..(59): Xaa is any aa, unknown, or other
  misc_feature (106)..(106): Xaa is any aa, unknown, or other
  misc_feature (108)..(108): Xaa is any aa, unknown, or other
MKERCERTKAAWSLPLRPYGFWTFDRXHSQLSWDPQISQAAGLRDPYDDLIAXHSGSPXSSLTPVPIFAQKVYLGINKKLFPLKLDVVPSSSVWKMVSPNYPISLXSXAWKV

SEQ ID NO: 16096 - DNA, 660 bp, Zea mays
  misc_feature: Ceres CLONE 1379509-F
  misc_feature: Encodes the peptide sequence at SEQ ID NO. 16097
ctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcattacggagaggaccccccgcggaagagggaatgcgagagcgagtgccgcgagccggcaccagcaagctgacgcgggcgaggacggcgacagcggcgtgtacggctacgtctcccgctccgggaaggggcgagtgccgggcgccagtgccttgcgccgcccccaggggccagccgggggagacccaggagtggatgagggcggtgcgcccgccgcggactggcccgccaacatggagcaagaagtacggtcccggcagcgagagccggggcaaggggcccggggagaggtgcgagcgccacccccgcggggactggggggaaa

SEQ ID NO: 16097 - protein, 74 aa, Zea mays
  misc_feature: Ceres CLONE 1379509-F
MGKGSVGASWWAFLLLAGVLLVVAATAGAEDGVVERDRKEDLRWCKQACEWHYGEDPPRKRECESECREPAPAS

SEQ ID NO: 16098 - DNA, 944 bp, Zea mays
  misc_feature: Ceres CLONE 1379510-R
aattgggtaccgggccccccctgcgagtcgacggtatcgataagcttttttttttttttttttcaataaacttggtcactgaccggctgaaactgacgggtgacgaaatacatttgacacgggatacatgcgtgctcgtactgatgtgcaaaccagaaccgagagatctgatgacctgacgagatgagcagacgatggactgactagctagctactaggtacacacgtacgtagtatacgtggtacgtcaacacacaccatatatatatatatgggtactacttattacgtcatgacactccagcagcgcctgatatgatgacacatgtaccagctgcatcgatcagaatcctcagaccctggtgacccccttgggctcgccggcccgcgccgccgacgtcgtacccgtggtccccgtagccaccggtgccgccgaagaaggccgtgtggggagcatggggcacggtagaggaagcctgcgtgaaggccaaagatgattgacccaaaaggccttccaaacatgcggcagggccccaagcccgcgggtgttccgcccgaattgtgggattctcccttttaaagggccaagccccggaaaaggggagatccccggtgggatgggcccccaggggctgaaattaagcggacgaaacgcctggggggtttgggtggggccaggggctggtttccttgtgccccccagggaggcgtctaaacgggggtggcaggcgccccgctcaaaggtttttgtataagccgagtcccatcataatttgtggggcagagatatggggcgaaaaacccggggggaaattggaaaaccactgcgggccctttttctgggaaacagtcacaagatggtagtttagggtctaacccgcgattgatataaaaatagggactaaaaggtgcaatgtttggaggttcggtctatgggacgggtg

SEQ ID NO: 16099 - DNA, 630 bp, Zea mays
  misc_feature: Ceres CLONE 1379540-F
  misc_feature: Encodes the peptide sequence at SEQ ID NO. 16100
  misc_feature (503)..(503): n is a, c, t, g, unknown, or other
tccccgcggtggcggccgctctagaactagtggatcccccgggctgcaggaattcgcacgagaccattacctagaacatcctaatcgaaaaacaaaaaaccctcttctcctctgtccgagattcatacaaaaatgcttctcaaatccgcttctgctttctcgctcgtgaacatccatggaggagtcaacaaggacatctctcctctctcctcctcctcctcctcttcattgagtcttcccgtttcttcgggaaaatcaagaaacctctccttctctgtttctgcctccacgcaaaccctgagcggcgtcgttttcgagccgtttgaggaggtgaagaaggagctcgatctcgtcccttcgagtccacagctctctctcgctcgccatctatactctcccgagtgcgaagccgccgtgaacgaacagatcaatgtggagtacaacgtgtcgtatgtgtatcacgccttgtacgcttacttcgatcgtgacaacgttgctctcanaggtcttgccaagtttttcaaggactcgagtgtggaagagcgagaccacgctgagatgttgatggagatcagaacaaagtggggggagggttaagtacagcccatggtgatgcctcagtctgagttt

SEQ ID NO: 16100 - protein, 154 aa, Zea mays
  misc_feature: Ceres CLONE 1379540-F
  misc_feature: SWISSPROT Homolog: EC 1.16.3.1 Ferroxidase
  misc_feature (124)..(124): Xaa is any aa, unknown, or other
MLLKSASAFSLVNIHGGVNKDISPLSSSSSSSLSLPVSSGKSRNLSFSVSASTQTLSGVVFEPFEEVKKELDLVPSSPQLSLARHLYSPECEAAVNEQINVEYNVSYVYHALYAYFDRDNVALXGLAKFFKDSSVEERDHAEMLMEIRTKWGEG

SEQ ID NO: 16101 - DNA, 619 bp, Zea mays
  misc_feature: Ceres CLONE 1379543-F
  misc_feature: Encodes the peptide sequence at SEQ ID NO. 16102
ggagctccccgcggtggcggccgctctagaactagtggatcccccgggctgcaggaattcgcacgagaccattacctagaacatcctaatcgaaaaatatttcagtcgtccctcgcgtagccgcggcgcatcgcgactcacgcactcaccgaccgcggatatggccccgccgccatgggctctccttgtgacttccctcctcctcatcctattccaccactcacctcgcgccgcggtggagtttccgccgtctctgggcgacagcctcctgggagccgcccgcgcgccggatttcgcggcttggctgcccgggttgcggcgccgcatccacgagcgccccgagctcaacttccaggagcaccgcaacagcgagatcgtccgcgacgagatcgacgcgatcgggatgccgtacgcgtggcacgtcgcgcagacggtggttgtggcgaccatcgccgtaggcagcgatggccccgtctgctcgctccgagccgacatggacgcgctacccttgcaggaattgtgagactgggaacacgagagcaaggacagcggaaagatgcatgctggtggagatgaagctcacacccgaatgcttcctgccccaactaaattgcatcat

SEQ ID NO: 16102 - protein, 120 aa, Zea mays
  misc_feature: Ceres CLONE 1379543-F
  misc_feature: SWISSPROT Homolog: EC 3.5.1.14 Aminoacylase
MAPPPWALLVTSLLLILFHHSPRAAVEFPPSLGDSLLGAARAPDFAAWLPGLRRRIHERPELNFQEHRNSEIVRDEIDAIGMPYAWHVAQTVVVATIAVGSDGPVCSLRADMDALPLQEL

SEQ ID NO: 16103 - DNA, 649 bp, Zea mays
  misc_feature: Ceres CLONE 1379559-F
  misc_feature: Encodes the peptide sequence at SEQ ID NO. 16104
  misc_feature (27)..(27): n is a, c, t, g, unknown, or other
aaagctggagctccccgctggtggggncgctctacaccaaacgcgtcccccgggctgcaggaattcccacgagaccattacctagaacatcctaatcgaaaaggttctggttggttggtgagatgtgttttcctctttctccttcgttgggagtttccatttggtggacatccttttccagatcccttcgtggattagatccacgctcctctagtcgagatcggcttgcatttttctgagatggagattgggaccgaaaaggttgcaaaacaatgacctccaactaatacaacccacaacagctgaagaagaaatccagctttctcaaccaccaaatttggaagacaagaccggtgaagagctgctcaacatagatccggatatggttcccgaagaaggatgtactggtactatatcaagcatcgtgcaaaatagcagatggtggtacccatcttggtccaggtggcacaaatcttcatctcaaacctcaactggatatcactgcacatcatggggctgcacaaatattaaatttagatacaagctcagcttcattgctactgatggaacatgcgaagcagagttcttttggtttgatagcatagccagaaaaatagtaggagaaccttggggcaaccttgttacagca

SEQ ID NO: 16104 - protein, 89 aa, Zea mays
  misc_feature: Ceres CLONE 1379559-F
MVPEEGCTGTISSIVQNSRWWYPSWSRWHKSSSQTSTGYHCTSWGCTNIKFRYKLSFIATDGTCEAEFFWFDSIARKIVGEPWGNLVTA

SEQ ID NO: 16105 - DNA, 695 bp, Zea mays
  misc_feature: Ceres CLONE 1379571-F
  misc_feature: Encodes the peptide sequence at SEQ ID NO. 16106
  misc_feature (1)..(1): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (26)..(26): n is a, c, t, g, unknown, or other
  misc_feature (37)..(37): n is a, c, t, g, unknown, or other
  misc_feature (52)..(52): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (74)..(74): n is a, c, t, g, unknown, or other
  misc_feature (75)..(75): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (94)..(94): n is a, c, t, g, unknown, or other
  misc_feature (116)..(116): n is a, c, t, g, unknown, or other
  misc_feature (118)..(118): n is a, c, t, g, unknown, or other
  misc_feature (167)..(167): n is a, c, t, g, unknown, or other
nggccgcgccnccccccnnnnnaaanaggacgacccnccccccccagggggnttaannnnnncggggggggggnngnnnnnnnnccaaagcggngctccccgcgggggcggccgcncngttttcatgcacccgcggggcggcaggatttcccacgagaccaggaccnagaacatccgaagcgaaaaaccaaactccagaggcttccaacagcaggcgaggaaagcaagacacgcccacccacccgctccggcagccggcggcgatgcagcagcagatgcccatgccgccggcgcccgctgccgccgcggcggcggcgcccccggcggccggcatcacgaccgagcagacccagaacgatttggacgaaaagaagcaaccaaacagggccagccaggaaaagcagacaccagggaaggaggccgaaggtgctcagtaacaagctcttctacaaaagaaccgggggggggggggggcgatcgccgacgcccaaccccagcctccgcaaaacccagcaggacgccctcagaggacgcacccggcgcaagggcccggtgcgggggataacatgtcacaaggacccagggcgccccccagaaccccacgaacccccacaggagaggcaggagcaagaaggaacacaacagggtcagcagcagcagcagcaagcggaggggccgacatggaccgggagagg

SEQ ID NO: 16106 - protein, 57 aa, Zea mays
  misc_feature: Ceres CLONE 1379571-F
MQQQMPMPPAPAAAAAAAPPAAGITTEQTQNDLDEKKQPNRASQEKQTPGKEAEGAQ

SEQ ID NO: 16107 - DNA, 711 bp, Zea mays
  misc_feature: Ceres CLONE 1379573-F
  misc_feature: Encodes the peptide sequence at SEQ ID NO. 16108
  misc_feature (299)..(299): n is a, c, t, g, unknown, or other
  misc_feature (330)..(330): n is a, c, t, g, unknown, or other
  misc_feature (357)..(357): n is a, c, t, g, unknown, or other
  misc_feature (388)..(388): n is a, c, t, g, unknown, or other
  misc_feature (389)..(389): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (418)..(418): n is a, c, t, g, unknown, or other
  misc_feature (446)..(446): n is a, c, t, g, unknown, or other
  misc_feature (495)..(495): n is a, c, t, g, unknown, or other
  misc_feature (630)..(630): n is a, c, t, g, unknown, or other
  misc_feature (655)..(655): n is a, c, t, g, unknown, or other
  misc_feature (663)..(663): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggagngacctgcggtggtgcaagcaggcgtgncgagtggcagtacggaaaggacaccccgcgnnaagagggatgcnnnaagagcgagtgccgncgagcggcaccagcaagctgacgcgggngcgaggacggcgacaggccggcgtgggacgcctacgtctccgcctcggnaaaaaaaaaggaaaggagtgcccggcccccagtgccctgcgcccgccacgagggcccaaggccgtggagaaaacccaggaggggccttttgaaggcggtgcccgccgccgggggaaactggccgtcgacatgganaccaaaaggagtaacggtcgcggcnagcgaagnccgcgggcaagtggtccccccggaaaaagttgcgagcgccaccaacgg

SEQ ID NO: 16108 - protein, 76 aa, Zea mays
  misc_feature: Ceres CLONE 1379573-F
  misc_feature (31)..(31): Xaa is any aa, unknown, or other
  misc_feature (41)..(41): Xaa is any aa, unknown, or other
  misc_feature (50)..(50): Xaa is any aa, unknown, or other
  misc_feature (61)..(61): Xaa is any aa, unknown, or other
  misc_feature (65)..(65): Xaa is any aa, unknown, or other
MGKGSVGASWWAFLLLAGVLLVVAATAGAEXRSGRTGPQGXTCGGASRRXEWQYGKDTPRXEGCXKSECRRAAPAS

SEQ ID NO: 16109 - DNA, 632 bp, Zea mays
  misc_feature: Ceres CLONE 1379576-F
  misc_feature: Encodes the peptide sequence at SEQ ID NO. 16110
tggagctccccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatggagctgttcgcgcgcgccaaggtggtgcggctcaagagccaccacgacaagttcctgtacgcggacgaggacgaggcgcacgtgacgcaggagcgggacgggtcgtcggcgaacgcgcggtgggccgtggagccggcgccgcacaacccgggcgccatccgcctgcggagccggtacggccactacctcaccgcctccggtgagccgttcctgctgaggatgacgggccggaaggtgacgcagacggcgcccgccgcgccccgcccctgcaaagcgatcgtgtactgggagcccgtgcgtgacggcttccagacgcgcctcagcaccatggcggccactttctg

SEQ ID NO: 16110 - protein, 115 aa, Zea mays
  misc_feature: Ceres CLONE 1379576-F
  misc_feature (1)..(115): Pfam Name: DUF569 Pfam Description: Protein of unknown function (DUF569)
MELFARAKVVRLKSHHDKFLYADEDEAHVTQERDGSSANARWAVEPAPHNPGAIRLRSRYGHYLTASGEPFLLRMTGRKVTQTAPAAPRPCKAIVYWEPVRDGFQTRLSTMAATF

SEQ ID NO: 16111 - DNA, 673 bp, Zea mays
  misc_feature: Ceres CLONE 1379579-F
  misc_feature: Encodes the peptide sequence at SEQ ID NO. 16112
  misc_feature (277)..(277): n is a, c, t, g, unknown, or other
  misc_feature (550)..(550): n is a, c, t, g, unknown, or other
  misc_feature (606)..(606): n is a, c, t, g, unknown, or other
  misc_feature (609)..(609): n is a, c, t, g, unknown, or other
ggagctccccgcggtggcggccgctctagaactagtggatcccccgggctgcaggaattcgcacgagaccattacctagaacatcctaatcgagaaaaaaaagaactccttccacgcccagccatctctaaaccctacccacagccaccgccgccgccgccgctccctgacccctagtgtccggatttaacttcaaacatggcggacgtcgatgtcgagccggaggtcgccgccggtgctcccaagaagaggacgttccgcaagtacagctaccgcnggcgtcgacctcgatgcgctgcttgacatgtccaccgacgacctcgttcagctcttcccagcgcgcgccaggagaaggttccagaggggtttgaagaggaagcccatggcgctcatcaagaagctgcgcaaggcgaaaaaggatgctcctgtcggcgagaagccagagccagtgaagacccatctccgcaacatgatcattgtccccgagatgattgggagcaaattgttggtgtctacaatggcaagaccttcaacccaggttgagatcaangcctgagatgattggccactatttcttgcagagttctccatttcctacaagccggnaangcacgggaaggccccccgggtattgtgcactaaaaaccccctctgagtttatcctcttggaaaa

SEQ ID NO: 16112 - protein, 114 aa, Zea mays
  misc_feature: Ceres CLONE 1379579-F
  misc_feature (51)..(108): Pfam Name: Ribosomal_S19 Pfam Description: Ribosomal protein S19
  misc_feature (113)..(113): Xaa is any aa, unknown, or other
MSSRRSPPVLPRRGRSASTATAGVDLDALLDMSTDDLVQLFPARARRRFQRGLKRKPMALIKKLRKAKKDAPVGEKPEPVKTHLRNMIIVPEMIGSKLLVSTMARPSTQVEIXA

SEQ ID NO: 16113 - DNA, 637 bp, Zea mays
  misc_feature: Ceres CLONE 1379581-F
  misc_feature: Translation starting site: 289
  misc_feature (509)..(509): n is a, c, t, g, unknown, or other
tggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctnctggtccgcgtccaatagcaaggtcaccaagctctgcgatttggggcctagggacagcgtatgcgcagtgcattggtcacgggaaggctcttatctttccattggcaccggccttggagatgtccaga

SEQ ID NO: 16114 - DNA, 686 bp, Zea mays
  misc_feature: Ceres CLONE 1379583-F
  misc_feature: Translation starting site: 195
  misc_feature (494)..(494): n is a, c, t, g, unknown, or other
  misc_feature (528)..(528): n is a, c, t, g, unknown, or other
  misc_feature (529)..(529): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (648)..(648): n is a, c, t, g, unknown, or other
ggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgtttcgtggcggtgtctgtgggcgcgaacatctccggcgggcacgtgaaccctgccgtgaccttcggcgcccttcgtgggcggcaacatcaccntggttccgggggctcctggtactgggtggcgaannctgctggggtcccacccgtggcgtgcttcctgctcccgcttctcgacggggcgggcaggcccgggcaacttctgctggngnnnnnggnnnnnnntgggggaagggcctcggggnnnngnaaaaacccggagaaccttcgggctggtggggcaaccgg

SEQ ID NO: 16115 - DNA, 637 bp, Zea mays
  misc_feature: Ceres CLONE 1379584-F
  misc_feature (423)..(423): n is a, c, t, g, unknown, or other
  misc_feature (451)..(451): n is a, c, t, g, unknown, or other
  misc_feature (470)..(470): n is a, c, t, g, unknown, or other
  misc_feature (490)..(490): n is a, c, t, g, unknown, or other
  misc_feature (532)..(532): n is a, c, t, g, unknown, or other
  misc_feature (533)..(533): n is a, c, t, g, unknown, or other
tggagctccccgcggtggcggccgctctagaactagtggatcccccgggctgcaggaattcgcacgagaccattacctagaacatcctaatcgaaaaaatcctgtctactactaccatcgccgtccttgtgtttcatttttaatgaccattctctcatctgctgctggctgcggctatatacccccctctctctgtctctctatctcctcctgttcttagacgtttctccagagcctgaagccaaatctagggggcttgcttcatctgctgtccgagcgtggattgatttctcggggctggcgcgctcaagagctcacctgagttccaccgaaatctgccacgctagttcttgcctaggtgtgtcgttgcgttgtgacccttgcggattttcttgtttcttttgacgtgcgatcttttgcagntagtctcccccccatccgtaatcatccngcgtctaggaaatgcaagncagtttgctaattttgtcgnctagggcctccccccatcctggttaaaagaaaaatcgaaggnngggattttttttttttttcccggtccaaaaaggaaacacgaaaacacaaattggtggcatcggaaaaagcccgggcaaaaaaaaacccaacccttgggattttt

SEQ ID NO: 16116 - DNA, 606 bp, Zea mays
  misc_feature: Ceres CLONE 1379601-F
  misc_feature: Encodes the peptide sequence at SEQ ID NO. 16117
  misc_feature (564)..(564): n is a, c, t, g, unknown, or other
aaagctggagctccccgcggtggcggccgctctagatctagtggatcccccgggctgcaggaattcgcacgagaccattacctagaacatcctaatcgaaaacacggatcgagacgtcccaatcgagctaatctcacaccgccagtgccagtgccagcggcagctgctaatccgtgccgtgttccagcagcgatgggagtggagtcggagtgcgacaggataaagggcccctgtagacccgatgaggaccaggagctgcggtgtctcgtggagcgccacggtgcgcgtaactgtacggcgatcgggcgcggtatttactttcgatcgcagaaaccaaggcggatgagtggaggtcaccaaatcttgcctcatgcggagcgccgtccctacttcacaaaggaacacgtcgcaattgtgaacgagctggctacgccgacaggccgaagtgacgtcatcattccttgccatcacatacgcttcgcctgtggaaacaatggccgcgaaattgcacaactctagaagatgtcaggcgcttccattacggctcactgatcctaaagctgnagacccaaactcaaaagttgcaatatgctgacatccctaaca

SEQ ID NO: 16117 - protein, 108 aa, Zea mays
  misc_feature: Ceres CLONE 1379601-F
MGVESECDRIKGPCRPDEDQELRCLVERHGARNCTAIGRGIYFRSQKPRRMSGGHQILPHAERRPYFTKEHVAIVNELATPTGRSDVIIPCHHIRFACGNNGREIAQL

SEQ ID NO: 16118 - DNA, 665 bp, Zea mays
  misc_feature: Ceres CLONE 1379603-F
  misc_feature: Encodes the peptide sequence at SEQ ID NO. 16119
  misc_feature (508)..(508): n is a, c, t, g, unknown, or other
  misc_feature (518)..(518): n is a, c, t, g, unknown, or other
  misc_feature (655)..(655): n is a, c, t, g, unknown, or other
tggagctccccgcggtggcggccgctctagaactagtggatcccccgggctgcaggaattcgcacgagaccattacctagaacatcctaatcgaaaaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctctgactcggcggagtccatcgagaagacctcccaggcgctcaagatcctcaagcaggtcggcgcctacaccgacgccgagaaggccaaggactccgtcggcatccgccccggcaagggtaagatgcgcaaccgccgctacatcaaccgcaagggcccgctcgtcgtctacggcaccgagggctccaaggtcgtcaaggccttccgcaacctccccgggcgtggacgtcgccaacgtcgagcgcctcaacctgctcgacctcgcccccggtggacaccctcggncgctttgtgnatctggaccgagagcgcgttcaaaagctcgagggaggtgtatgggagcttttgacgcgccgtcgcaaaagaaaaaagggcttttgttctgccgagggcccaagatggccaacgctggacctggggcaggattatcancctctgaacg

SEQ ID NO: 16119 - protein, 120 aa, Zea mays
  misc_feature: Ceres CLONE 1379603-F
  misc_feature (100)..(100): Xaa is any aa, unknown, or other
  misc_feature (103)..(103): Xaa is any aa, unknown, or other
MPLVISDSAESIEKTSQALKILKQVGAYTDAEKAKDSVGIRPGKGKMRNRRYINRKGPLVVYGTEGSKVVKAFRNLPGRGRRQRRAPQPARPRPRWTPSXALXIWTESAFKSSREVYGSF

SEQ ID NO: 16120 - DNA, 650 bp, Zea mays
  misc_feature: Ceres CLONE 1379628-F
  misc_feature: Encodes the peptide sequence at SEQ ID NO. 16121
  misc_feature (408)..(408): n is a, c, t, g, unknown, or other
  misc_feature (595)..(595): n is a, c, t, g, unknown, or other
aaagctggagctccccgcggtggcggccgctctagaactagtggatcccccgggctgcaggaattcgcacgagaccattacctagaacatcctaatcgaaaaaagaccaagatagaccacccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgatcacggcgtggncttcgtgggcacgctgtcaggacagctcttcttcggctggctgagcgacaagctcgagcgcaagaaggtctatggcatgacgctcatgctcatggtcctctggtcccgtcgcgtccgggctctcgtttcggcacacccccgggtacggcatggggaccctggccttcttccgcttcggggtccgggntcggaatcgggggggaataccgggttgtcggggactttattgccgaataacccca

SEQ ID NO: 16121 - protein, 157 aa, Zea mays
  misc_feature: Ceres CLONE 1379628-F
  misc_feature (77)..(77): Xaa is any aa, unknown, or other
MAAGDLEVLTALDTAKTQWYHFTAIVVAGMGFFTDAYDLFCISLVTKLLGRIYYTVEGSATPGTLPPHVSASDHGVXFVGTLSGQLFFGWLSDKLERKKVYGMTLMLMVLWSRRVRALVSAHPRVRHGDPGLLPLRGPGSESGGNTGLSGTLLPNNP

SEQ ID NO: 16122 - DNA, 638 bp, Zea mays
  misc_feature: Ceres CLONE 1379632-F
  misc_feature: Encodes the peptide sequence at SEQ ID NO. 16123
tggagctccccgcggtggcggccgctctagaactagtggatcccccgggctgcaggaattcgcacgagaccattacctagaacatcctaatcgaaaactccgtgctttcttagaggagggttggcttctcctccccctccggttcgggttcgggttcgtgaggttctccggggttcggtttcttgggtgagcgtatcgagatggtggcgtcggatgttgagtaccgctgcttcgtcggagggctcgactgggccacggacgaccactccctccacaacgtcttcagcacctacggcgaggtcctcgagtccaagatcatcctcgatcgggagacgcagaggtcccgcgtgttcggcttcgtcaccttctccacggaggaggcgatgcgaaacgccatcgagggcatgaacggtaaggagctggacggtcgcaacatcaccgtcaacgaggcccagtcccgcggcgatcgtggaggcgccggcgtcgccgattacggtgctggccgtgtaggaggcgtctacgttggtgtagggcgtcgtgatgccggcgacgactacatcgctggcggcgtgtacggtgatgtagacttcggtacggtgctggtggcgacgcctacggagctgggcatccgtggctgg

SEQ ID NO: 16123 - protein, 146 aa, Zea mays
  misc_feature: Ceres CLONE 1379632-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MVASDVEYRCFVGGLDWATDDHSLHNVFSTYGEVLESKIILDRETQRSRVFGFVTFSTEEAMRNAIEGMNGKELDGRNITVNEAQSRGDRGGAGVADYGAGRVGGVYVGVGRRDAGDDYIAGGVYGDVDFGTVLVATPTELGIRGW

SEQ ID NO: 16124 - DNA, 667 bp, Zea mays
  misc_feature: Ceres CLONE 1379636-F
  misc_feature: Encodes the peptide sequence at SEQ ID NO. 16125
aagctggagctccccgcggtggcggccgctcaatcctaccggatcccccgggctgcaggatttcgcacgagaccattacctagaacatcctaatcgaaaaagcacaagaacactcctagctagctaaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccgggaactgggtcaactcattcaccctgggggtcgaggatggaaaggtcagggggtccacgcctggagtggaggggcataaccgttggaaactggcggagggggctggtgtttggggggccccggccagtttggctatggggaaacggcatccttccccagaaagttcccacgaacaaaaaaagccacggggaacctccttaaaagctttag

SEQ ID NO: 16125 - protein, 149 aa, Zea mays
  misc_feature: Ceres CLONE 1379636-F
MAKLQVTPGAAFTECNELNFQGLYLYHTPLGPKANQAAIVESKAKIGIGATVVNNWAVYDGPGPGAKLVGRAQGLHILAGNWVNSFTLGVEDGKVRGSTPGVEGHNRWKLAEGAGVWGAPASLAMGKRHPSPESSHEQKKPRGTSLKAL

SEQ ID NO: 16126 - DNA, 656 bp, Zea mays
  misc_feature: Ceres CLONE 1379640-F
  misc_feature: Encodes the peptide sequence at SEQ ID NO. 16127
  misc_feature (544)..(544): n is a, c, t, g, unknown, or other
  misc_feature (559)..(559): n is a, c, t, g, unknown, or other
  misc_feature (579)..(579): n is a, c, t, g, unknown, or other
  misc_feature (656)..(656): n is a, c, t, g, unknown, or other
aagctggagctccccgcggtggcggccgctctagaactagtggatcccccgggctgcaggaattcgcacgagaccattacctagaacatcctaatcgaaaaaacacagtaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggcggcggcgttggcccgttccggtggggcaccgggctccggatgcggtgctgccagcagctccaggacgtgagccgcgagtgccgctgcgccgccatccggagcatggtcaggggctacgaggaggccatgccgccgctggagaaaggctggtggccatgggggcggagcagcagcncccccccccgaaagncagaaggaggaggacagggntggctactactacccctgcagccggtcaggagagggatacggctacgctcagggtggccagcggcagatgtatccan

SEQ ID NO: 16127 - protein, 158 aa, Zea mays
  misc_feature: Ceres CLONE 1379640-F
  misc_feature (122)..(122): Xaa is any aa, unknown, or other
  misc_feature (127)..(127): Xaa is any aa, unknown, or other
MAKIAAAAAAALCFAALVAVAVCQGEVERQRLRDLQCWQEVQESPLDACRQVLDRQLTGGGGGGGVGPFRWGTGLRMRCCQQLQDVSRECRCAAIRSMVRGYEEAMPPLEKGWWPWGRSSSXPPRKXEGGGQGWLLLPLQPVRRGIRLRSGWPAADVS

SEQ ID NO: 16128 - DNA, 664 bp, Zea mays
  misc_feature: Ceres CLONE 1379644-F
  misc_feature: Encodes the peptide sequence at SEQ ID NO. 16129
  misc_feature (323)..(323): n is a, c, t, g, unknown, or other
  misc_feature (324)..(324): n is a, c, t, g, unknown, or other
aaagctggagctccccgcggtggcggccgctctagaactagtggatcccccgggctgcaggaattcgcacgagaccattacctagaacatcctaatcgaaaattaccctcagcacgtcggcgctacagcccgcacctcgtttcctctcccgtctccgagatgacgaaacgaaccaagaaggtcggaattgttgataaatatggaaccaggtatggtgctagcttgcgtaagcaaatcaagaacatggaggtatctcagcactccaagtatgtctgtgagctctgtggcaagcttgctgtgcagaggaaagcgcttggcattgnngatgcatgactgtcggaagtcaaagtcgtcgtgcttacacatgacactgctagtgcgacactgtcagtagactatccgtcgcttgaggacaaactgaagatgatccggccccttgacggcatactgggcccactatattggtggggagccgaaaacgactcagcaattttgggtaagcccaggttttccaagggtgggggctaagattccacttggttaccggtgggaatttcccaggggaagggggccccattaattttcggggggggccaaaattggttctgggtttttcccaaaaaaaaaaaaaaactttttcctagcgggggccccctggaggggg

SEQ ID NO: 16129 - protein, 57 aa, Zea mays
  misc_feature: Ceres CLONE 1379644-F
  misc_feature (2)..(56): Pfam Name: Ribosomal_L37ae Pfam Description: Ribosomal L37ae protein family
  misc_feature (55)..(55): Xaa is any aa, unknown, or other
MTKRTKKVGIVDKYGTRYGASLRKQIKNMEVSQHSKYVCELCGKLAVQRKALGIXDA

SEQ ID NO: 16130 - DNA, 646 bp, Zea mays
  misc_feature: Ceres CLONE 1379653-F
  misc_feature: Encodes the peptide sequence at SEQ ID NO. 16131
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggtcttgtagctgtccagcgccgcgtccacctcggcgtccgcggctcctagccgggccgccctgagcc

SEQ ID NO: 16131 - protein, 108 aa, Zea mays
  misc_feature: Ceres CLONE 1379653-F
MLLTSCRQGRGMASLSCARADGVVRSGALPAKLLLCASCCFPTAAPVADGEVQVLACRQHLHRLPRRQDLRRQRPRRRHPQLVGLHQQPRQRGLVAVQRRVHLGVRGS

SEQ ID NO: 16132 - DNA, 659 bp, Zea mays
  misc_feature: Ceres CLONE 1379656-F
  misc_feature: Translation starting site: 479
aaagctggagctccccgcggtggcggccgctctagaactagtggatcccccgggctgcaggaattcgcacgagaccattacctagaacatcctaatcgaaaaatcacctataacattttgagcattcacaaacacaccaagcgaagcgaactagcaacaatctaagaagaatggataccaagatattatccctccttgcgcttcttgtgcttatttgcgagcgcaacaaatgcgtacattattccaccatgttcacttgctcctatctccattattgccacaggtcctcccaccagttacttccatgggcttccaacagccagctgtgcaaggctatatgatactacaagcgattgctcggagcgtcttacaacaaccaattgcccaattgcaacaacaatccttggcacatctaacaatacaaaccatcgcaacgcaacagcaacaacagttcctaccagcactgatccacctagacatggcgaaccctgtcgtctacttgcaacagcagctgcgtgcatccaacccacttgctctaggaaacgtacttgcaaaccaacaacaacaacgactgctacaggttctgacagcgcttaaacaactagccatgctgaaccctgccgactacctacaacagcaacaactgctttcatctagcc

SEQ ID NO: 16133 - DNA, 667 bp, Zea mays
  misc_feature: Ceres CLONE 1379656-R
cgaattgggtaccgggccccccctcgaggtcgacggtatcgataagcttttttttttttttttttcttttttttttttttttttttttttttttttttttttttttttttttttttttttttttttttttaccgaaataaatcccacccaatattttgattttttctaggaaacacatgccggtatgagggcccccttatcgagtacctctcatatgtaatctaaaaaaaggcccccccaacaatgggttgctgcccccacaaaacaggattcctcaaaaaaaaccggttgtatggcaacaatttttgctgctttagaaaggcccccaccaatgggttaccccctgccaatggattaagtaactgttgtccctgttgtaggtacccaacaaaattccacataattagttggttaaatggaaacaccttttgcaagtaggcaacagggtttgccccacctagctgaattaaagctggtacaatctgttgcaacaattcttgttgcaggtatgtaggggcattggccccaacgagcgggctaaataaaaacaatttttgcttttttaagtaggcggcagggttccccatggctagttgactaaaccctggcaaaaactgttgcaatttttgtttttgctggtttgcaactacctttgctaaaacaaggg

SEQ ID NO: 16134 - DNA, 627 bp, Zea mays
  misc_feature: Ceres CLONE 1379660-F
  misc_feature: Encodes the peptide sequence at SEQ ID NO. 16135
  misc_feature (449)..(449): n is a, c, t, g, unknown, or other
aagctggagctccccgcggtggcggccgctctagaactagtggatcccccgggctgcaggaattcgcacgagaccattacctagaacatcctaatcgaaaatgcggtctgcctctgcccttaccgctacgctttcctcccggattccagcagcgaaacacgcgcggggcaaggacggagctggtaagccgatcgagccggcgagggtggacaagatgatgatggccgaggtggccgccaaccacagcaaaaggagccacaacgacggctacttcagtgccaaagccgccgccgccgccgccgcgagcccagaggagttgggaagcatgtccatgtcctcgaagaagccgaggaaatagcacagcccgagaaccgcgcccgtatcgcccaaggagaagaaggacaggatcggcgagagagtcgcgggcgctcagcagctagtggtcgcgntcgggaagacagaacggctttccgtctgcaggaggcgtcgggtacatccaggtcctggaccagaggtccaggcctcaactcccttaactggggggtcctcggggtggcggcccgccctggagaaaccaaaactaaagcctcccgaaccccggtttggcttggggcccgggaccacaac

SEQ ID NO: 16135 - protein, 47 aa, Zea mays
  misc_feature: Ceres CLONE 1379660-F
MMMAEVAANHSKRSHNDGYFSAKAAAAAAASPEELGSMSMSSKKPRK

SEQ ID NO: 16136 - DNA, 667 bp, Zea mays
  misc_feature: Ceres CLONE 1379661-F
  misc_feature (619)..(619): n is a, c, t, g, unknown, or other
aagctggagctccccgcggtggcggccgctctagaactagtggatcccccgggctgcaggaattcgcacgagaccattacctagaacatcctaatcaaaaaaaatgcgtcgcatccgctccacaggatcctctgcgccaccgcaaacgtgtgaccgcccgtgacgtcggagatcccgagccgtcgacgcgtgccagacccgctcgcagccatgtcgccgtcgtagctcgactgcacaagagagcgtgcacatgggcaagcttgcggactgccggtaccgtcaagaagagatgcccgaggtcatgcagcgcgtcccgcgaaccccgagggagcagaccggctgctcagagctctcagagcgagatcgccatctgttgtgagtcggatacgagaaaggcctagactgagactgagactcatgaggcctagtccgctgctgaaccaaacgaagcagagcccaaggaagcagagccgcaggccatcgatccgcgactacagatccaggataggagaacagatacgacgccgccgcgacggcaccatagacgtatgctgctgctgctcgtccaaagcctgctgagccgcagatagccgccgagccacacaggtaggagctgtgnaagctcacgaggagtacgaggaggcagcgcctgctgttgctgacactc

SEQ ID NO: 16137 - DNA, 652 bp, Zea mays
  misc_feature: Ceres CLONE 1379662-F
  misc_feature: Encodes the peptide sequence at SEQ ID NO. 16138
tggagctccccgcggtggcggccgctctagaactagtggatcccccgggctgcaggaattcgcacgagaccattacctagaacatcctaatcgaaaaatcactcctcactcactcactcagaacgaaagacagctcaggtcatctgctcacacctcacaggctcacacccacaggacggccgccacagcaccgcggatagaacactacagcggtgagctgcagagcaggttagccgaggacatcgccatcgtcatcactcgtcagccatgagaaaggacaagcaccacaagcacgagcaccacctgcggcgttgctgcgggtgcatggcgtcctgcctcctggcgctggtcctcatcgtgaccttcgtctcgctggtggagtacctggcgctgcgcccctcgaacccgtccttctacctgcaggacctgcagctgcgcaagaccatctcgctggacgacccgtcgctgacggcgtcggcgcaggtgacgctggcctcccacaaccccaacgaacgagtgcgtaacttctacaagcgcctggacgtgttcgtcacctaccgcgacgaggccgtgactgtgcccgtgtctctgccgccgcactaccagggccaccacgacttcaccgtctggtcacccgtgctgtcgaccgagt

SEQ ID NO: 16138 - protein, 128 aa, Zea mays
  misc_feature: Ceres CLONE 1379662-F
MRKDKHHKHEHHLRRCCGCMASCLLALVLIVTFVSLVEYLALRPSNPSFYLQDLQLRKTISLDDPSLTASAQVTLASHNPNERVRNFYKRLDVFVTYRDEAVTVPVSLPPHYQGHHDFTVWSPVLSTE

SEQ ID NO: 16139 - DNA, 651 bp, Zea mays
  misc_feature: Ceres CLONE 1379670-F
  misc_feature: Translation starting site: 195
  misc_feature: SWISSPROT Homolog: EC 3.4.25.1 Proteasome endopeptidase complex
  misc_feature (545)..(545): n is a, c, t, g, unknown, or other
  misc_feature (647)..(647): n is a, c, t, g, unknown, or other
tggagctccccgcggtggcggccgctctagaactagtggatcccccgggctgcaggaattcgcacgagaccattacctagaacatcctaatcgaaaaacaccaccgctctgcctcgtctcgcctcgcgtcgtgtcacctcacctcacctcgtcgagtaggggtttgtaccgccgtggatctcgccgtccccgccatggacgtctcgcacgcgggatcctccgtcgccggggaggctccgaccaccggggagcaccggatggggactaccatcgtcgtggtctgctacgagggcggagtcgtcctgctcgccgattccaggaccagcactggaatgaatgtactcaaccgtgcttcacacaagattactcaactgacagacaatgtgtatgtctgtcgctctggatctgctgttgatacacaagtcatttcggattatgtacgctatttcctccaccaacacacaatccagcttggacaaccagctaccgttaaagttgcagccacttgattagttgcgctagcttatcagaacaagaacatgttngcaagctggcatgattgttggaggatgggacaagtacgagggaggccaaattttctcagtccctcttggtggaacgatcttgaaagcaccatttgcaattgnaggg

SEQ ID NO: 16140 - DNA, 796 bp, Zea mays
  misc_feature: Ceres CLONE 1379674-F
  misc_feature (20)..(20): n is a, c, t, g, unknown, or other
  misc_feature (23)..(23): n is a, c, t, g, unknown, or other
ccggctggagctcaccgcgntgncggccgctctatactagtggatcccccgggctgcaggaattcccacgagaccattacctagaacatcctaatcgaaaaatcgcacatattattgttaccacctagcaacatagaaagcacaatagtgtaccaacaatggcagccaaaatattttgcctccttatgctccttggtctctctgccagcgccgttacggcgaccattttcccccaatgttccgccactcacaaacataaccttcttactatacacctatcaccacatacaaatcttcaccccccgcaacccatgtccacccaagtactataatttccccatcgtcccctcttcccctggggatctttttttttttttttcctcccccccccccccaacccaaccttccctccctcaatccaccacccccacctatcgcccccccccctctcctcataccccccacatactccaatactgagtcagaaaacgtatcaccgacccctcagtcttcctcgccatccctttcacaccgacccagccccctcgctacctcccgcgcacccccaacccctccccacgccacctctactgccctcttgcccgttcctctgtactgctcccttctgctctcacccccacccccactccgctcccccccctcaccctcccaccccgcccacttcctctcccacccacacccctcccaccacccgcccagcactcaatcacaacactcttctcaccagtcacgctgcctcctgagcatatctctccgcgttccacacacccacgcc

SEQ ID NO: 16141 - DNA, 702 bp, Zea mays
  misc_feature: Ceres CLONE 1379680-F
ccagctggagctccccgcggtggcggccgctcttcacactagtggatcccccgggctgcaggatattcgcacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaatgcgtgctgcgacctgtagtgcctccaccacgccatccaccctgatggccacgacccccggcgcccacaccattgcggagaatgctcaggatctcaccccccccccccctgagcctcatcccgacacacccccccccccaaccctgaattactcgcacccccccacccccgacaccgccaccaccaccagccgcccgccgcccgcgggctgggctcgtcgcccccccccccccccccccggccaacgcacgacggctaccaaacaccaagccccctcacgccccccaacccccccgcccatccccccctcctccccccgtctcacccaaacccgcaccctacccgcacctagtgcgttacctcgccgtcacccaccatcttgcccgccccgccgagaaatcacctccccacaccccccccc

SEQ ID NO: 16142 - DNA, 776 bp, Zea mays
  misc_feature: Ceres CLONE 1379683-F
  misc_feature: Encodes the peptide sequence at SEQ ID NO. 16143
gcccgctggagctcaccgcggtggcggccgctctacgactagtggatcccccgggctgcaggtaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcgccgacaagctcgtcttcgaagcgccgcctcagctcgtgaggtaggattacggtcagaacgccgaatagttacacttacctccccaaggcgacgcgcccccccggcgcctcctgtcgctccgtaccgccgcacaaaaagggggctcgaaatccgtatttagaatggaggcacgccgctcccgccggcctccccccccccgttcccccccccgccgccaatgccgggtactcacctttctcccaccccgcaggacagccgccacccatgagtatgcttgaagagggcgggcgcccccgccccccccctcgccgtcaacgcgcgcggggatagaagaccaggacgtccctcttacatcaaggccattctggccgacaacgcaaacctcccgaaacgagccccctaccccctcatacctccccccccccccccccccccccacctcccgtcccaacaccccacccctccgtcctcacctcacacacaacctattacaactaacaggcgcctctccccaccaccctcaccgccca

SEQ ID NO: 16143 - protein, 38 aa, Zea mays
  misc_feature: Ceres CLONE 1379683-F
MASGIGSGQQQPPAPAADADPGAVADKLVFEAPPQLVR

SEQ ID NO: 16144 - DNA, 685 bp, Zea mays
  misc_feature: Ceres CLONE 1379685-F
  misc_feature: Encodes the peptide sequence at SEQ ID NO. 16145
aaagctggagctccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgggaatcctttcgagggggaccccctacccgaacaacaagggtgggccacccttttggccagggccccagggggggggggggctccccccggtttctaaggtggcccaggccccccttcgcctgtgtggccccccgcacacccaccccccacccccgctctccccttccctctcaccgcccccccccccaaccccccaaaccgggccgctgcccctctctcccagccgggggttcccctctcatcaacccgcccgccgacaacagaccaccaccaccccccacccccca

SEQ ID NO: 16145 - protein, 103 aa, Zea mays
  misc_feature: Ceres CLONE 1379685-F
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFCCPGALQYISGGNPFEGDPLPEQQGWATLLARAPGGGGAPPGF

SEQ ID NO: 16146 - DNA, 696 bp, Zea mays
  misc_feature: Ceres CLONE 1379689-F
ccccgctgggagctcacgcggtggcggccgctctagactagtggatcccccgggctgcaggaattcgcacgagaccattaccagaacatcctaatcgaaaaatcaccaccactgggtcttcagaccattagcttatctactccagagcgcagaagaacccgatcgacaccatgagggtgttgctcgttgccctcgctctcctggctctcgctgcgagcgccacctccacgcatacaagcggcggctgcggctgccagcccaccgtcgacggttcttctaccgacgccggtgaatctgccccctccggacttacctgtcaccctccggtgtattttctcaccgtctgtttcctatggcagcgccgtgccctcttgccccctgctgtggccgtgtggcgcgtcctcccggcttttcccccccccgtctctcttcgtctgcttccccttacgcatgtccttttcgggtgggtagtcggtccttttctgggggttgtgtggcggccttgttggggaccccccccccctttctcagcctgtggctcgcccagcgatgtgttagtcgcgcgctctcccgccggcccccctcccgctcggtgttcccctcgccccgtgtttcgcgccgcggcgttttggtctcccgccccgcctgtgcctcctccttctctgtcctccctcccctcccctccgtttttgtttt

SEQ ID NO: 16147 - DNA, 894 bp, Zea mays
  misc_feature: Ceres CLONE 1379691-F
  misc_feature: Encodes the peptide sequence at SEQ ID NO. 16148
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (53)..(53): n is a, c, t, g, unknown, or other
  misc_feature (65)..(65): n is a, c, t, g, unknown, or other
ggggggggtgcttgttggttttttttnnnntttatcctcccccctgttaaaantttcaagctggngctccccgcggtggcggccgctctataactagtggatcccccgggctgcaggaattcgcacgagaccattacctagaacatcctaatcgaaaaacacacagcgccaccgcgtggttcgttaggaaaggaaatcgattcccccgcatccgatctcttcggtgctagagaaatataggccgccgcatcctcctcattcggcgaaaggtgcgcggctagccttgccacaccttcttatcccccccccgccgggaagtggacgctcgcggcccgtgataatcacaccacaaaataaagaaccgcaaccccctaccccataacaagcccattatgcggcccccccccccccccccctcccctacattttatccgtcctgctgatgtacttaggcgcccgtccccgccccccctatgtccctcttaaccccgcccccccgctccagctctcccacctcgcccctgccacggagctctatcccaccccccccccccgcccctctccccaccctcctcccccctcccgcggcccgcgcctaccccacccacaccgtgccacctctctctgagtggcacacactccaccatacctcatccgctctccaatcataacttccatcctctgcactctcgcgcccccccacccgcacccacaacattcgccgtcgaccacctcacccccccccatatccaccctcacatctctcctcctccacacaccaccatacctgcttcctctccccaccaaccctcacccactgcaaccagtacccctcaccaccacgcctcccccactgaccgtgccccccctcccccggctcccctacaccccttg

SEQ ID NO: 16148 - protein, 65 aa, Zea mays
  misc_feature: Ceres CLONE 1379691-F
MSLLTPPPRSSSPTSPLPRSSIPPPPPAPLPTLLPPPAARAYPTHTVPPLSEWHTLHHTSSALQS

SEQ ID NO: 16149 - DNA, 770 bp, Zea mays
  misc_feature: Ceres CLONE 1379694-F
  misc_feature (256)..(256): n is a, c, t, g, unknown, or other
ccagctggagctcaccgcggtggcggccgctctagactagtggatcccccgggctgcaggaattcgcacgagaccattacctagaacatcctaatcgaaaagctaaggactggggttctcgcattgccgggtccgctgtcaccggcagttctgacataacacaccgcttcttccccagttcaagtgccacaccgctcgtcgccttcccatctcgccgcgacatgaatttctgccgccacctgctcctcgccgcggngttcgcgctcctcctcgctgcctgcgcttctgccgtgagaaagagcgctggttccttccacccatccccgaccgcccccactccccctgccccccccagggcgcttccctgctcccccgtcttccctcgccggatagtagaagcgcaaaccacctctttatcgattgcccaaagaacatccccggaacaaccttacagctggcccaaaaacccgacccccccctacccaccccccaaaacacgccgaccacccccccaacatccgccaatggcttttatcccccctcacccccccgctttcatcttttcatctcgcgtactatatcctcccaccacccttcctgccttccgccacatcctctctccccccacaaccaatgcccccctacacttcctcaatactctcaccccccccctacacactgatggttaaaaagattagtaacctcatccaaccaattatacaattcttaccctctccccatacacaagaccttcaccaccacgcccaccg

SEQ ID NO: 16150 - DNA, 649 bp, Zea mays
  misc_feature: Ceres CLONE 1379699-F
  misc_feature: Encodes the peptide sequence at SEQ ID NO. 16151
  misc_feature (540)..(540): n is a, c, t, g, unknown, or other
ccaagctggagctccccgcggtggcggccgctctataactagtggatcccccgggctgcaggaattcgcacgagaccattacctagaacatcctaatcgaaaatcaaatatctctcaccacctctaccctcagcttctccccacctttggtcaggcaggctcaggcaaagggggcggccaacaaggacgagcgatggcgaccaaggtcatctgcttcctgttgctcgcatccctgctcctcgccgtcgcctttcccgtgtctgctctgcggcagcaggtgaagaagggcggcggcggaggcggaggcggaggcagtgttagcggaagcggaggcggcaacctgaatccctgggagtgctcgcccaagtgcgggtcgcggcgctccaagacgcagtacaggaaggcctgcctcaccttatgtaacaagtgctgcgccaagtgcctctgcgtgccaccggggttctacggcaacaagggggcctgtccctgctaccacaactggaaaaccaaggaaggagcgcccaacgtgcccctaaaaanatcaccgcaagctcccgcccgccattgaccccccttctccgaatctgcaacgtgctgtccactctcgcaccccccccctaggcttggccattatataactaagactacg

SEQ ID NO: 16151 - protein, 124 aa, Zea mays
  misc_feature: Ceres CLONE 1379699-F
  misc_feature (1)..(113): Pfam Name: GASA Pfam Description: Gibberellin regulated protein
  misc_feature (116)..(116): Xaa is any aa, unknown, or other
MATKVICFLLLASLLLAVAFPVSALRQQVKKGGGGGGGGGSVSGSGGGNLNPWECSPKCGSRRSKTQYRKACLTLCNKCCAKCLCVPPGFYGNKGACPCYHNWKTKEGAPNVPLKXSPQAPARH

SEQ ID NO: 16152 - DNA, 726 bp, Zea mays
  misc_feature: Ceres CLONE 1379701-F
  misc_feature: Encodes the peptide sequence at SEQ ID NO. 16153
ccccgctgtagctcaccgcggtggcggccgctctatacactagtggatcccccgggctgcaggaattcgcacgagaccattacctagaacatcctaatcgaaaaagctacaaccgaagccaccaccagcagtccagcacgactagcggaataatatccaccggcgacgggaacgggaggcggcgcggccggagattcgaagcgatggcgttcacgatgcgggcagcgaaggtgcctccgaactcggcctcgctggaggaggcccggcaccgcgtcttcgatttcttcacgcaggcatgccgctctatcccccccggcatggagatctaccccctcgcccacgttgtggcgggcttctcagttcctgtcgttcccccctccgcacacccgccccatcgccgctcggccactgccccccgggggcctccccggctctctgtcccgccgccccggcgccctcgtcgcccccgctccccctgccccggctccgcgcgcgccctcgttgcgtttccgcccccccccccgtttagaccccactcgtctcccgcccccgcccccccgcggcccgcggcccgcccgccctaggccccctccccgtgttcccccccgggcgtgacgctccccccccctccccccctcccgtttttccccccgctgccgcccgcctgctgccttcccctacccccccgccctcccctccctcgcgcctccgccgctcttccctccg

SEQ ID NO: 16153 - protein, 126 aa, Zea mays
  misc_feature: Ceres CLONE 1379701-F
MAFTMRAAKVPPNSASLEEARHRVFDFFTQACRSIPPGMEIYPLAHVVAGFSVPVVPPSAHPPHRRSATAPRGPPRLSVPPPRRPRRPRSPCPGSARALVAFPPPPPFRPHSSPAPAPPRPAARPP

SEQ ID NO: 16154 - DNA, 743 bp, Zea mays
  misc_feature: Ceres CLONE 1379702-F
  misc_feature: Encodes the peptide sequence at SEQ ID NO. 16155
  misc_feature (482)..(482): n is a, c, t, g, unknown, or other
  misc_feature (657)..(657): n is a, c, t, g, unknown, or other
cgagctggagctccccgcggtggcggccgctctacaactagtggatcccccgggctgcaggaattcgcacgagaccattacctagaacatcctaatcgaaaaacccttttcattttttcttccccatcttggagaagaagaaggcccgacgccctcgccgctgccaccaaaatcgcacgcgagccccaaagatccccaaaccctacacccgcccgtcggcgcactcggggaccgtcgaatccagcaggtcgacggagcagaggaagcctcgaagatgttccggacccagtacgacaccgcacgtgaccacactggaccccccatggcccccctgttccaggtgccagtaccccatggaagtcctcccaagcaaggtcctccatctcctcgactctcctccggccacggctcctccccccccccccccccccctcagcccgccaaaccgcccccgtcccgcagctcctcggtaagtagcaggngacacaggttgtgtgaggggaataaggtggggggtccccccaccgcaactaccgcagcggcgcgcgcgaccgccctggccgcgcccggcccccgcccgccccccccgccgcttccccgcacctaaccccgactggaccctctcgcctctcccctccccccccccgccgcgcgagngcgcacccctcccgcccccccccccccccccccgcctcccttcttttctcctccgcccgcccccctcttctcgacccgccctcccc

SEQ ID NO: 16155 - protein, 110 aa, Zea mays
  misc_feature: Ceres CLONE 1379702-F
  misc_feature (70)..(70): Xaa is any aa, unknown, or other
MFRTQYDTARDHTGPPMAPLFQVPVPHGSPPKQGPPSPRLSSGHGSSPPPPPPQPAKPPPSRSSSVSSRXHRLCEGNKVGGPPTATTAAARATALAAPGPRPPPPPLPRT

SEQ ID NO: 16156 - DNA, 873 bp, Zea mays
  misc_feature: Ceres CLONE 1379703-F
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (86)..(86): n is a, c, t, g, unknown, or other
gggggggggggcnnnccggcccccccccccgcccccccatccccgtgggccccccctccaagctggagctccaccgcggtggcggncgctctccaactagtggatcccccgggctgcatttattcgcacgagaccattacctagaacatcctaatcgactcccctctctccccagtcgaggacgacacgccctagtcccgcctcctccgcgccgagctctttggccccgattcgcgcaaacccaccaccgccacctccgcaggctccgcgtcgcccaacaccaacctcttccgcttcaagaaagaccactccgctcccacctcacacctcgctaaagatgccgccgggccaccatgactgcacccgcggatatttgacagagctgccgcgcgcacggagaagaccccccagggaacgtcggcgatattgtctggttacagcccccgcccgcgccacccctcgcgggggtcgccgtgcataaggcacccacaaggggagacgggctcgcccggctcccctcccgcgctgccccccacgccgccgtgctcgccgccgccccgcccccccgacggtgtatcctccccctgaacgccccacccatttcccgcgccgctcggccgggtgcccccccccccgccagacctttactctgagccgggcgcgcccgcagcgccccagacccccgcgcggtccgcccggcccgtcccgcgcgccctcccccgcagcccgccccgcccgccgcccgcccgctcagagttacatcgacccgtgctccacggcccccttttcgcatgccacgccctctccctctctcggccacccatcgtacactccttacccccagcgcggcctcgccgcgcccccacaatgccg

SEQ ID NO: 16157 - DNA, 677 bp, Zea mays
  misc_feature: Ceres CLONE 1379705-F
  misc_feature (343)..(343): n is a, c, t, g, unknown, or other
  misc_feature (357)..(357): n is a, c, t, g, unknown, or other
  misc_feature (377)..(377): n is a, c, t, g, unknown, or other
  misc_feature (390)..(390): n is a, c, t, g, unknown, or other
  misc_feature (392)..(392): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaacactcccagaggctcttctcctcctcgcctcctctccctagcctccacgacgcaagggagagtgacggaaagcgacgcggcgcgagcgaggagggccaaggggaagaggggaagcaccgcaccaggacccttgttcgccgccgccgcctctgatctccgcgaggttgtcaggattcaatatgtcgaccagcacattcgctacttcctgcacgctgttggggcatgttagaaacacgcaggncctccagacagcgntggaagagcccttcgtctcntagcttcttcagncnaagtacgaaggntnnccagcctgaaagacctccaagaaaactgggatgccttccgccatggcttggataacaagggtggaagctttggccggggccctgaagggggaaaaaaaaccccaattttgaggtgttcaaaaaaagccctacattctttgaccggccaaaaattggcgggggggagatgggccaaaaccggggcgggggggggggtttgtcccccccgggcggcgaaaaaaaagaatggggggtggggggcacaaccacgggggggcccctcctcttggg

SEQ ID NO: 16158 - DNA, 741 bp, Zea mays
  misc_feature: Ceres CLONE 1379707-F
  misc_feature: Encodes the peptide sequence at SEQ ID NO. 16159
  misc_feature (21)..(21): n is a, c, t, g, unknown, or other
  misc_feature (34)..(34): n is a, c, t, g, unknown, or other
gccggctggagctcaccgcgntggcggccgctcnatactagtggatcccccgggctgcaggaattcccacgagaccattacctagaacatcctaatcgaaaaatagcgcccgctcatcagcccacgcggccacgccgaagtatggggctctccgtctcctccctcgccgccgccctctcccacctctccctcccatcgacctccacccccaagcctcaccaggccccgctcctgcgcctgcgctccacctaccgccgcgctgttagcctcgcgctccgcgcctccgcagccgaaccgtttgagccggacctgaccgcgcaccacgcgacgcttgctccccgaggacgccgccaggaggctttttctgctcccccacccccaccgccccccaaatcgccacacatcacgatgtcatgatcgtgatctcctccccccctcttcatctctcttcctctgcctcgcccctccccacccccactctccccctccgccatttgcacccactgccagtcgcaccgcccccacgcccctccccgcgcccgcctgagggccccctgccctgctccggtgggcccgccccgaccccccccccccttgccggccaactggtcccaacagagactagccataacccaactccatcattcccttcgtcactctttcgtgcgtaccaccccctcccaccgacttccctccccctctcctcccgcgcgcttccgccctctctctcctcctcttgct

SEQ ID NO: 16159 - protein, 91 aa, Zea mays
  misc_feature: Ceres CLONE 1379707-F
MGLSVSSLAAALSHLSLPSTSTPKPHQAPLLRLRSTYRRAVSLALRASAAEPFEPDLTAHHATLAPRGRRQEAFSAPPPPPPPKSPHITMS

SEQ ID NO: 16160 - DNA, 728 bp, Zea mays
  misc_feature: Ceres CLONE 1379709-F
gcttgctggagctcaccgcggtggcggccgctcatccttagtggatcccccgggctgcaggaattcgcacgagaccattacctagaacatcctaatcgaaaacctccgctgagtcgctgaccgcctcgcacccgtcgttcccctccttccggcacaaccagcacgcgagcggcacgagaagactagggctccggcgaggcgacggcgagagccatggcagggattcgatggccgccagaggacccggagatcttcccttccaggatggtcagcgccgcgtccttgggtccttgtggggccctccgcagacatggcaccggcacgatgaccggaacggaggcatgcgctacccgcggccccagctttacgcgccctactcccctgtccccgccgccgacgccctcagccgctgactccttaccgccgtccttatgtactcctcctcgctcttgcgtcctccccgggctccctctgacgggcccacgcgccttccacacactcccggcgcgtccgtacatcccccgactcctcgcggccgtccatccctgttctgtatagggcgctgcgggcgcttggcctcccccgcccactcctcccccctttttccctcggcatccccacccccccatcaaccttctcactggcatgggtccgcctccccggcccacacacaccctccccccgctccgtccctcgagcccgcccccgcgacccctcctcatgccccg

SEQ ID NO: 16161 - DNA, 663 bp, Zea mays
  misc_feature: Ceres CLONE 1379715-F
  misc_feature: Encodes the peptide sequence at SEQ ID NO. 16162
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaaaagattaggaaaggaagcaccggagcaggcgatacggcgccgacgacaatggcagcaacaagggcttccccagagcttctcttgctgctcaccgtccagctcagcttgctcttccgcctccccgactccccctccaccctcgccctcgccctcgccgcggaaccagagcaacagaacgccaagcaacatcgccagcccgcgctgctggtgcagtcgacgtgcaactccaccagattctactacctctgcatagccgcgctcgccgccgaccccgccaggtccaccgccgacgtcccgggcctcggcgccatcgccgtgtccgccgccgcatacaacgcctccggaacggccgccttcctcggcaacgccagcgacgccgcggacaccccgtaggcggaccgagcgctcctccgcgcctgccccggaaagtacgccgccgcccgcgacgaggtcgtgcaggagcgcgcgtccctcgccgagcaggcctacgactaccccttcgtgcacgcgagcgcccacggaagattaccccgcggtgtgccggaacgatgatcccggcgn

SEQ ID NO: 16162 - protein, 114 aa, Zea mays
  misc_feature: Ceres CLONE 1379715-F
MAATRASPELLLLLTVQLSLLFRLPDSPSTLALALAAEPEQQNAKQHRQPALLVQSTCNSTRFYYLCIAALAADPARSTADVPGLGAIAVSAAAYNASGTAAFLGNASDAADTP

SEQ ID NO: 16163 - DNA, 714 bp, Zea mays
  misc_feature: Ceres CLONE 1379718-F
  misc_feature: Encodes the peptide sequence at SEQ ID NO. 16164
  misc_feature (351)..(351): n is a, c, t, g, unknown, or other
catagctggagctccccgcggtggcggccgctctagaactagtggatcccccgggctgcaggaattcgcacgagaccattacctagaacatcctaatcgaaaagaaaaatctctgccgtgcctctcgtctctcttctcaggcgccacgcaaaacgttctccgttttccctctccggatccggtccgcgggggccaggaggtaccgatgatccggaccgcaacggagcgagcgcgtctcctcctatcgcgctcctacgtagcacaggcacaggcagcttctcgctggtctctcgtccgctggaacgcttcgcatcttggatctgtacgctctttctatcagatggacattancagggcatacaacaaataaaagtttgactgcaagagggttgccataagctcccctgagagtcaagaattaacaaatgaaaaagctggggtcccatgccaactctaaaggatttaagggcccatggtcacaaagattctggctaaaaaaggtgcttggaaacagggggaaagggttgggaaactggacccctggaaggggggggtttctggaaattaccaaaaaaaattggaaaggggaaaaaaattttggtaaaagggacttgggagtctttttccacattggggggttgcatatttgggtgaaagaaaaagagccccccctccccaaattttttctctcttggtgggggtgaagaaaaaagg

SEQ ID NO: 16164 - protein, 54 aa, Zea mays
  misc_feature: Ceres CLONE 1379718-F
  misc_feature (49)..(49): Xaa is any aa, unknown, or other
MIRTATERARLLLSRSYVAQAQAASRWSLVRWNASHLGSVRSFYQMDIXRAYNK

SEQ ID NO: 16165 - DNA, 613 bp, Zea mays
  misc_feature: Ceres CLONE 1379720-F
  misc_feature: Encodes the peptide sequence at SEQ ID NO. 16166
  misc_feature (549)..(549): n is a, c, t, g, unknown, or other
aaagctggagctccccgcggtggcggccgctctagtactagtggatcccccgggctgcaggaattcgcacgagaccattacctagaacatcctaatcgaaaaatcacataagtccgccgcccctctccctcagtaaacccccctctcttcttcccgcggtctgctcgttcgatctgtgcagcagatctgaggtctcgagcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagtttcttaagatgaacccccttgggaaggttcctgttctggagactcctgatggccctgtttttgagagtaatgctatcgcacgctatgttgctcgcttgaaggatgacaaccctctttttgggtcttccgtattgaacaagccacgttgagcaatggatggattttgccgcaacagaaagtgatcctggntgtgcatggtacttgtatccaaggcttgggtacctcccctatgtcagcacaactgaggaaacag

SEQ ID NO: 16166 - protein, 93 aa, Zea mays
  misc_feature: Ceres CLONE 1379720-F
  misc_feature (1)..(76): Pfam Name: GST_N Pfam Description: Glutathione S-transferase, N-terminal domain
  misc_feature: SWISSPROT Homolog: EC 2.5.1.18 Glutathione transferase
MALVLHSGAGNKNAFKALIAAEYSGIKVELTKDFEMGVSNKTPEFLKMNPLGKVPVLETPDGPVFESNAIARYVARLKDDNPLFGSSVLNKPR

SEQ ID NO: 16167 - DNA, 686 bp, Zea mays
  misc_feature: Ceres CLONE 1379737-F
  misc_feature: Encodes the peptide sequence at SEQ ID NO. 16168
  misc_feature (387)..(387): n is a, c, t, g, unknown, or other
  misc_feature (428)..(428): n is a, c, t, g, unknown, or other
  misc_feature (440)..(440): n is a, c, t, g, unknown, or other
caaagctggagctccccgcggtggcggccgctctatacatagtggatcccccgggctgcaggaattcgcacgagaccattacctagaacatcctaatcgaaaatcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgacggcctccatccacgacatcggngagaagatcgaggaggtcgtcgggttcggcaagcccacggncgacgtgtgcgntatccacatcccgcacatcagcctccaccgcgccgacctcgtcgtggacgtgatcatcaagaacccgaacccggtccccgatcccgctcgtggacatcgactacctcatcgacagcgacggccgccaggtggtgtcgcgcctcatcccggaagcccgcaaccatccaaggggaacggccaggaaaaccgtcaaagatccccggtggtcgtttcgtctttccaaagaaaatccaagaagcaccctac

SEQ ID NO: 16168 - protein, 146 aa, Zea mays
  misc_feature: Ceres CLONE 1379737-F
  misc_feature (33)..(145): Pfam Name: LEA_2 Pfam Description: Late embryogenesis abundant protein
  misc_feature (61)..(61): Xaa is any aa, unknown, or other
  misc_feature (65)..(65): Xaa is any aa, unknown, or other
MSSSAENDPTVTVTERGGKDKHEDGGDKEQGGGGFIDKVTASIHDIGEKIEEVVGFGKPTXDVCXIHIPHISLHRADLVVDVIIKNPNPVPDPARGHRLPHRQRRPPGGVAPHPGSPQPSKGNGQENRQRSPVVVSSFQRKSKKHP

SEQ ID NO: 16169 - DNA, 825 bp, Zea mays
  misc_feature: Ceres CLONE 1379743-F
  misc_feature: Encodes the peptide sequence at SEQ ID NO. 16170
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (825)..(825): n is a, c, t, g, unknown, or other
gggggttgccnnnccnncnnnntttgnnaagtggcnnnccccgaggccgcgccaaagtggagctccccgcggtggcggccgctctatactagtggatcccccgggctgcaggaattcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccacctccacgcatacaagcggaggctgcggctgccagccaccgccgccggttcatctaccggggggggggaatctgccacctccggttcacctgccacctccggtgaatctcccaccgccggtccacctgccgccgccggtccacctggcaccgcacggcccatgtgcccgccgccggttcatctggccgcccccaccatgccccctaccttaataaaacggcccccgggcctcagcctcaatcccccaggacaccaccccatggccccggggccaaaaggccggcaatttcaaacccaccgcgcccaggtctggaagggggaaccttggccggcggttctggaaagaacccccagaaccccttggcgaccacgcggcggttacgagggtcccctgggaagacatccaaggtggccagaaccccgaacagagggaagcagccctatatagggttcgccgcctcccaggcggcccacacgccggcgtgggcggagaagaggcaggaggggttcacaccctcgccagagcttccacggcgccaacgggggggn

SEQ ID NO: 16170 - protein, 87 aa, Zea mays
  misc_feature: Ceres CLONE 1379743-F
MRVLLVALALLALAASATSTHTSGGCGCQPPPPVHLPGGGNLPPPVHLPPPVNLPPPVHLPPPVHLAPHGPCARRRFIWPPPPCPLP

SEQ ID NO: 16171 - DNA, 676 bp, Zea mays
  misc_feature: Ceres CLONE 1379746-F
  misc_feature: Encodes the peptide sequence at SEQ ID NO. 16172
  misc_feature (394)..(394): n is a, c, t, g, unknown, or other
  misc_feature (676)..(676): n is a, c, t, g, unknown, or other
aaagctggagctccccgcggtggcggccgctctagaactagtggatcccccgggctgcaggaattcgcacgagaccattacctagaacatcctaatcgaaaaatcacataagtccgccgcccctctccctcagtaaacccccctctcttcttcccgcggtctgctcgttcgatctgtgcagcagatctgaggtctcgagcgaccgtgaagcagcttcaatcgtcggcatggcgctcgtattgcatagtggggctggaaacaagaatgccttcaaagcacttattgctgcagaatacagtgggatcaaggttgagttgaccaaggattttgagatgggtgtctccaacaagacccctgagttttcttaagatgaccccccttgggaaggttcccntgttctggagactcctgatggccctgtttttgagagtaatgctatccgacgctatggttgctcgcttggaggatgacaacccttctttttggggcctccccgaatggaaacaaacccccgtttagacaatgggatggtttttgcccgaaacaaaaattgaaccccgggggtggacgggaaactggtatcccaagggttggggacccccccttttgtggcccccaacttgggggaaacagttttttttttcctttgaaaaaggccctttgggggcctcaaaan

SEQ ID NO: 16172 - protein, 46 aa, Zea mays
  misc_feature: Ceres CLONE 1379746-F
MALVLHSGAGNKNAFKALIAAEYSGIKVELTKDFEMGVSNKTPEFS

SEQ ID NO: 16173 - DNA, 651 bp, Zea mays
  misc_feature: Ceres CLONE 1379750-F
  misc_feature: Encodes the peptide sequence at SEQ ID NO. 16174
  misc_feature (413)..(413): n is a, c, t, g, unknown, or other
aaagctggagctccccgcggtggcggccgctctataactagtggatcccccgggctgcaggaattcgcacgagaccattacctagaacatcctaatcgaaaaaaaaggaccccggcccacctggaagccggagagaatcgagcagagccaccgatcgctcctctccactttccacattccagttccactccgcctccgctgccggtcgccgactccgaaacttcgacagtccgaccacaaggtcttgtgcgggatccacagaaggatgagtgaagaggataagactgctgcttctgctgagcagccgaagagggcccctaagctcaatgaaaggatcctctcttctctgtccaggaggtccgtagctgctcatccatggcatgatctttgagatcggcctgatgctcctgctnggtttcatggtgttgttgagatcacaagggaagcaaagttaaatatgagcttgacaagaaaactgaactgattaggttgatccaggcccgtactcatcacgtggaaacccccccaatatgggttcgtccaaggaccttttggaaaaaacatgccccaggggttggttacccctagggaaggaccggggggcccggggccccccccgggaaaaaaaaaaccgccctttgccccgtagga

SEQ ID NO: 16174 - protein, 41 aa, Zea mays
  misc_feature: Ceres CLONE 1379750-F
  misc_feature: SWISSPROT Homolog: EC 3.6.1.1 Inorganic diphosphatase
MSEEDKTAASAEQPKRAPKLNERILSSLSRRSVAAHPWHDL

SEQ ID NO: 16175 - DNA, 653 bp, Zea mays
  misc_feature: Ceres CLONE 1379754-F
  misc_feature: Encodes the peptide sequence at SEQ ID NO. 16176
aaagctggagctccccgcggtggcggccgctctataactagtggatcccccgggctgcaggaattcgcacgagaccattacctagaacatcctaatcgaaaaactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacaagcaccagacggacgcgtcggcgtcgggcgccgacgcggcgtgcggcggcgtgggcgtgctgggcatcgcctgggccttcggcggcatgatcttcgtcctcgtctactggaccggcggcatctcggggggccacatcaaccccggcgtcaccttcggcctcttcctggcgcgcaaggtctccctggtgcgcgcgctgcttctacatcgtggcggaaggggctcggcgcccatctgcggcgtcggccttcttcaagggcgttccaa

SEQ ID NO: 16176 - protein, 153 aa, Zea mays
  misc_feature: Ceres CLONE 1379754-F
  misc_feature (34)..(152): Pfam Name: MIP Pfam Description: Major intrinsic protein
MGKDDVIESGAGGGEFAAKDYTDPPPAPLIDAAELGSWSLYRAVIAEFIATLLFLYITVATVIGYKHQTDASASGADAACGGVGVLGIAWAFGGMIFVLVYWTGGISGGHINPGVTFGLFLARKVSLVRALLLHRGGRGSAPICGVGLLQGRS

SEQ ID NO: 16177 - DNA, 660 bp, Zea mays
  misc_feature: Ceres CLONE 1379760-F
  misc_feature: Encodes the peptide sequence at SEQ ID NO. 16178
aagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggcaccatgaacccatgcatgcagcactgcatgatgcaacaggggcttgccagcttgatggcgtgtccgtccctgatgctgcagcaactgttggccttaccgcttcagacgatgccagtgatgatgccacagatgatgacggctaacatgatgtcaccattgatgatgccgagcatgatgtcaccaatgatctttgcgagcatgatgtctcaaatgatgatgccacaatgtcactgcgacgccctctcgcagattatgctgcaacagcagttaccattcatgctcaacccaatgtccatgacgatcccacccatgttcttacagcaacccttgtgttgtcgctgaatcctagatagaattatttggggtgtatcgaataatgggtgagctgccatcc

SEQ ID NO: 16178 - protein, 148 aa, Zea mays
  misc_feature: Ceres CLONE 1379760-F
MAAKMLALFALLALCASATSATHIPGHLPPVMPLGTMNPCMQHCMMQQGLASLMACPSLMLQQLLALPLQTMPVMMPQMMTANMMSPLMMPSMMSPMIFASMMSQMMMPQCHCDALSQIMLQQQLPFMLNPMSMTIPPMFLQQPLCCR

SEQ ID NO: 16179 - DNA, 683 bp, Zea mays
  misc_feature: Ceres CLONE 1379762-F
  misc_feature (321)..(321): n is a, c, t, g, unknown, or other
  misc_feature (485)..(485): n is a, c, t, g, unknown, or other
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaatcccctcctcctcctctctctctccgcattttcccttccgataacagtgaggcctcgggtaatgttgagctacccctccctcccctccagcgctgcagctcccctccatactcggtcaagaattctgcggagagctccaatcacgtccgaccactaagccacgccgcataaatcgcgcaacctgatcgcttcctcaatggagcagagggcaagcgcgncgacgcggttgtctgccaccgtagcgtcgcaggagaaagcacatgagtccgtatccctgcggaccgctagccggcgggactgattgactcccatcactcggatctcagcgctggacgacgggaagggcttctatcgagtgcaaggtcgggcacagggatcggcntcggaatgcacgaacttggaaatggacgagggagttcaggccctaattccccctgcccctctgaatcgaggaaccaccgacgttngatccctttgtggggaccttgaagaaggaggcccctttccaaacccaaaccaggaaactggctggttggcccaaagagggaaacaaaagtaagggggaaaccaaaaaaacaaa

SEQ ID NO: 16180 - DNA, 670 bp, Zea mays
  misc_feature: Ceres CLONE 1379765-F
  misc_feature: Encodes the peptide sequence at SEQ ID NO. 16181
  misc_feature (228)..(228): n is a, c, t, g, unknown, or other
  misc_feature (237)..(237): n is a, c, t, g, unknown, or other
  misc_feature (262)..(262): n is a, c, t, g, unknown, or other
  misc_feature (305)..(305): n is a, c, t, g, unknown, or other
  misc_feature (329)..(329): n is a, c, t, g, unknown, or other
  misc_feature (335)..(335): n is a, c, t, g, unknown, or other
  misc_feature (336)..(336): n is a, c, t, g, unknown, or other
  misc_feature (400)..(400): n is a, c, t, g, unknown, or other
ggagctccccgcggtggcggccgctctagaactagtggatcccccgggctgcaggaattcgcacgagaccattacctagaacatcctaatcgaaaaattatctccctgactcgcctcgtcctccagatatcggccgccaccttcacctccaccgccccggcgcacctgtgcgtctccatcgtcgccgcctctcctccttcggacacgactgaccttccactggcgccnacgaagaanacacataggaagaagctcaccgccnaacctcatccagatccagtcgctgccctccgaaggccgcatancgaacgtctcgtctcttccttggnatccgnnggtcactccatcacccccaggttcacctcctttagcccccctcggtcggtttcacccaccgttncaattttgccacctccttcgttgaaaaaaaaaaccggagggacttgttttctgggctccaatttttgggaaacattttttgggaaaataaacagggctttggcaattttggggcccccccgcaaaaagggggcggttttttttgaacccgtgttctctttaaggaaaccttccccgggggggcaaaaaggggttaatagggggtggccccccgaaagagaggggggggggggggtggtaaaaaaggggtcccccgggggagaaaaaaatt

SEQ ID NO: 16181 - protein, 223 aa, Zea mays
  misc_feature: Ceres CLONE 1379765-F
  misc_feature (79)..(79): Xaa is any aa, unknown, or other
  misc_feature (88)..(88): Xaa is any aa, unknown, or other
  misc_feature (102)..(102): Xaa is any aa, unknown, or other
  misc_feature (110)..(110): Xaa is any aa, unknown, or other
  misc_feature (112)..(112): Xaa is any aa, unknown, or other
  misc_feature (134)..(134): Xaa is any aa, unknown, or other
GAPRGGGRSRTSGSPGLQEFARDHYLEHPNRKIISLTRLVLQISAATFTSTAPAHLCVSIVAASPPSDTTDLPLAPTKXTHRKKLTAXPHPDPVAALRRPHXERLVSSLXSXGHSITPRFTSFSPPRSVSPTVXILPPPSLKKKTGGTCFLGSNFWETFFGKINRALAILGPPRKKGAVFFEPVFSLRKPSPGGQKGVNRGWPPEREGGGGVVKKGSPGGEKN

SEQ ID NO: 16182 - DNA, 659 bp, Zea mays
  misc_feature: Ceres CLONE 1379766-F
  misc_feature (606)..(606): n is a, c, t, g, unknown, or other
  misc_feature (607)..(607): n is a, c, t, g, unknown, or other
  misc_feature (653)..(653): n is a, c, t, g, unknown, or other
tccccgcggtggcggccgctctagaactagtggatcccccgggctgcaggaattcgcacgagaccattacctagaacatcctaatcgaaaaacctttttttgggttgcctagatttgttagcttcttgttgcagcggtatctactagggagtactaggatggcatagaatagaagaagtggaggtgcctgcctgctgaaaccgttctttcctctgaacaactcatctcatctttttgatcgtgaagtgtttcagctactaataagctagctaggctagggaaggagaagctagcgatggctgcagaggtcggagagcatcttcctgccctcgacgatctcgtcgaagaagtcatcgagctcagcgatgacggcctcggcgcctgatcgcagcatcccaacccagccattgatgatctctgctctctggacaaggctgtcgctgaggtcgtcgcggtagccgcccatggcgactggccctgtcgaagtcctgcttggaggccgtcgatggcggccctgggcctggcggaactcgtgcatcatgatcccggccgagtgccgagcggtggtccccagcgatgatgcattcctccatctcctcgacgagnngcttggcgcaggcggggcgattggaggcgacgtaaccgccgcccgncgaggg

SEQ ID NO: 16183 - DNA, 695 bp, Zea mays
  misc_feature: Ceres CLONE 1379773-F
  misc_feature: Encodes the peptide sequence at SEQ ID NO. 16184
  misc_feature (375)..(375): n is a, c, t, g, unknown, or other
  misc_feature (480)..(480): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtgncgacgctgctgaactgcatgatgtgggtgctgtaccggctgccgctggtgcacccgcacagcatgctggtgggtgacatcaacgggaccgggatgctcatccagntgacctagggggggttcttcatcctttgctcccggggggggggggccccaaaaggtcggttcctgttcccccccaagggcccttttttggtccccttggggggggtgggggccccccgtgggcaaaaccccagaggggagggcccgtgcccccggaatttctcccccctttttttggaccaccggtgggagcgcggcccccctccccaaaaaaaa

SEQ ID NO: 16184 - protein, 85 aa, Zea mays
  misc_feature: Ceres CLONE 1379773-F
  misc_feature (9)..(86): Pfam Name: MtN3_slv Pfam Description: MtN3/saliva family
  misc_feature: Functional homolog of the protein sequence given in SEQ ID NO 96877
  misc_feature: Useful for making plants with modulated UV sensitivity
  misc_feature (49)..(49): Xaa is any aa, unknown, or other
  misc_feature (84)..(84): Xaa is any aa, unknown, or other
MVSADTIRTAIGVIGNGTALVLFLSPVPTFVGIWKKRAVEQYSPIPYVXTLLNCMMWVLYRLPLVHPHSMLVGDINGTGMLIQXT

SEQ ID NO: 16185 - DNA, 684 bp, Zea mays
  misc_feature: Ceres CLONE 1379777-F
  misc_feature: Encodes the peptide sequence at SEQ ID NO. 16186
  misc_feature (375)..(375): n is a, c, t, g, unknown, or other
  misc_feature (389)..(389): n is a, c, t, g, unknown, or other
  misc_feature (401)..(401): n is a, c, t, g, unknown, or other
  misc_feature (402)..(402): n is a, c, t, g, unknown, or other
  misc_feature (456)..(456): n is a, c, t, g, unknown, or other
  misc_feature (487)..(487): n is a, c, t, g, unknown, or other
  misc_feature (505)..(505): n is a, c, t, g, unknown, or other
  misc_feature (531)..(531): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacgganaggacaccccgcgnaagagggatgcnnagagcgagtgccgcgagcggcacccagcagctgacgcgggcgaggacggcgacngcggcgtggacgcctacgtctcccgctcggnaaggggcgagtgcccggngccagtggctgcgcccgcacgagggncaagccgggggagacccaggaatggcatgaaggggtgcccgccccccggggactggccgtcaacatgaaagaagaagtaccgtccggggaaacaaaaggcggggaaaatggccgggaaaaggggaaacgcccacccgggggggaatggggggg

SEQ ID NO: 16186 - protein, 128 aa, Zea mays
  misc_feature: Ceres CLONE 1379777-F
  misc_feature (55)..(55): Xaa is any aa, unknown, or other
  misc_feature (64)..(64): Xaa is any aa, unknown, or other
  misc_feature (82)..(82): Xaa is any aa, unknown, or other
  misc_feature (92)..(92): Xaa is any aa, unknown, or other
  misc_feature (98)..(98): Xaa is any aa, unknown, or other
  misc_feature (107)..(107): Xaa is any aa, unknown, or other
MGKGSVGASWWAFLLLAGVLLVVAATAGAEDGVVERDRKEDLRWCKQACEWQYGXDTPRKRDAXSECRERHPAADAGEDGDXGVDAYVSRSXRGECPXPVAAPARGXSRGRPRNGMKGCPPPGDWPST

SEQ ID NO: 16187 - DNA, 658 bp, Zea mays
  misc_feature: Ceres CLONE 1379781-F
  misc_feature: Encodes the peptide sequence at SEQ ID NO. 16188
  misc_feature (458)..(458): n is a, c, t, g, unknown, or other
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaccatttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccgganacttccttacgatgattgcaggaccgtccttcgaccaaggtccacgctgctcctggcggtggctcttccctgggatacctgtttggtgggcactgatgccgctcaccaagctatcaccccccactgtcgccgcatgctttttctgaatcgtgaacagnccgtgtcatttcatgtgtacccaaaccctccgtcccgcgtgg

SEQ ID NO: 16188 - protein, 126 aa, Zea mays
  misc_feature: Ceres CLONE 1379781-F
  misc_feature (79)..(79): Xaa is any aa, unknown, or other
MSRGGSAGGGQSSLGYLFGSGEPPKPAVAPAVSAPPAAAGAPPAEKPPAAKPDGTSQIAAGVTSQTNNYHRADGQNTGXFLTMIAGPSFDQGPRCSWRWLFPGIPVWWALMPLTKLSPPTVAACFF

SEQ ID NO: 16189 - DNA, 634 bp, Zea mays
  misc_feature: Ceres CLONE 1379783-F
  misc_feature: Translation starting site: 206
  misc_feature (406)..(406): n is a, c, t, g, unknown, or other
  misc_feature (407)..(407): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (498)..(498): n is a, c, t, g, unknown, or other
  misc_feature (499)..(499): n is a, c, t, g, unknown, or other
  misc_feature (511)..(511): n is a, c, t, g, unknown, or other
  misc_feature (560)..(560): n is a, c, t, g, unknown, or other
  misc_feature (586)..(586): n is a, c, t, g, unknown, or other
  misc_feature (593)..(593): n is a, c, t, g, unknown, or other
tggagctccccgcggtggcggccgctctagaactagtggatcccccgggctgcaggaattcgcacgagaccattacctagagcatcctaatcgaaaaaaaaactccactgctttcatcaactccggcgacttggagaatacgaagttccagaatccgatcggaagtttggtgctcgcgccttgacggattgatttcggtgcgccgatggggcaggcgttccgcaagctgttcgatgccttcttcggcaccagcgagatgagggttgtgatgcttggtctggatgccgccggtaaaaccaccatattgtacaagctgcatatcgggggaggttttgtcgactgttcccacgattggtttcaacgtcgagaaagttcaaatacagaatgtgatgtttactggtgtggnnatgtggtgnnncagaaaagttgaggcccctttgtggagcactacttttcacatactgatgggctgatctacgtagttgattcgttggatcnnggagagattggnaaaagccaaagctgaatttcaggcaataatcaaagatcctttgatgctnaacaggggaatactgggactggccantaagcangatttgaaaggggcattgcccccattggaggggggggggag

SEQ ID NO: 16190 - DNA, 667 bp, Zea mays
  misc_feature: Ceres CLONE 1379784-F
  misc_feature: Encodes the peptide sequence at SEQ ID NO. 16191
aagctggagctccccgcggtggcggccgctctagaactagtggatcccccgggctgcaggaattcgcacgagaccatacctagaacatcctaatcgaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctctttccgccgcggcggcggcgcaggccccgaccgccaccccgacgccggctcccaaggcgtcccccccgccggcgacgccgccgccgacccccgcgccggtgtctccgcccgtgccgcccccgaccatgcctcctccggagcccgcgcccgcccccaaggccccggacccggcgcccgaggcccccaccccggcgcccacggccagagctcccactcccgacgtgagctccccgccgatgcacgcggagggcccagttaagagaccatccggggagggttctcgagaaccctgcggagccgttgccaactgatgcttctacgctaagtgatttctttgcacagcagaggtgggaggtatccagtatggagaagagagcctccttggtcaaacaagcactgcttaagagcaggacttatataga

SEQ ID NO: 16191 - protein, 61 aa, Zea mays
  misc_feature: Ceres CLONE 1379784-F
MPPPEPAPAPKAPDPAPEAPTPAPTARAPTPDVSSPPMHAEGPVKRPSGEGSREPCGAVAN

SEQ ID NO: 16192 - DNA, 605 bp, Zea mays
  misc_feature: Ceres CLONE 1379786-F
  misc_feature: Encodes the peptide sequence at SEQ ID NO. 16193
  misc_feature (253)..(253): n is a, c, t, g, unknown, or other
  misc_feature (354)..(354): n is a, c, t, g, unknown, or other
  misc_feature (364)..(364): n is a, c, t, g, unknown, or other
  misc_feature (366)..(366): n is a, c, t, g, unknown, or other
  misc_feature (389)..(389): n is a, c, t, g, unknown, or other
  misc_feature (390)..(390): n is a, c, t, g, unknown, or other
  misc_feature (419)..(419): n is a, c, t, g, unknown, or other
tggagctccccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgatnaacatcctcttccaaatcgtagtctagcccgtgcccaaaaccctagcgaccgccggagagctcgtccgaatcgagggcaccgaggggaaaatagatcgcgncggacgatgnanagcccctgcgaagaggaggccgnnggagagctgccaatggagatcgagtcgtncgtcacggcggaggactgggcgcgcgcgctttctcgggtggtgccgtccgtcgtcgtcctccgaacactggggccggggctttgaaaacgaggtcccggccgcagctacccccgggtttccgtcgtgaaaagccccgggataatcctcctaaccgcctgtcttaaaccggaaccgggggccgggag

SEQ ID NO: 16193 - protein, 47 aa, Zea mays
  misc_feature: Ceres CLONE 1379786-F
  misc_feature (2)..(2): Xaa is any aa, unknown, or other
  misc_feature (10)..(10): Xaa is any aa, unknown, or other
  misc_feature (20)..(20): Xaa is any aa, unknown, or other
MXSPCEEEAXGELPMEIESXVTAEDWARALSRVVPSVVVLRTLGPGL

SEQ ID NO: 16194 - DNA, 644 bp, Zea mays
  misc_feature: Ceres CLONE 1379787-F
  misc_feature: Encodes the peptide sequence at SEQ ID NO. 16195
  misc_feature (328)..(328): n is a, c, t, g, unknown, or other
  misc_feature (342)..(342): n is a, c, t, g, unknown, or other
  misc_feature (363)..(363): n is a, c, t, g, unknown, or other
  misc_feature (418)..(418): n is a, c, t, g, unknown, or other
  misc_feature (468)..(468): n is a, c, t, g, unknown, or other
  misc_feature (521)..(521): n is a, c, t, g, unknown, or other
  misc_feature (530)..(530): n is a, c, t, g, unknown, or other
aagctggagctccccgcggtggcggccgctctagaactagtggatcccccgggctgcaggaattcgcacgagaccattacctagaacatcctaatcgaaaaacgctccccggaacgaacgacgcagcccaacccgttcccaccaaaccagcggcaccacccatggcttcggcggcggcgagatccggtctccggtcgctggcggtgcgcgccggcccgttgaggcgccgcatgtcctcctccgtccacgacgaacccaattaaaacggcaaggggggagaagaatcacctacccccgggatcgggacctggcaccctcccctggcggnggtacaaccctggnccaagggcccacccccacttntcgataaggccgccgcggtaccctatctgcacatcgccacaggagtcccatgggnccctgatggctgtttgagacaaagacaccactgagcctgatagcaccatncaggagctgtgatgcttaaagagtatatgggtgttcagggattttctttcccntgaaaatanttgctgcacaggaataaaatgacaaactctgatgggccggagggtttaactgggtaactgtaacggttggcttctttctttgccgccccgacaataggcccccgaaatgatttt

SEQ ID NO: 16195 - protein, 33 aa, Zea mays
  misc_feature: Ceres CLONE 1379787-F
MASAAARSGLRSLAVRAGPLRRRMSSSVHDEPN

SEQ ID NO: 16196 - DNA, 598 bp, Zea mays
  misc_feature: Ceres CLONE 1379788-F
  misc_feature: Encodes the peptide sequence at SEQ ID NO. 16197
  misc_feature (202)..(202): n is a, c, t, g, unknown, or other
  misc_feature (245)..(245): n is a, c, t, g, unknown, or other
  misc_feature (312)..(312): n is a, c, t, g, unknown, or other
  misc_feature (342)..(342): n is a, c, t, g, unknown, or other
  misc_feature (349)..(349): n is a, c, t, g, unknown, or other
aagctggagctccccgcggtggcggccgctctagaactagtggatcccccgggctgcaggaattcgcacgagaccattacctagaacatcctaatcgaaaagcacaatccatccatccatctattctccagtccacccattccattccactacccacgcccagaattcacgcgaacgcacacgcacccacacgacacatccngatgatgcttagggtttccccgtccccggccgccgcggtgccnacccagctctccggtgcgcccgcgacccctgctcccgtcgtcagggtgggcgcgccgcgcggcgtcncctcgcccggcgctggcgccgcgtgcaggnccgcggncaaggggaaggagtgctcaccggggtcgggttcccagcccttccaggagatcaaggggaggtcgccctcgtgccccatcccccgaaaagtggttcgggggcccaaatttcctccattgactggaagggccgccctcaaggagaaaataaacgggggaggacaaacgcccccgaagagaaaccccccccctcttttcccaattttgaaccgggaaaaaacggggtttttacaagggatttgccccaagtt

SEQ ID NO: 16197 - protein, 131 aa, Zea mays
  misc_feature: Ceres CLONE 1379788-F
  misc_feature: SWISSPROT Homolog: EC 1.16.3.1 Ferroxidase
  misc_feature (37)..(37): Xaa is any aa, unknown, or other
  misc_feature (47)..(47): Xaa is any aa, unknown, or other
  misc_feature (49)..(49): Xaa is any aa, unknown, or other
MMLRVSPSPAAAVPTQLSGAPATPAPVVRVGAPRGVXSPGAGAACRXAXKGKECSPGSGSQPFQEIKGRSPSCPIPRKVVRGPKFPPLTGRAALKEKINGGGQTPPKRNPPPLFPILNREKTGFLQGICPK

SEQ ID NO: 16198 - DNA, 649 bp, Zea mays
  misc_feature: Ceres CLONE 1379792-F
  misc_feature: Translation starting site: 257
  misc_feature (361)..(361): n is a, c, t, g, unknown, or other
  misc_feature (376)..(376): n is a, c, t, g, unknown, or other
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttccgccagtctcggtctcttccgaagcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatgggccnagtgcctggaggatnagaccgcgggacatcacgatgatgcctttcagcaccttcttcagccagaactgtggctgggaagcacgntcccccgggcaatcttcgttgatctagaacccactggggatcgatgaggtgcggattggaagtaccggccggtttttcaccccgagggagtcaacgggggaaggggggaagcccttaaaaatttcgcccggggccctaaccaatgggaaggaaattgtggtttgggcctttgcccaaaccccagggtgggggcaaccggcccgc

SEQ ID NO: 16199 - DNA, 677 bp, Zea mays
  misc_feature: Ceres CLONE 1379793-F
  misc_feature: Encodes the peptide sequence at SEQ ID NO. 16200
  misc_feature (242)..(242): n is a, c, t, g, unknown, or other
  misc_feature (273)..(273): n is a, c, t, g, unknown, or other
  misc_feature (350)..(350): n is a, c, t, g, unknown, or other
  misc_feature (367)..(367): n is a, c, t, g, unknown, or other
  misc_feature (409)..(409): n is a, c, t, g, unknown, or other
  misc_feature (426)..(426): n is a, c, t, g, unknown, or other
  misc_feature (432)..(432): n is a, c, t, g, unknown, or other
  misc_feature (450)..(450): n is a, c, t, g, unknown, or other
gctggagctccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggngctgcagggcttgtacggcgctggcgccggnctgacgacgatgatgggcgccggcgggctgtacccctacgcggagtaccctgagcagccgcagtgcagcccgctggncgcggcgccctactacnccgggtggtggcagccgagcgccatggttcagccgctccggnaacagtgctgccagcancaaatngagatgatggacgtgcantccgtcccgcaccacttgcaaatgatgatgcaactggaaggtggccgttgccgcccgaaaaaccctgaaccaaccagtttttgaatgaaaaaaaaaaaaaaagtgtttgggaaccccgggtctcaaaccccttggcccttgatattgggccaaaaattgccggcccagggtggggactttccacaaaaaccagtggcccgttttcccgaaaaacccctgggggggcc

SEQ ID NO: 16200 - protein, 125 aa, Zea mays
  misc_feature: Ceres CLONE 1379793-F
  misc_feature (29)..(29): Xaa is any aa, unknown, or other
  misc_feature (65)..(65): Xaa is any aa, unknown, or other
  misc_feature (71)..(71): Xaa is any aa, unknown, or other
  misc_feature (85)..(85): Xaa is any aa, unknown, or other
  misc_feature (90)..(90): Xaa is any aa, unknown, or other
  misc_feature (92)..(92): Xaa is any aa, unknown, or other
  misc_feature (98)..(98): Xaa is any aa, unknown, or other
MKMVIVLVVCLALSAASASAMQMPCPCAXLQGLYGAGAGLTTMMGAGGLYPYAEYPEQPQCSPLXAAPYYXGWWQPSAMVQPLRXQCCQXQXEMMDVXSVPHHLQMMMQLEGGRCRPKNPEPTSF

SEQ ID NO: 16201 - DNA, 578 bp, Zea mays
  misc_feature: Ceres CLONE 1379794-F
  misc_feature (209)..(209): n is a, c, t, g, unknown, or other
  misc_feature (233)..(233): n is a, c, t, g, unknown, or other
  misc_feature (260)..(260): n is a, c, t, g, unknown, or other
  misc_feature (306)..(306): n is a, c, t, g, unknown, or other
  misc_feature (315)..(315): n is a, c, t, g, unknown, or other
  misc_feature (316)..(316): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (378)..(378): n is a, c, t, g, unknown, or other
  misc_feature (379)..(379): n is a, c, t, g, unknown, or other
  misc_feature (435)..(435): n is a, c, t, g, unknown, or other
  misc_feature (460)..(460): n is a, c, t, g, unknown, or other
  misc_feature (461)..(461): n is a, c, t, g, unknown, or other
  misc_feature (467)..(467): n is a, c, t, g, unknown, or other
  misc_feature (468)..(468): n is a, c, t, g, unknown, or other
  misc_feature (471)..(471): n is a, c, t, g, unknown, or other
  misc_feature (479)..(479): n is a, c, t, g, unknown, or other
  misc_feature (485)..(485): n is a, c, t, g, unknown, or other
  misc_feature (487)..(487): n is a, c, t, g, unknown, or other
  misc_feature (490)..(490): n is a, c, t, g, unknown, or other
  misc_feature (493)..(493): n is a, c, t, g, unknown, or other
  misc_feature (496)..(496): n is a, c, t, g, unknown, or other
  misc_feature (511)..(511): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
tggagctccccgcggtggcggccgctctagaactagtggatcccccgggctgcaggaattcgcgcgagaccattacctagaacatcctaatcgaaaacatcaccaccactgggtcttcagaccattagctttatctactccagagcgcagaagaacccgatcgacaccatgaggggttgctcgttgccctcgctctcctggtctcgctngcgagcgccacctccacgcatacnagcggcggctgcggctgccagccaccngccgccgggttcatctacccgccgggccgggtggccatctttgggnccccccccnnccnnnccccttttttttttccccccgggggggggggggggggggggtgtgtgtttgttttgnntcttccccccccccccccccccgccgcgcccgcccgcgcgcgcgcccgcgcgcccnccccgcccccgccgcgccctcgcgnnccccgnnccncccccccnctccgncncgnccnctntgtttgtgggtgtgnctggtgggggggggggggtccccgtctggnnnnnnnnnntnnnnnnnncccgggcgcgcggggcggc

SEQ ID NO: 16202 - DNA, 652 bp, Zea mays
  misc_feature: Ceres CLONE 1379798-F
  misc_feature: Encodes the peptide sequence at SEQ ID NO. 16203
  misc_feature (253)..(253): n is a, c, t, g, unknown, or other
  misc_feature (277)..(277): n is a, c, t, g, unknown, or other
  misc_feature (511)..(511): n is a, c, t, g, unknown, or other
  misc_feature (512)..(512): n is a, c, t, g, unknown, or other
  misc_feature (544)..(544): n is a, c, t, g, unknown, or other
  misc_feature (572)..(572): n is a, c, t, g, unknown, or other
ggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctactcgccgatcgatacgatggccgtcttctccgacctccacaccgccgacggcctcaagtccctcgaggctcacctcgccggcnaaacctatgtgtctggtgacgccnttagtaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggatgatgatgaccttgatctttttgggtgatgaactgaggaggacnnagaagcagctgatgagcgtgccgccgctgccnaggcctcttctaaaagaaagaaagtggntaatcctcgtccttatggatgtcaaccatgggacgatgagactgatatgaagaagctggaggaggctggtcgcagtgccc

SEQ ID NO: 16203 - protein, 102 aa, Zea mays
  misc_feature: Ceres CLONE 1379798-F
  misc_feature (23)..(23): Xaa is any aa, unknown, or other
  misc_feature (31)..(31): Xaa is any aa, unknown, or other
MAVFSDLHTADGLKSLEAHLAGXTYVSGDAXSKDDIKVFAAVPSKPGAEFPNAARWYETVSAAVASRFPGKAVGVNLPAGSAPAAAAPADEAEDDDDLDLFG

SEQ ID NO: 16204 - DNA, 650 bp, Zea mays
  misc_feature: Ceres CLONE 1379800-F
  misc_feature: Encodes the peptide sequence at SEQ ID NO. 16205
  misc_feature (134)..(134): n is a, c, t, g, unknown, or other
  misc_feature (438)..(438): n is a, c, t, g, unknown, or other
  misc_feature (451)..(451): n is a, c, t, g, unknown, or other
  misc_feature (548)..(548): n is a, c, t, g, unknown, or other
  misc_feature (570)..(570): n is a, c, t, g, unknown, or other
  misc_feature (650)..(650): n is a, c, t, g, unknown, or other
tggagctccccgcggtggcggccgctctagaactagtggatcccccgggctgcaggaattcgcacgagaccattacctagaacatcctaatcgaaaaatacacatattattgagaccaactagcaacatagaangcacaatagtgtaccaacaatggcagccaaaatattttgcctccttatgctccttggtctttctgcaagtgctgctacggcgaccattttcccacaatgctcacaagctcctatagcttcccttcttcccccgtacctctcaccagcggtgtcttcggtatgtgaaaacccaattcttcaaccctataggatccaacaggcaatcgcagctggcatcttacctttatcacccttgttcctccaacaatcatcagccctattacagcagttacctttggtgcatttattggcacaaacatcaggncacaacaactacnacaacttgtgctagcaaaccttgctgcctactctcagcaacaacagtttcttccattcaacaactagctgcattgaactctgcttcttaattgcaancaacacaactaccattcagccngctatctgctggctaccccccagcaatttcttccattcaacccactgacagctttgaactctcctgcttatttacagcan

SEQ ID NO: 16205 - protein, 103 aa, Zea mays
  misc_feature: Ceres CLONE 1379800-F
  misc_feature (100)..(100): Xaa is any aa, unknown, or other
MAAKIFCLLMLLGLSASAATATIFPQCSQAPIASLLPPYLSPAVSSVCENPILQPYRIQQAIAAGILPLSPLFLQQSSALLQQLPLVHLLAQTSGHNNYXNLC

SEQ ID NO: 16206 - DNA, 592 bp, Zea mays
  misc_feature: Ceres CLONE 1379801-F
  misc_feature (261)..(261): n is a, c, t, g, unknown, or other
gctggagctccccgcggtggcggccgctctagaactagtggatcccccgggctgcaggaattcgcacgagaccatacctagaacatcctaatcgaaaaaccatcacagtacgcacgcacgcacacaccagcccagcagcagaagcgcccctcggccctcgctcccacaacaagctcaagccagccttctctctctgctccaatggcgcgcttccagctcgcagccgtggccatggccatgctctttcgccgcggcggcggngcaggccccgaccgccaccccgacgccggctcccaaggcgtcccccccgccggcgacgccgccgccgacccccgcgccggtgtctccgcccgtgccgccccccgacatggctccctcgggggccgcgcccgcccccaaagccccggccccggggccccgaggccccaaccccggggcccaagggccaagggtcccacttcccaagggagctccccccccaaggccacggagggccccccgtccaaacccccccgcgggagggtccccccaaccccccacggccccgcgtccccgcaagcccccccccaccgcctcgccggcgggcccctcg

SEQ ID NO: 16207 - DNA, 654 bp, Zea mays
  misc_feature: Ceres CLONE 1379805-F
  misc_feature: Encodes the peptide sequence at SEQ ID NO. 16208
  misc_feature (541)..(541): n is a, c, t, g, unknown, or other
  misc_feature (548)..(548): n is a, c, t, g, unknown, or other
  misc_feature (563)..(563): n is a, c, t, g, unknown, or other
aaagctggagctcaccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcagggaagcagcccctattcgagacagggtcgatctttgctggcttggcgagcttcagccgaatcaaggtcgagcatggcggcaggccagtaaatagagcaacacaaaaccctttcaattaatggagacctctgcagcaaccccgacccggccgccacancaggggnccacttccccatcgncatcgccctcgtcgtcgctgaaggtgtggaggccagcggcgcaacgcaacatgcgcaatcaggtgtcccatctgagcgccgcccaggagca

SEQ ID NO: 16208 - protein, 50 aa, Zea mays
  misc_feature: Ceres CLONE 1379805-F
  misc_feature (13)..(13): Xaa is any aa, unknown, or other
  misc_feature (16)..(16): Xaa is any aa, unknown, or other
  misc_feature (21)..(21): Xaa is any aa, unknown, or other
METSAATPTRPPXQGXTSPSXSPSSSLKVWRPAAQRNMRNQVSHLSAAQE

SEQ ID NO: 16209 - DNA, 684 bp, Zea mays
  misc_feature: Ceres CLONE 1379811-F
  misc_feature: Encodes the peptide sequence at SEQ ID NO. 16210
  misc_feature (601)..(601): n is a, c, t, g, unknown, or other
atagctggagctccccgcggtggcggccgctctagaactagtggatcccccgggctgcaggaattcgcacgagaccattacctagaacatcctaatcgaaaacttctgagtcccgacgcacgagctcccaagagctagccatggcgtccaccaccctctcctccgccttcaccctcctctcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcacgctcgaggaggcccgcagcctcgtcgaccacctccaggagcggctcggcgtcaccgccgcggccttcgcgccggccgccgtcgtcccggcgcccggggcgggcgccggggccgcggccgaggaggagcccccgtcgagaaaacggagttcgacgtaatgatcgaagagggtgcccacaagcgcgcgtaatcgccactatcaaaggtggtggcgggggctcaccaaccctccgggctcagggaaggcaagggacctttatcgagnggtcttcccccaagaaggtcaaaaaaaggcccgccaagcaagggaacgaaggcccaaggaaccccaaaaaaaacagcctccga

SEQ ID NO: 16210 - protein, 117 aa, Zea mays
  misc_feature: Ceres CLONE 1379811-F
MASTTLSSAFTLLSRPSTSPCPAASLPRSSHAAPHIRRGRRAVAVACTATESPKILELGDAIAGLTLEEARSLVDHLQERLGVTAAAFAPAAVVPAPGAGAGAAAEEEPPSRKRSST

SEQ ID NO: 16211 - DNA, 654 bp, Zea mays
  misc_feature: Ceres CLONE 1379813-F
  misc_feature: Translation starting site: 166
  misc_feature (434)..(434): n is a, c, t, g, unknown, or other
  misc_feature (572)..(572): n is a, c, t, g, unknown, or other
  misc_feature (597)..(597): n is a, c, t, g, unknown, or other
  misc_feature (634)..(634): n is a, c, t, g, unknown, or other
aagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggngaagagagtggtgtttctcaagcagctcaagtctggcctgctccttatctctgggcctttcaagatcatggagtaccgatccgccgtgtgaaccagacctatgtcattgctacatcaaccaaagttgacatctctggntgtgatgtcgccaagtttgatgacnagtactttgcccaggagaaagagcagaaggtgagaangacgagggtgagctttttga

SEQ ID NO: 16212 - DNA, 653 bp, Zea mays
  misc_feature: Ceres CLONE 1379817-F
  misc_feature: Encodes the peptide sequence at SEQ ID NO. 16213
  misc_feature (390)..(390): n is a, c, t, g, unknown, or other
  misc_feature (482)..(482): n is a, c, t, g, unknown, or other
  misc_feature (499)..(499): n is a, c, t, g, unknown, or other
tggagctccccgcggtggcggccgctctagaactagtggatcccccgggctgcaggaattcgcacgagaccattacctagaacatcttaatcgaaaagcgaggtcgaaatccccaaggcgaggcgttgaaacccttaaccctcttccacctcgaagcggcgcgaggagggagagtgtgagtggactcaggaggcggcgggcgaaatgaagcttaacgtcaagaccctcaagggcaccaacttcgagatcgaggcgagccccgatgcgtcggttgctgaggtgaagaggatcatcgaaactactcagggtcagagtacctacccagcagaccagcaaatgctcatataccaggggaaatttctgaggatgagaccacttgggaagcaacgnatgtgctgaaaacagcttccttggtatatgctgcccaagctaggcatcgtcaagtggagcttccacggtactggtgaaaagttctgaaatcnggccaacctggtgcccntggcaattagtgaaagaaccctaacaagctccgttgcccaggtgaaacggccccccaaggggcaaaacaggggggtcccatgtaaagggtggggtttggggggggctagggggaaagccgggattttaaaactttgtaggggaacaccctaaaa

SEQ ID NO: 16213 - protein, 64 aa, Zea mays
  misc_feature: Ceres CLONE 1379817-F
  misc_feature (6)..(64): Pfam Name: ubiquitin Pfam Description: Ubiquitin family
MKLNVKTLKGTNFEIEASPDASVAEVKRIIETTQGQSTYPADQQMLIYQGKFLRMRPLGKQRMC

SEQ ID NO: 16214 - DNA, 655 bp, Zea mays
  misc_feature: Ceres CLONE 1379827-F
  misc_feature: Encodes the peptide sequence at SEQ ID NO. 16215
  misc_feature (642)..(642): n is a, c, t, g, unknown, or other
aaagctggagctccccgcggtggcggccgctctagaactagtggatcccccgggctgcaggaattcgcacgagaccattacctagaacatcctaatcgaaaaatctgtacttttgattgatcgtgtctgtctgtgcaggctcaccaagatgggggccctggtgtgggagaaggtggtgcaccgccaccagggctggcgcctcctctccagcatgtggctccacgccggcgtcatccacctggtcgtcaacatgctctgcctcctcttcatcggcatgcgcctcgaacagcagttcggatacgtgaggatcggcgcgatctacgtggtctccggcgtgggcggcgccgtgctgtcgtcgctggtcgtccggaaccgcgtcaccgtgggggcctccggggcgctcttgggcctgctgggcgccatgctctcggagctgctcaccaactggaccatctacaccaacaaggcggcggccgtggccacgctcctgtccgtgggcgccgtcaacctggtgctcggcgtcctgccccacgtcgacaacctggcccacatcggcggcttcctcgcgggcttctactcggcttcgtcgtgctcatgcgcccccacttgggctggatggagcgctacggactccccgccggngcgccctgcacgg

SEQ ID NO: 16215 - protein, 169 aa, Zea mays
  misc_feature: Ceres CLONE 1379827-F
  misc_feature (9)..(153): Pfam Name: Rhomboid Pfam Description: Rhomboid family
  misc_feature: SWISSPROT Homolog: EC 3.4.21.105 Rhomboid protease
  misc_feature (165)..(165): Xaa is any aa, unknown, or other
MGALVWEKVVHRHQGWRLLSSMWLHAGVIHLVVNMLCLLFIGMRLEQQFGYVRIGAIYVVSGVGGAVLSSLVVRNRVTVGASGALLGLLGAMLSELLTNWTIYTNKAAAVATLLSVGAVNLVLGVLPHVDNLAHIGGFLAGFYSASSCSCAPTWAGWSATDSPPXRPAR

SEQ ID NO: 16216 - DNA, 639 bp, Zea mays
  misc_feature: Ceres CLONE 1379831-F
  misc_feature: Encodes the peptide sequence at SEQ ID NO. 16217
  misc_feature (358)..(358): n is a, c, t, g, unknown, or other
  misc_feature (438)..(438): n is a, c, t, g, unknown, or other
  misc_feature (439)..(439): n is a, c, t, g, unknown, or other
  misc_feature (457)..(457): n is a, c, t, g, unknown, or other
  misc_feature (482)..(482): n is a, c, t, g, unknown, or other
  misc_feature (483)..(483): n is a, c, t, g, unknown, or other
  misc_feature (506)..(506): n is a, c, t, g, unknown, or other
aaagctggagctcaccgcggtggcggccgctctagaactagtggatcccccgggctgcaggaattcgcacgagaccattacctagaacatcctaatcgaaaagaagtctatctttttctcctcctgccgtacgtccggtccgttccagcttgcaaagcgctcgcgagctgctgccatggccggcgccggtgcgcccgcagttccccaggccggtcgcccagcccccaacttcgacgtcatcgtggtgggcgccggcatcatgggcagctgcacggcgcacgcggcggcgtctcgcggcgcccgcgtcctgctgctggagcgcttcgacctgctccacccgctgggctcctcgcacggngactcccgcatcatccgcgacggctacgcgcagccgcggtacctccgcatggtgcgcctcgccccgccgctctggggcgnncgccgagcccgaggcggntatcgcgtgttcaccccgacgccgnnactctccatggggcccgcggagnagggcctcgttcgccgccgccatcgcaaaattcggggccgagaaggtggacgaggaccacctttcacggcaggtgggggcgggccttcgccctcacggtccgggccccggtggacccgttggttcccccggtt

SEQ ID NO: 16217 - protein, 154 aa, Zea mays
  misc_feature: Ceres CLONE 1379831-F
  misc_feature: SWISSPROT Homolog: EC 1.5.3.1 Sarcosine oxidase
  misc_feature (88)..(88): Xaa is any aa, unknown, or other
  misc_feature (103)..(103): Xaa is any aa, unknown, or other
  misc_feature (111)..(111): Xaa is any aa, unknown, or other
MAGAGAPAVPQAGRPAPNFDVIVVGAGIMGSCTAHAAASRGARVLLLERFDLLHPLGSSHGDSRIIRDGYAQPRYLRMVRLAPPLWGXRRARGGYRVFTPTPXLSMGPAEXGLVRRRHRKIRGREGGRGPPFTAGGGGPSPSRSGPRWTRWFPR

SEQ ID NO: 16218 - DNA, 594 bp, Zea mays
  misc_feature: Ceres CLONE 1379835-F
  misc_feature: Encodes the peptide sequence at SEQ ID NO. 16219
  misc_feature (368)..(368): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (548)..(548): n is a, c, t, g, unknown, or other
  misc_feature (583)..(583): n is a, c, t, g, unknown, or other
aagctggagctccccgcggtggcggccgctctagaactagtggatcccccgggctgcaggaattcgcacgagaccattacctagaacatcctaatcgaaaaagatcttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccatttcgcacgatgaagcatcagntcggatttggcctcccgggggctaaaccggggggttgggaaaatcgcggggggggggtggggtttcccacccccctcttaggggggggggggtgccccccaaaatcttcttttttttttgggggcgggtttttttttcccccaccccccccccccgggggagattggtgttttnnnnggngcgggcggggggagaaacaacacacccaccccgcnccgtgtttggc

SEQ ID NO: 16219 - protein, 138 aa, Zea mays
  misc_feature: Ceres CLONE 1379835-F
  misc_feature: SWISSPROT Homolog: EC 1.11.1.11 L-ascorbate peroxidase
  misc_feature (64)..(64): Xaa is any aa, unknown, or other
  misc_feature (122)..(122): Xaa is any aa, unknown, or other
  misc_feature (123)..(123): Xaa is any aa, unknown, or other
  misc_feature (124)..(124): Xaa is any aa, unknown, or other
MAKNYPTVSAEYSEAVDKARRKLRALIAEKSCAPLMLRLAWHSAGTFDVSSRTGGPFRTMKHQXGFGLPGAKPGGWENRGGGVGFPTPLLGGGGCPPKSSFFFGGGFFFPPPPPPGGDWCFXXXGRGEKQHTHPAPCL

SEQ ID NO: 16220 - DNA, 655 bp, Zea mays
  misc_feature: Ceres CLONE 1379837-F
  misc_feature: Translation starting site: 214
  misc_feature: Pfam Name: ICL Pfam Description: Isocitrate lyase family
  misc_feature: SWISSPROT Homolog: EC 2.7.8.23 Carboxyvinyl-carboxyphosphonate phosphorylmutase
  misc_feature (354)..(354): n is a, c, t, g, unknown, or other
  misc_feature (439)..(439): n is a, c, t, g, unknown, or other
  misc_feature (458)..(458): n is a, c, t, g, unknown, or other
  misc_feature (520)..(520): n is a, c, t, g, unknown, or other
aagctggagctcaccgcggtggcggccgctctagaactagtggatcccccgggctgcaggaattcgcacgagaccattacctagaacatcctaatcgaaaaaaccaccgtagcacacaccagtacaccacacactcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtcccccggcgcggcgctccgcgggatcctcgcgacgcctggtgcgcaccaggcgccctgctgctacgacgcgctcggngcgcgcctcgtcgagcgcgcggggtttccgatcgggttcatgggcggtttctgtgtttctgccgcgcgacttggcttgcctgatngtggcctcattttctatgnagaaaatgtagatcagggcgtctcatcaatgaggcctgttcaatcccagtgattggtgatgnagacaatggtacggaaactctatgaatatcaagagaaccataaagggatatatcaatgctgggtttgcctgaattatgcttgaagatcaggtggcacctaagcatggggcctactgaaaggaagaaagtcatacc

SEQ ID NO: 16221 - DNA, 657 bp, Zea mays
  misc_feature: Ceres CLONE 1379838-F
  misc_feature: Encodes the peptide sequence at SEQ ID NO. 16222
  misc_feature (332)..(332): n is a, c, t, g, unknown, or other
  misc_feature (346)..(346): n is a, c, t, g, unknown, or other
  misc_feature (464)..(464): n is a, c, t, g, unknown, or other
  misc_feature (573)..(573): n is a, c, t, g, unknown, or other
aagctggagctccccgcggtggcggccgctctagaactagtggatcccccgggctgcaggaattcgcacgagaccattacctagaacatcctaatcgaaaaactcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctccctgacagcagcgncttatcttcgccgncaagcagcttgaggacggacgcacacttgctgactacaacatccagaaagagtcaaccctccacttggtgctgcgccttaggggaggcatgcagatctttgtcaagaccttgactggncagaacatcacccttggaggtggagtcctcagacaccattggacatgtcagggaaagatccagggacaggaggggcatccacctgaccagcaacgtctcatctttgccngcaagcagtttggaggatgggaggacccttgctgactacaacatcaggaggagagcaccctccacttggtgctgcggcttaggc

SEQ ID NO: 16222 - protein, 38 aa, Zea mays
  misc_feature: Ceres CLONE 1379838-F
MQIFVKTLTGKTITLEVESSDTIDNVKAKIQDKEGIPP

SEQ ID NO: 16223 - DNA, 602 bp, Zea mays
  misc_feature: Ceres CLONE 1379842-F
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcgaaaaagacacgtgtttctgttaattcgtctcgttttctcccttcccctgcgggctggagagcggcggcgaacgagacaaggtcaccggtgacgctcctcacctactccctgccgcctttcgctttccggcccggcctgccgcaagctcgcgcgccgcctacatcgacccctccccgcgccgcaggccgcctcccacagacgcggggcagccacgtcgcccggctcggagggattcggttcggcccgtcgtgctcccctccgcactcttctattggcctggagagcagcgnagatccaccagcaatttggattgcttctccttttttcttgaaaatactggggctccctcgggggtgggtaagggaaatccacgttttcaaaaaggggggtccggaacaggtttttttttttggctttcccaaaaagggggtgttggggggaggaattccagaattcccttttttggggggggttttttccaaaaaaaagggggcaccccaaaat

SEQ ID NO: 16224 - DNA, 618 bp, Zea mays
  misc_feature: Ceres CLONE 1379843-F
  misc_feature: Encodes the peptide sequence at SEQ ID NO. 16225
  misc_feature (330)..(330): n is a, c, t, g, unknown, or other
  misc_feature (331)..(331): n is a, c, t, g, unknown, or other
  misc_feature (403)..(403): n is a, c, t, g, unknown, or other
  misc_feature (411)..(411): n is a, c, t, g, unknown, or other
tggagctcaccgcggtggcggccgctctagaactagtggatcccccgggctgcaggaattcgcacgagaccattacctagaacatcctaatcgaaaacacaccaaaagaaaccaactaaaatcccaaaagagaggaaaggcacaaacagacggtacaaagaaagggacgctcgtctcggctcgtcacgtgccgccgccatggctgctctgggccgtggcctgcccctcctcctcctgctcctcctcctcgccgtatcgggggccgccaacgccgcggcggcgcccggcggcatgtccatcatcacctacaacgaggagcacggcgcgcgnnggctggagcggacggagccggaggtgcgggccatgtacgacctctggctcgcggagcacggccgcgcctacnacgcgctnggcgagggcgagggcgagcgcaaccgccgcttcctcgtcttctgggacaacctccgcttcgtcgacgcgcacaacgagcgcgccggcgcccgcgtcttcccgctcgggatgaaccagttcgccgacctcaccaacgacgagttccgcgccgcgtaccctcgcggcatggtccccgccgccgccggggagccgtcgtggggggaagta

SEQ ID NO: 16225 - protein, 140 aa, Zea mays
  misc_feature: Ceres CLONE 1379843-F
  misc_feature (57)..(119): Pfam Name: Inhibitor_I29 Pfam Description: Cathepsin propeptide inhibitor domain (I29)
  misc_feature: SWISSPROT Homolog: EC 3.4.22.14 Actinidain
  misc_feature (45)..(45): Xaa is any aa, unknown, or other
  misc_feature (69)..(69): Xaa is any aa, unknown, or other
MAALGRGLPLLLLLLLLAVSGAANAAAAPGGMSIITYNEEHGARXLERTEPEVRAMYDLWLAEHGRAYXALGEGEGERNRRFLVFWDNLRFVDAHNERAGARVFPLGMNQFADLTNDEFRAAYPRGMVPAAAGEPSWGEV

SEQ ID NO: 16226 - DNA, 682 bp, Zea mays
  misc_feature: Ceres CLONE 1379851-F
  misc_feature: Encodes the peptide sequence at SEQ ID NO. 16227
tggcggccgctctagaactagtggatcccccgggctgcaggaattcgcacgagaccattacctagaacatcctaatcgaaaagcctctgtatccgagcatactagcggatcctggcccgatccctcttcccacctacctccgcttctctcgaagtgaggaaccccaagccctcgccatggcgtcgcggatcctggcccgatccaagtcccttcacctcgtcgccgccctcacccctgccgctgccaaagcagcaacgactatcgccggagcccgggcgctctcgtccctgccccgctacccgtctgccccgtcgccccatgagctcggcaaggatctgggatatgaaccaacatctcacctcagtggaccacaagttttacctcgcctggtttcctctctagcatccaatgcatctcaggtgcagaagtcacagatctctgagacatacaagtcaggtggtgaaaatgaaacagtctgagacacggaaatcaagtgacgaagccacacaaaaagtgtggcgatcagtccgctagaagcagctatcgctaaacctatagtagtcccccgacaagcgagagtcctaagtaaggcgatcaaagaaacgacccaaggcacttttaaatgatccccgccctggctcttgcctcaaaaaaagataagtacctccctttcgggcggggg

SEQ ID NO: 16227 - protein, 100 aa, Zea mays
  misc_feature: Ceres CLONE 1379851-F
MASRILARSKSLHLVAALTPAAAKAATTIAGARALSSLPRYPSAPSPHELGKDLGYEPTSHLSGPQVLPRLVSSLASNASQVQKSQISETYKSGGENETV

SEQ ID NO: 16228 - DNA, 598 bp, Zea mays
  misc_feature: Ceres CLONE 1379854-F
  misc_feature (205)..(205): n is a, c, t, g, unknown, or other
  misc_feature (216)..(216): n is a, c, t, g, unknown, or other
  misc_feature (422)..(422): n is a, c, t, g, unknown, or other
  misc_feature (580)..(580): n is a, c, t, g, unknown, or other
gctcagaactagtggatcccccgggctgcaggaattcgcacgagaccattacctagaacatcctaatcgaaaagtgatacacatccgtcccttctagtctcctaataactagtttctatcttgctccccaaaccagcgcaaaccctgccctgacaccggcatcgacacgtccaccggtggcgccatgctgctctaggctaccggnattggaaattnttttgaccaatttaactaaaccaatattcttttcccggggttaaaaaaggggttaaaaatcggtccggggggcaaaaaaacccggcggcccccttaaaacccttaaaaccaaaacctttttccccccgtttcgccgggaatttttataccccccacggggggggcccgggccccccaaaaaggggaaacccataaatgccccgggntttcccaaaaacccctcttttaccccaattttttccaaatttggggccccttgggggaaaaaacggccccccccccccccaaaagggggaaaaaacccccccccccccccgggggtgtttccccacaaaaaaaaaaaatccccccccccggggggggnaaaaaaaaaaaaaaaaaa

SEQ ID NO: 16229 - DNA, 753 bp, Zea mays
  misc_feature: Ceres CLONE 1379860-F
  misc_feature: Encodes the peptide sequence at SEQ ID NO. 16230
  misc_feature (304)..(304): n is a, c, t, g, unknown, or other
  misc_feature (404)..(404): n is a, c, t, g, unknown, or other
  misc_feature (405)..(405): n is a, c, t, g, unknown, or other
  misc_feature (488)..(488): n is a, c, t, g, unknown, or other
  misc_feature (495)..(495): n is a, c, t, g, unknown, or other
  misc_feature (504)..(504): n is a, c, t, g, unknown, or other
  misc_feature (530)..(530): n is a, c, t, g, unknown, or other
  misc_feature (537)..(537): n is a, c, t, g, unknown, or other
  misc_feature (557)..(557): n is a, c, t, g, unknown, or other
  misc_feature (590)..(590): n is a, c, t, g, unknown, or other
  misc_feature (720)..(720): n is a, c, t, g, unknown, or other
  misc_feature (721)..(721): n is a, c, t, g, unknown, or other
  misc_feature (733)..(733): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagngacggagtggtcgaacgggaccgcaaggaggacctgcggtggtgcaagcaggcgtgcgagtggcagtacggaaaggacaccccgcggaagagggaatgcnnagagcgagtgccgcgagcggcaccagcaagctgacgcggggcgaggacggcgaccaggcggcgtgggacgcctacgtccccgncttcggnaaggggggncgagtggccggcgccagtgcctgcgnccgccancgagggccagccgtgggagnacccaggagtggcatgaggcggtgccgccgccngcggactggccgtcgacatgggagcaagagtacggtcgcggcagcgagagcgcgggcaaggcccgggagaggtgcgagcgccacaccgcggggactggtgggagagcagcgctgctgatgatgaaaaaannccgcgggagcgnaaaaaagagggcgcacgccg

SEQ ID NO: 16230 - protein, 164 aa, Zea mays
  misc_feature: Ceres CLONE 1379860-F
  misc_feature (31)..(31): Xaa is any aa, unknown, or other
  misc_feature (64)..(64): Xaa is any aa, unknown, or other
  misc_feature (92)..(92): Xaa is any aa, unknown, or other
  misc_feature (106)..(106): Xaa is any aa, unknown, or other
  misc_feature (108)..(108): Xaa is any aa, unknown, or other
  misc_feature (115)..(115): Xaa is any aa, unknown, or other
  misc_feature (126)..(126): Xaa is any aa, unknown, or other
MGKGSVGASWWAFLLLAGVLLVVAATAGAEXRSGRTGPQGGPAVVQAGVRVAVRKGHPAEEGMXRASAASGTSKLTRGEDGDQAAWDAYVPXFGKGGRVAGASACXRXRGPAVGXPRSGMRRCRRXRTGRRHGSKSTVAAARARARPGRGASATPRGLVGEQRC

SEQ ID NO: 16231 - DNA, 733 bp, Zea mays
  misc_feature: Ceres CLONE 1379873-F
  misc_feature (519)..(519): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (692)..(692): n is a, c, t, g, unknown, or other
  misc_feature (693)..(693): n is a, c, t, g, unknown, or other
  misc_feature (720)..(720): n is a, c, t, g, unknown, or other
aaactggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcaaaataataaaaaaaataataaaaactagtactaacgcaatccagcttttctccttataaagaaatcaatggataaatttaaaaaaagcagagcatcaaaccaagaaaaaaaactgatgtcacgaacttgacagttgacttttcgcgcaaacaacaacnaaacacctacgtactgtgctctgcttatggatacatacatgcatactagtactcaatatccaannnnnnnncccccccccaagaacccctttttttggggaaatttggaaaaaaaaggggggggggaacaaaactctcccaattcccgaaatgtgggacgtgtgatgcataannaggggggggggggggttgaaaaaaggnttcccctcgtgag

SEQ ID NO: 16232 - DNA, 690 bp, Zea mays
  misc_feature: Ceres CLONE 1379885-F
  misc_feature: Encodes the peptide sequence at SEQ ID NO. 16233
ctcgaactagtggatcccccgggctgcaggaattcgcacgagaccattacctagaacatcctaatcgaaaatcatttttctctctcctgcgccgcgacgtccctcgccttcgccgccgaatccgagactccgatctcgggttcaccgcagggcacagagcagccccgactcccggaccgatccgcgctctcctctccgtcgcttcagtcatggcaggaatgagacctgagggttctcagttcgatgctaagcactatgattctaagatgcaggagctgctgagcactggtgagactgaggaggtcttcacttcatatgatgaagtttttgagagttttgatgatatgggcctccaagagaatcttctgagaggcatttatgcttatgggtttgagaagccctctgcaattcagcagagaggaattgttcccttctgccagggtcttgatgtcattcagcaagcccaaactggtaacaggaaagacaacaaccttttgttctgggaacttgcagaacctggactatggcctggttgaatgccaaggtccgggcccttggtccccccccgggagctcgcgccgccaatcgtagaaagccctggcaggggcttggcgaataacctggggggaaaagacccatggcatgtgggggaaggaaaaactcggtccctgaaggaatataagggatctt

SEQ ID NO: 16233 - protein, 108 aa, Zea mays
  misc_feature: Ceres CLONE 1379885-F
MAGMRPEGSQFDAKHYDSKMQELLSTGETEEVFTSYDEVFESFDDMGLQENLLRGIYAYGFEKPSAIQQRGIVPFCQGLDVIQQAQTGNRKDNNLLFWELAEPGLWPG

SEQ ID NO: 16234 - DNA, 746 bp, Zea mays
  misc_feature: Ceres CLONE 1379892-F
  misc_feature: Encodes the peptide sequence at SEQ ID NO. 16235
tccccgcggtggcggccgctctagaactagtggatcccccgggctgcaggaattcgcacgagaccattacctagaacatcctaatcgaaaaattttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgttttctcaagcagctcaagcccggcctgctccttatctctgggcctttcaagatcaatggagtaccgatccgccgggtgaaccagacccatggtcattgctacctcaaccaaagttgccatctccgggtgccgatgctcccccaagttgatggaaagtacttttggccgcgtagaagaattcagaaggtggagcaacccccaagtgccaactttttcggaacagaaaaaggagggattccaaggcccctggcctgaacttccagaagggagtgcccagaaagggctggcggaattcatggtcctgaaacaaa

SEQ ID NO: 16235 - protein, 143 aa, Zea mays
  misc_feature: Ceres CLONE 1379892-F
  misc_feature (1)..(49): Pfam Name: Ribosomal_L6e_N Pfam Description: Ribosomal protein L6, N-terminal domain
MAPTSKLSTGIKRASRSHAYHRRGLWAIKAKNGGAFPKADKAAAAVEPKFYPADDVKPRVPSTRKPKPTKLRSSITPGTVLILLAGRFMGKRVVFSQAAQARPAPYLWAFQDQWSTDPPGEPDPWSLLPQPKLPSPGADAPPS

SEQ ID NO: 16236 - DNA, 688 bp, Zea mays
  misc_feature: Ceres CLONE 1379894-F
caccattacctagaacatcctaatcgaaaaaaagaaaaacctaatgcccagtcctgaatcacgtcttcacccgtggtcgtgcgatgcactcatccccttccgcctccacattcctcattgtatggtgagaagaacatcacaagcaagtactcctggctgctacagcagtcgcttgaggttgttacgaagaaccacaacgaagcgcccctgatgttcctgaatgaccacctctactacagcggcgggtatgcctgcgacatcctcctcctaggctagctgattgaggcttcctacttcgatcaaaaggagagcatcacccataactatcctcaacggtgtggccccccactacgtacttaagtgataaaggatcaagggtgtaacaccaggtacaccgcgtgcagttatatattccccgaccgcccttcgggtagaccacagggtaatgagagttttattgcaaacattggcacccgagccacagccttgaaaggatgtggaactcagctcgttttcacattgcactcaaactcaattgaagagtctccagcgaacatcgcaagcttcctgagtatctactataagaccgggttgagtccaagaaaaacgggtatcatcgcttaggtagaagcgggggaggcgcaaggagagagaaatcctgattccgatactgcgaatggttaaccat

SEQ ID NO: 16237 - DNA, 721 bp, Zea mays
  misc_feature: Ceres CLONE 1379899-F
  misc_feature: Encodes the peptide sequence at SEQ ID NO. 16238
  misc_feature (515)..(515): n is a, c, t, g, unknown, or other
  misc_feature (526)..(526): n is a, c, t, g, unknown, or other
cgcggtggcggccgctctagaactagtggatcccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcggccgagtcctggggtaccggccgcgccgtgtctcgtatcccccgcgtccccggcggcggcacccaccgcgccggccagggagcgttcggcaacatgtgccgcggcgggcgcatgttcgcgcccaccaagatctggcgcaagtggcaccgccgcgtcaacatcaacctcccgcgngttgccgtcgnctccgtgctcggcggcaccggcgtgccgggcctcgtccaggtgcgcgggcaccgcatcgagtctggcccccagatggcccctggcatttccgaatccccggagtccattgaaaaacctcccaggggcttcagatcttcaagcaaatcggggcccaccccgacgccgaaaaggccaaggattccgtcggatccgcc

SEQ ID NO: 16238 - protein, 192 aa, Zea mays
  misc_feature: Ceres CLONE 1379899-F
  misc_feature (23)..(191): Pfam Name: Ribosomal_L4 Pfam Description: Ribosomal protein L4/L1 family
  misc_feature (128)..(128): Xaa is any aa, unknown, or other
MVAVNRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNINLPRVAVXSVLGGTGVPGLVQVRGHRIESGPQMAPGISESPESIEKPPRGFRSSSKSGPTPTPKRPRIPSDP

SEQ ID NO: 16239 - DNA, 697 bp, Zea mays
  misc_feature: Ceres CLONE 1379903-F
  misc_feature: Encodes the peptide sequence at SEQ ID NO. 16240
ggcggccgctctagaactagtggatcccccgggctgcaggaattcgcacgagaccattacctagaacatcctaatcgaaaaaaaattcgtcatattttctctcctcccctggtcccttctcgctctcgcccgcgtaattcctctctggcgtctaccaaaagcggagcaaccgaggtaagaaaaaggggtgggcgaggaaaagcgattaggcttctcttccagttcctgagtcaaactgagaaacaatggatatctgaagcatgaagagtcaacccacctcactcttttaaacaggtcgggtaacacacttaaaggctgcggcgtttgcatgacattctctttgagcttatatgggtggctggattggtaatttaagcagatctcagtcacttccagactctaaaccaaagcgatctttgagaaagaaatatcaggattcatcgactggaaacagaagacgatggcaatcgggtctataagcaatggagaagaatgttagcatatctgtttctcttgaggggaatatctcttctattcccaattcaatagccaacgactctaaaacgtcagtggaaaaacagggaagatacatcattcatcaaccatgcggctgaagcatgggctgagatgataacacaatgggttggacgccaggcagaagttctgagaaagaccccccgagagccagtgataagtt

SEQ ID NO: 16240 - protein, 42 aa, Zea mays
  misc_feature: Ceres CLONE 1379903-F
MGGWIGNLSRSQSLPDSKPKRSLRKKYQDSSTGNRRRWQSGL

SEQ ID NO: 16241 - DNA, 695 bp, Zea mays
  misc_feature: Ceres CLONE 1379907-F
  misc_feature (287)..(287): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggncagaatcaagagagagatagcaggggggctagctagctgagctcgtgcgaccaaaaatgggccgaatttgcaggaacatggtgggcgccgcttctggtggctcaccctcatcatggaaatcatcgtcatcggcttcgccgagctgaaccctgaaccactttcatcacgggcagaccactaaccccgggggtggccgaaaggggggcgacgtctaattttcctgggggtcccacctgcgcccccccctggggggtgggggccccccgggccacaaaatgtggggggggggggacaccagggggggccgggggccccaaaaagcctggccccaaaagcgcgggggggggtttatttcgcgggggcaaaaccggggctcccccttttggggggggcacaggggaggaaacc

SEQ ID NO: 16242 - DNA, 839 bp, Zea mays
  misc_feature: Ceres CLONE 1379912-F
cgctcagaactagtggatcccccgggctgcaggaattcgcacgagaccattacctagaacatcctaatcgaaaaatgctcttcgccccctcgcgcttaccgctgccgcgcctcccgactcgccgcctccgactagctccgggctctccaatgacctccatgatcgacatcttcaaggcctcggcgccgggccccgctcgcggtacaccgccccacgcatgccccgcccgaagaccgcgagggtggagctatctacccaacaaaggcaccaacagccagggagtagctcgcctccaaggtcgaaatgggccaccacagccctctgagccaagaaaaaacacaccaccgctttccccaccccccagccaaggccgccccaacacccctccaaaggcagcgcaaaagcacacacatcacgacctcacagccccaaacaaacttggtcggcacgaccgaccaaaagaaaaaccccctgagaaactaaacccaggaacgcaacactctggccacccccgtgggcaccctacaagacacaagacctgacacatccaaaaaagaggatccaaacagcacgcccacccccaaaacatacgggtaccccaagcctcacgacaaaacaaccactacggcaccgacccttcacacaccgcacaccgacacgctcaaaaaacgtagacctcactccaaccacgaccacagcgacctagcgacacactagcacacaccccaacacgcacccccctccctgtcgcactacttcaacgaagtactaacactcgtcccacgcactgccagtgaaccatacgcacaacaacaccgcgaccgcatacatgtggcgcg

SEQ ID NO: 16243 - DNA, 879 bp, Zea mays
  misc_feature: Ceres CLONE 1379919-F
  misc_feature: Encodes the peptide sequence at SEQ ID NO. 16244
caccgccccccccccctcctccccaccacccccccttgcccccccacccaactgcaacaccactcgctggcggacgctctaaaactagtggatcccccgggctgcaggaattcgcacgagaccattacctagaacatcctaatcgaaaaaggagaggggagcgagcgagcgagcaaccggcggcgacagccatggcggagcagcacaaggaggagtcgggcgtgacagtgctggacaagatctccgacaagctccacgggcgagggggcggctcgtcctcgtcgtcggactcggacgacgagcgctcgtcggcgacggccgccgtgaaggacaagatctaccgcatcttcgggcgcgagaagcccgtgcactccgtcctcggcggcggcaagccggccgatctgtccctatggtaggaaccaagaggacctctggcggggtgctcgcagcgcgcaaccgcccctctgcgctgctgccttgcaggccatggcatcaaccaccctccttcacccgtgtctatggcccctggcctcatccctccagccctgggccactcctggtctccccctggaccagatggccccgcgatcttttcacttaaaaacacggcccccctccttaaacaatccccccgaggggcgcacagagtccctcacgatgccacccgggcgtggagcaacgggtgccccccgttaccccgaggagaattaggggaatctacccacagctcttttcccctgaccttggaccggaaaaaccgggcacccagacaaacacgactcccccaagcagaactctccttgtaccgccgccttgcgacgggacgtggcggccctccatattactagctcttactcggacgcttttgcgccatcctcc

SEQ ID NO: 16244 - protein, 74 aa, Zea mays
  misc_feature: Ceres CLONE 1379919-F
MAEQHKEESGVTVLDKISDKLHGRGGGSSSSSDSDDERSSATAAVKDKIYRIFGREKPVHSVLGGGKPADLSLW

SEQ ID NO: 16245 - DNA, 928 bp, Zea mays
  misc_feature: Ceres CLONE 1379923-F
  misc_feature (21)..(21): n is a, c, t, g, unknown, or other
cccccctcctccccctccccntgaacccccgccaccacccaaggtggaactcaccgcggtggcggccgctctagactagtggatcccccgggctgcaggaattcgcacgagaccattacctagaacatcctaatcgaaaacgtgccacacatccatccccgttcgcctcttctcctccctcctgccgggtccttaataaagagcagcagcgcaagaggttggtagagcgagcgacaacaaggcaatgccggcggagagcttcctgttcacctcggagtccgagaacgaggggcacccaggacaagctgtgcaaccaggtgtcgaacgcgctgctgaacgcatggcctggcgccacgaccccccacagcaagggcgcctggcgcgacctgcccccgagactaacttgggtgatgcgtgaaccatcccgctcccccgccaagggggaactgttggactaccgacacacaccccccgcggcgaacacccttggcccggcaggcatggggccatcactctgccgaagaacgatgtgagcctccccacttccactcccaccttgtacagggtggccggtgcggaaaaccctgtccaacggcaggtcgggcgccccccgagccgctctggcccgagcgggggatgtggctccgcccgcactcccacctacgcacccgaagatccgcacaagcaaacccaagagcgcctcccagcacgccttccctccccctccaggtgcagagccgtaacgccactgcgcgaagaaggagcccccgccttcctgcatttcccccccgtcgtaccctggcctctgccccactacccccaccgccttcccacccccccccgcaccacgcctctgactgtccagatatcaccccatagccgtgctcttctctcacgggcgcgcgccaccaccccagggggaagcgag

SEQ ID NO: 16246 - DNA, 821 bp, Zea mays
  misc_feature: Ceres CLONE 1379934-F
  misc_feature: Encodes the peptide sequence at SEQ ID NO. 16247
  misc_feature (821)..(821): n is a, c, t, g, unknown, or other
acccgcggtggcggccgctctagaactagtggatcccccgggctgcaggaattcgcacgagaccattacctagaacatcctaatcgaaaagagaaatggcggccgtctcctccacctcaaccgcctcctcctacttctccccgcagccgcagctgccgatctccaccgccgaccctgccgccagcaaaagtaggttgatgcggcacccacggcggagcagcagcttcgtgatggtggaggcgtcctctgccagcggcagcgaagccggggtggccagaacgaagagcctcccggaggacgaccgtggaggagcctcaaagggctgcctcgatctccgcttcggattcgtgtacagggagatacccaaacctctgcgggacgcttgacccggggttcgaaatcctgggcaccccaggacccgggagggtacccccacgagcaacaaggcgccccggccctgggcagggggaacggggaagcctggggctccgcgcccgcctcccgcaggggcgagggatccgcctctaccccggctgtacgattcggagaaaccccgccccacccccgagggtaagaacgaatagccagcctctaaacgcggtggcagacgacccaggacaagcacacccgcctatctataaccacacccggggccccccatcgcacggccccaacaagatctggcggtccaaatgggctcgtcgcccaccccatgggcatcccgcgcatctgctacagacgccgcataccgtgcaacctagcgcgcatgcggattcgggcaactgccgtgagagtcgccagcgctcaccactaagcaggan

SEQ ID NO: 16247 - protein, 96 aa, Zea mays
  misc_feature: Ceres CLONE 1379934-F
MAAVSSTSTASSYFSPQPQLPISTADPAASKSRLMRHPRRSSSFVMVEASSASGSEAGVARTKSLPEDDRGGASKGCLDLRFGFVYREIPKPLRDA

SEQ ID NO: 16248 - DNA, 674 bp, Zea mays
  misc_feature: Ceres CLONE 1379945-F
  misc_feature: Encodes the peptide sequence at SEQ ID NO. 16249
  misc_feature (407)..(407): n is a, c, t, g, unknown, or other
  misc_feature (424)..(424): n is a, c, t, g, unknown, or other
  misc_feature (446)..(446): n is a, c, t, g, unknown, or other
  misc_feature (448)..(448): n is a, c, t, g, unknown, or other
  misc_feature (449)..(449): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaattccccctccggcgccgcctcccccagacacttcgccgccggcaagatgggccgcgtgattcgcgctcagcgcaagggtgcggggtccgtgttcaagtcccatacccatcaccgcaagggccctgcccggttccggtccctcgacttcggcgagcgcaacgggtacctgaagggcgtggtcaccgacgtcatccacgacccgggccgcggcgcgccgctggccaaggtcaccttccgccatccattccggtacaagcaccagaaggagctgttcgtggctgctgagggcatgtacactggccagntcgtttactgcggacgncgtgctacactctccattggcnanncgtctgcgctcagggggatccctgagggtgccgttgtctgcaacgttgagcaccacgtcggggatcgcggtgtcttcgccagggcgtctggggactacgcgatcgttatcagccataacccagaacacggaccatcgaggatcaagctcccctctgttgctaagaggattgtccaagtanctgccgtggcatgattggcaagtccctggtggtggcagactgaaa

SEQ ID NO: 16249 - protein, 164 aa, Zea mays
  misc_feature: Ceres CLONE 1379945-F
  misc_feature (11)..(90): Pfam Name: Ribosomal_L2 Pfam Description: Ribosomal Proteins L2, RNA binding domain
  misc_feature (87)..(87): Xaa is any aa, unknown, or other
  misc_feature (100)..(100): Xaa is any aa, unknown, or other
  misc_feature (101)..(101): Xaa is any aa, unknown, or other
  misc_feature (161)..(161): Xaa is any aa, unknown, or other
MGRVIRAQRKGAGSVFKSHTHHRKGPARFRSLDFGERNGYLKGVVTDVIHDPGRGAPLAKVTFRHPFRYKHQKELFVAAEGMYTGQXVYCGRRATLSIGXXSALRGIPEGAVVCNVEHHVGDRGVFARASGDYAIVISHNPEHGPSRIKLPSVAKRIVQVXAVA

SEQ ID NO: 16250 - DNA, 747 bp, Zea mays
  misc_feature: Ceres CLONE 1379946-F
  misc_feature: Translation starting site: 257
  misc_feature: SWISSPROT Homolog: EC 5.3.1.1 Triose-phosphate isomerase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (49)..(49): n is a, c, t, g, unknown, or other
  misc_feature (50)..(50): n is a, c, t, g, unknown, or other
  misc_feature (747)..(747): n is a, c, t, g, unknown, or other
nnnnnnnnnnnnnnnnnnnnnncctctnttcctcnncncccccgcgggnnggtcagagctggagctccaccgcggtggcggccgctctagaatagtggatcccccgggctgcaggaattcgcacgagaccattacctagaacatcctaatcgaaaaacaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtgggcaagagccagctgcgccaagagggggggtggtgcggctcagaactgctgggttaagaagggaggtgctttcaccggggaagtcagtgctgagatgctcgtcaaccttggtgttccctgggtcattcttggacactctgaaaggagagctctggctgggaggaatcaaatgaatttggtggagacaagggtgcgtatgccctgtctcagggactaaagtgcattgcatggggggggggagacacttgagccagaggggaggcggggtctgagcatgggagggtgggtgctgcacaaacaaaaggcaattggctgaggaagatcaacggactgggagn

SEQ ID NO: 16251 - DNA, 733 bp, Zea mays
  misc_feature: Ceres CLONE 1379949-F
  misc_feature: Encodes the peptide sequence at SEQ ID NO. 16252
  misc_feature (16)..(16): n is a, c, t, g, unknown, or other
  misc_feature (17)..(17): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
gggggccccccccccnnacccccaacctccggctccccccgggannnngccagagctggagctccaccgcggtggcggccgctctagaactagtggatcccccgggctgcaggaattcgcacgagaccattacctagaacatcctaatcgaaaaattatcacggcggcggcggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaacctccagctttgcaagggtaggcctgttcaggttgggcagaagggcatcacttatctgaacacgtatgacggccgcaccatccgctaccctgacccccctcatcaagggcaaacgacaccatcaagata

SEQ ID NO: 16252 - protein, 162 aa, Zea mays
  misc_feature: Ceres CLONE 1379949-F
  misc_feature (3)..(40): Pfam Name: RS4NT Pfam Description: RS4NT (NUC023) domain
  misc_feature (94)..(158): Pfam Name: Ribosomal_S4e Pfam Description: Ribosomal family S4e
  misc_feature (42)..(90): Pfam Name: S4 Pfam Description: S4 domain
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDANLQLCKGRPVQVGQKGITYLNTYDGRTIRYPDPPHQGQTTPSR

SEQ ID NO: 16253 - DNA, 672 bp, Zea mays
  misc_feature: Ceres CLONE 1379958-F
  misc_feature: Translation starting site: 255
aaagctggagctccccgcggtggcggccgctctagaactagtggatcccccgggctgcaggaattcgcacgagaccattacctagaacatcctaatcgaaaactttttctatatcgcgttacgtccctccctacccagcgatctaggccgccgcctctcctactgcatctccctcgctctcgtcgcctcgttcgcttcgcctcctccccgccccaccccgagccgagcagagcgcagccctatccggagctgggatggcggacgcgaagcagcagcagcagcagccacagcaggcggcagcggcagccaccggcgtgtggaagacggtcaagcccttcgttaacggcggggcctctgggatgctcgcgacctgcgtcatccagcctatcgacatggtcaagtgaggatccaattgggtgagggctccgctggtcagggcacaaggaacatgcttgcaaatgagggtgcccgttctttctaccagggttttgtctgcccgaattgctgaggcaaggcgacgtacccgactggtcgtccttgaatccctttagggtttctaactaaacaaagccagttggaaaaaaatggaaagggaagcccttggccctctaaattccaaaaagcttttttattgggcccggactggctgggggcaatttggggggtttggtt

SEQ ID NO: 16254 - DNA, 822 bp, Zea mays
  misc_feature: Ceres CLONE 1379960-F
  misc_feature: Encodes the peptide sequence at SEQ ID NO. 16255
  misc_feature (1)..(1): n is a, c, t, g, unknown, or other
  misc_feature (18)..(18): n is a, c, t, g, unknown, or other
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (822)..(822): n is a, c, t, g, unknown, or other
ntttccccccccggcccnncccccccttttgtttnnnnnaggggggggggcatagctggagctccccgcggtggcggccgctctagaactagtggatcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcggatctccctcccggccccgccgcgcgcaccggtgaagacgacgagcccctcgtgaatggtgggagcccgcgcgacgtccgtcgcctcgcagccgcagccggaggaggcctcccttccgcggcttcggttactgcatgcagggctggtaccaccgggggcatcgggtctcgaccccctggaacccccgccgccacttggctttctttggatttggattttcattccgggtcgcggtcgggggcccccctccccggtcccctgggaacttggttggcgcggagaaggggggggcaagcggccgcgaagaaattcgccccccccttcttcctttctccctaaggaaagccaggaaaacaaaagccccaccccggcccccctggaaccccccgccccccccaaggggccccccccgcgggggcccataagaaatttccttgggggggggggggaaaacccccgggggaaagggccccccccccgggaggggcccccaaaaaacccccccggggctttccgggggagacacgggaaccccccccccggggaccn

SEQ ID NO: 16255 - protein, 96 aa, Zea mays
  misc_feature: Ceres CLONE 1379960-F
MQGWYHRGHRVSTPWNPRRHLAFFGFGFSFRVAVGGPPPRSPGNLVGAEKGGASGREEIRPPLLPFSLRKARKTKAPPRPPWNPPPPPRGPPRGGP

SEQ ID NO: 16256 - DNA, 850 bp, Zea mays
  misc_feature: Ceres CLONE 1379971-F
  misc_feature: Encodes the peptide sequence at SEQ ID NO. 16257
  misc_feature (45)..(45): n is a, c, t, g, unknown, or other
  misc_feature (48)..(48): n is a, c, t, g, unknown, or other
  misc_feature (850)..(850): n is a, c, t, g, unknown, or other
ggaccccgcccccccccccccccctccccaccccctcccccgaancanacaaactgggactccccgcggtggcggccgctctagaactagtggatcccccgggctgcaggaattcgcacgagaccattacctagaacatcctaatcgaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcaacagcagcagaagcagggcgccatgatgacggcgctcaaggccgcgacggccgcgaccttcggcgggtcgatgctggtgctgtccgggctgatcctggccggcaccgtgatcgcgctcacgggggccacccacgggcccccccgatcttcagccccggtgctggagccgggccgccaatcccgatgggcgatcatgagtggcccggcactcgaccccccgcccgggagggcctccagcggtcaacctgccgcatgcgccgagaggtgcgccccaggggaagggcaaaaggaaacgctgacacgggcccaagcctctccggtgccggagaatcgaagtgagcttggcacccacctccccaagccgccaaggctcgtccgaccaccacggaccccgctaaacttacctaggacgggcggcgcccaagcaaggcgcatgcggaacgagccactagcggcgttagcggaaagaagacaaaagagggtctcagcccggaatccgccccggatcgaccacacgcgtggaan

SEQ ID NO: 16257 - protein, 203 aa, Zea mays
  misc_feature: Ceres CLONE 1379971-F
MADHHRGATGGGGGYGDLQRGGGMHGEAQQQQKQGAMMTALKAATAATFGGSMLVLSGLILAGTVIALTGATHGPPRSSAPVLEPGRQSRWAIMSGPALDPPPGRASSGQPAACAERCAPGEGQKETLTRAQASPVPENRSELGTHLPKPPRLVRPPRTPLNLPRTGGAQARRMRNEPLAALAERRQKRVSARNPPRIDHTRG

SEQ ID NO: 16258 - DNA, 873 bp, Zea mays
  misc_feature: Ceres CLONE 1379976-F
  misc_feature (36)..(36): n is a, c, t, g, unknown, or other
gaccacccacccccctcctcccccccgcccccccgncaacatctccccctacgctggagctccccgcggtggcggccgctctagaatagtggatcccccgggctgcaggaattcgcacgagaccattacctagaacatcctaatcgaaaatctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggccgccggcctgaccgacgatgatgggcgccggcgggctgtacccctacgcggagtacctgaggcagccgcaggtgcagcccgctgtttggcggcgccctactaccccgcggagtgggcccgccgagcgccatgttccccgccgcctcccggcaacaggtgcctgccacccaccacaatgaggatcgactggaccgcgcaaccccgtcccccgcacgcaacttgccaaacggaggatagccgctctcggagcgtggcccgttggcagtcccagcaacgccgcccctgtacccaagcccaccctccttacatgccccctcccaacgcagcccaccctagcttgtcccatcccccggtgtctacgaacccccctatgggtcactgtcatgagggtcacgcacgaactttgcgcccagcctacttccgcgtggcgcgccagcgccctatcgcctagccgggccccgcgtctcccgcctccctcacgcctcccgtccgccaccatcacacggtggcgctcactccccctcgcgcattctcatatacgtccat

SEQ ID NO: 16259 - DNA, 693 bp, Zea mays
  misc_feature: Ceres CLONE 1379977-F
  misc_feature: Encodes the peptide sequence at SEQ ID NO. 16260
  misc_feature (276)..(276): n is a, c, t, g, unknown, or other
  misc_feature (279)..(279): n is a, c, t, g, unknown, or other
  misc_feature (306)..(306): n is a, c, t, g, unknown, or other
  misc_feature (353)..(353): n is a, c, t, g, unknown, or other
  misc_feature (363)..(363): n is a, c, t, g, unknown, or other
  misc_feature (366)..(366): n is a, c, t, g, unknown, or other
  misc_feature (367)..(367): n is a, c, t, g, unknown, or other
  misc_feature (373)..(373): n is a, c, t, g, unknown, or other
  misc_feature (374)..(374): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (412)..(412): n is a, c, t, g, unknown, or other
  misc_feature (435)..(435): n is a, c, t, g, unknown, or other
  misc_feature (438)..(438): n is a, c, t, g, unknown, or other
  misc_feature (445)..(445): n is a, c, t, g, unknown, or other
  misc_feature (529)..(529): n is a, c, t, g, unknown, or other
  misc_feature (534)..(534): n is a, c, t, g, unknown, or other
aaagctggagctccccgcggtggcggccgctctagaactagtggatcccccgggctgcaggaattcgcacgagaccattacctagaacatcctaatcgaaaaaaccaagcagagcaaagagagagacgcggagccaccgcgttccggagagagacgcggagagccaaggcaaggcagctgtcgccgcagcgacgatgtggagctcgggctctgaccgcgacgaggccctagacacggcgaacgcctcgtcagtcgacgcttcgtcgcccgcgcggnagncgtccacgccgcccccgccgcctcggngccggcgccagcgcgcgcgacgccgcgctcaccgcctccgtgccagnaacacgggcncanngagcgnnagagnnnagaggactcctggaggccgacccggacgcgnacgacgtctggcgcgggctgcancancaacggnaagcggaaggcctggctgcggcgggcgtccaagccccggggtgtggtccgccggcgaggaggggtccccctccggacgcctccnccggnttcggggaaaaaacgccgggtttggggaaggtcccgaaaccttgaccaacgacgaccctggaggggcccaagggggggcgggggatctggggttcgggtttcggcttaccgggaaatcccccgaatttgtgggggaacgtttgccggccctccaccctc

SEQ ID NO: 16260 - protein, 166 aa, Zea mays
  misc_feature: Ceres CLONE 1379977-F
  misc_feature (28)..(28): Xaa is any aa, unknown, or other
  misc_feature (29)..(29): Xaa is any aa, unknown, or other
  misc_feature (38)..(38): Xaa is any aa, unknown, or other
  misc_feature (53)..(53): Xaa is any aa, unknown, or other
  misc_feature (57)..(57): Xaa is any aa, unknown, or other
  misc_feature (58)..(58): Xaa is any aa, unknown, or other
  misc_feature (60)..(60): Xaa is any aa, unknown, or other
  misc_feature (62)..(62): Xaa is any aa, unknown, or other
  misc_feature (63)..(63): Xaa is any aa, unknown, or other
  misc_feature (73)..(73): Xaa is any aa, unknown, or other
  misc_feature (81)..(81): Xaa is any aa, unknown, or other
  misc_feature (82)..(82): Xaa is any aa, unknown, or other
  misc_feature (84)..(84): Xaa is any aa, unknown, or other
  misc_feature (112)..(112): Xaa is any aa, unknown, or other
  misc_feature (114)..(114): Xaa is any aa, unknown, or other
MWSSGSDRDEALDTANASSVDASSPARXXSTPPPPPRXRRQRARRRAHRLRAXNTGXXSXRXXRTPGGRPGRXRRLARAAXXTXSGRPGCGGRPSPGVWSAGEEGSPSGRLXRXRGKNAGFGEGPETLTNDDPGGAQGGAGDLGFGFRLTGKSPEFVGERLPALHP

SEQ ID NO: 16261 - DNA, 720 bp, Zea mays
  misc_feature: Ceres CLONE 1379980-F
  misc_feature (44)..(44): n is a, c, t, g, unknown, or other
  misc_feature (45)..(45): n is a, c, t, g, unknown, or other
  misc_feature (56)..(56): n is a, c, t, g, unknown, or other
  misc_feature (57)..(57): n is a, c, t, g, unknown, or other
  misc_feature (59)..(59): n is a, c, t, g, unknown, or other
ttttttttttttttcctttcccctcccgccctccccccaccggnnccctgtggttnngntcatagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacgcgcggcgcccaacgccaccctacgggccagcaaccagcagcaagggaaggaggccgggcggccccgatggggtcgagcacggggaaaggcatggctcccacgacaaaggggccgaacggcgctcacagggcgtcttgcccggtgggtgaacgcttggttcccccgccggggcacgcgacctcgcatgacctggcattctctagtccctggggttttgggatgactaatacgggccttccggggagggagggagccctgcactcgcggtcaccccccccccggggggtcccttggataccttatccccccccgggggtgcctgccccccccccgggccttgttctcactcggaagggcgccaccccggggcgcccccccccccccggctcgcgcccgcccgcggcggcccccgtgagcccccgg

SEQ ID NO: 16262 - DNA, 707 bp, Zea mays
  misc_feature: Ceres CLONE 1379981-F
  misc_feature: Encodes the peptide sequence at SEQ ID NO. 16263
  misc_feature (354)..(354): n is a, c, t, g, unknown, or other
aaagctggagctccccgcggtggcggccgctctagaactagtggatcccccgggctgcaggaattcgcacgagaccattacctagaacatcctaatcaaaaactcgatttcgattctttctttttcccccacgtgcgccgccgcgaccttcctcgatcccatctcccaacgcccccgcctcgcctcgggatcccgccgccgctccatctgcctttgctcccccacccgcaggcagcgagcgacagcgacggcgagggatggccaaggccaggtcgttggcgaagcagaagcaggcgcagcaatcaaacggcggcggcggccacgcgctgtcctccaagctcgcccggtacctcngaccggaggcctccttggacaaggaccaactgctggacgcggtgcactggatccgccaggcggtggggctcatatgcgggctgctctggggagccgtccccctcctcgggggccgtctggatcgcactatttatggccaggtcgactggcattatctattgggactacaccctacttgcttgaagttgacgaagaaggaaaatggaggcccatgggggggcttcttccaggaggggcctttttccgttcaattaacccctttttccgggtttttcggggaaccccaaggaaaacaggcctgggctccccttctgggaaaaacccccctttggggggccaaataccctttgtgt

SEQ ID NO: 16263 - protein, 150 aa, Zea mays
  misc_feature: Ceres CLONE 1379981-F
  misc_feature (18)..(129): Pfam Name: Rab5ip Pfam Description: Rab5-interacting protein (Rab5ip)
  misc_feature (33)..(33): Xaa is any aa, unknown, or other
MAKARSLAKQKQAQQSNGGGGHALSSKLARYLXPEASLDKDQLLDAVHWIRQAVGLICGLLWGAVPLLGGRLDRTIYGQVDWHYLLGLHPTCLKLTKKENGGPWGGFFQEGPFSVQLTPFSGFFGEPQGKQAWAPLLGKTPLWGAKYPLC

SEQ ID NO: 16264 - DNA, 602 bp, Zea mays
  misc_feature: Ceres CLONE 1379988-F
  misc_feature: Translation starting site: 212
  misc_feature: Pfam Name: FAD_binding_2 Pfam Description: FAD binding domain
  misc_feature: SWISSPROT Homolog: EC 1.3.5.1 Succinate dehydrogenase (ubiquinone)
agagctggagctccccgcggtggcggccgctctagaactagtggatcccccgggctgcaggaattcgcacgagaccattacctagaacatcctaatcgaaaaacgctctcctctccagtctccaccaacgtcctccccccaccgcaccgcaccgcaccgcaccgccctccccaccccgcgcgtgcgccgccgccgcgagatccggggcgcgatgtggcgcagctgcgtctcgcggggtctctccagggccaaggcctccgcctccaggctcctctccacggcatcgtcgtcctacacggtggtggaccacacctacgacgcggtcgtggtgggggccggcggcgcggggctccgggcggccatcggcctctccgagcacggcttcacaccgcgtgcatcaccaagctcttcccacgcgctcgcacaccgtcgcagcacagggaagcataaatgccgcacttggaaacatgagtgaagatgattggaggtggcacatgtatgacactgttgaagggaagcgattggctcggggaccagattctattcaggatatggggagaaaaacaccaaaaactggtaaaaagctgggaaactatggaata

SEQ ID NO: 16265 - DNA, 676 bp, Zea mays
  misc_feature: Ceres CLONE 1379991-F
  misc_feature: Translation starting site: 353
  misc_feature: SWISSPROT Homolog: EC 1.2.4.1 Pyruvate dehydrogenase (acetyl-transferring)
  misc_feature: SWISSPROT Homolog: EC 1.2.4.4 3-methyl-2-oxobutanoate dehydrogenase (2-methylpropanoyl-transferring)
  misc_feature (252)..(252): n is a, c, t, g, unknown, or other
  misc_feature (258)..(258): n is a, c, t, g, unknown, or other
  misc_feature (303)..(303): n is a, c, t, g, unknown, or other
  misc_feature (357)..(357): n is a, c, t, g, unknown, or other
  misc_feature (367)..(367): n is a, c, t, g, unknown, or other
  misc_feature (389)..(389): n is a, c, t, g, unknown, or other
  misc_feature (416)..(416): n is a, c, t, g, unknown, or other
  misc_feature (425)..(425): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaatcgaaaaataatttcccctcattcatctcacagtcccaggcctcccctccctcctccccgtcgccaaccaacctccaacccccagccgatcgcgtcggagatgctggggcgtcgcgcggaggcggctcggatccggatgcgtgctcgcccagctggngcaggncctccgccccgccgccgctcccgccaggacctactccgccgcggncaaggagataactgtacgggaagcattgaataccgcattagatgaagaaatgtncgcagacccnttctgttttctgatgggagaangaggtggcgagtaccaaggtgcatacnagatatccnagggtttgcttgacaagtatggccccgaagggttctcgatactccgatcactgaggcgggctccactgccattggtgttggntgcgcttaccatggtcttcgacctattggagaggtcatgaaatttaccttttcgatgcaggaaatggatccctaattaatttcagctggcaggccgaactacatggctgcttgggcagaatatcggttctaattgcctttaaggggcccaaatggtgctgttggtggag

SEQ ID NO: 16266 - DNA, 674 bp, Zea mays
  misc_feature: Ceres CLONE 1379994-F
  misc_feature (377)..(377): n is a, c, t, g, unknown, or other
  misc_feature (385)..(385): n is a, c, t, g, unknown, or other
  misc_feature (457)..(457): n is a, c, t, g, unknown, or other
  misc_feature (522)..(522): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaatcgcacatattattgagaccaactagcaacatagaaagcacaatattgtaccaataatggcagccaaaatattttgcctcattatgctcccttggtctttctgcaagtgctgctacggcgagcattttcccgcaatgctcacaagctcctatagcttcccttcttcccccatacctctcaccagcgatgtcttcagtatgtgaaaatccaattcttctacccctacagatccaacaggcaatcgcagcaggcatcttacctttatcacccttgntccctccnacatcatcagccctattttacacagtacctttggtgcatttattgcacaaaacatcagggcacaacactacnacaactcgtgctagcaaacctttgctgctactctcagcaacagcagttacctttggtgcatttgntgncacaaaacatcagggcacaacaactacaacaactcgtgctaacaaaactttgctgcctactctcagaaacaacagtttcttgcattcaaccaactagctgcattgaaactctgctgctttatttgcggcaacaacaactactacccatc

SEQ ID NO: 16267 - DNA, 759 bp, Zea mays
  misc_feature: Ceres CLONE 1379996-F
  misc_feature (42)..(42): n is a, c, t, g, unknown, or other
  misc_feature (759)..(759): n is a, c, t, g, unknown, or other
aaaacacaacaaacaaaacacaccccccccccctccccgccngcgaaaagaacagaagctgggctccaccgcggtgggggcgctctagaactagtggatcccccgggctgcaggtaattcgcacgagaccattacctataacatcctaatcgaaaatattattgagaccaactagcaacatagaaagcacaatagtggaccaacaatggcagccaaaatattttgcctccttatgctccttggtctttctgcaagagctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgtggctcggacgatcatcacccctattacatcagataccttttggggggctttattgggcccaaaacatccgagcgccacaacctacaccactgtgggctaagaaaccttggctgcctactctcaagaacgggaattttcttccattcaacccaactaactggcattggaaatgtcgctgcttttattgcgaccccccacccccaccacccccggccagctaccctcgctgccccaccccccagccatcgtctctccttttcaacccaccctcggcagccatctcgaaactctccccctgggcctttttttagacacggacgcacctctaccatccatn

SEQ ID NO: 16268 - DNA, 741 bp, Zea mays
  misc_feature: Ceres CLONE 1379999-F
  misc_feature: Encodes the peptide sequence at SEQ ID NO. 16269
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (45)..(45): n is a, c, t, g, unknown, or other
  misc_feature (741)..(741): n is a, c, t, g, unknown, or other
nttttttttctcttttttnnnntcccccccccctccccgccgcgnaaaaaaaacagagctgggactccaccgcggtggcgggcgctctacaactagtggatcccccgggctgcaggaattcgcacgagaccattacctagaacatcctaatcgaaaatcgcccagttataaatactcttgcgaaagggttagatatacgcctcaaccataagggtgtggaaattggtcgccaccggaacagggtagaggttactgtaagcaggggtcaaacattcgatgcggacgcagaaggggtcactgttccgttgggtgtcctgaaagcgaaaaccatcagatttgagccgaggctgccagagtggaaagaagaggcaatcagagaactgacggttggaggtgagaacaaaattgttctgcacttcggccagggtttctgggctaacgtggaggtcatcgggggcgtttcctctagcagcggatgggtggaggtatttcctccagccttcacaaggtaacaggccaccctgggcttgttgacatgcctgccggcccgaccttgcgtcctgacgattgagaagatgtcaggatggaggcttggtggcgcgaaggtgcccttttcctcaggcggaagagagacccttccccaagggcagtgtgaagcccgatgcaattaccccggcggggcgcccccggggggctacggaacggagaacagcactttggggttccctaactgcgttctcn

SEQ ID NO: 16269 - protein, 45 aa, Zea mays
  misc_feature: Ceres CLONE 1379999-F
  misc_feature (6)..(6): Xaa is any aa, unknown, or other
  misc_feature (7)..(7): Xaa is any aa, unknown, or other
  misc_feature (15)..(15): Xaa is any aa, unknown, or other
FFSLFXXPPPLPAAXKKQSWDSTAVAGALQLVDPPGCRNSHETIT

SEQ ID NO: 16270 - DNA, 724 bp, Zea mays
  misc_feature: Ceres CLONE 1380002-F
  misc_feature (20)..(20): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (55)..(55): n is a, c, t, g, unknown, or other
  misc_feature (423)..(423): n is a, c, t, g, unknown, or other
  misc_feature (724)..(724): n is a, c, t, g, unknown, or other
tttttttttttggttttttnnttttgttatttgtacnnagagggggggggggggnggggcaaagtgggactccccgcggtggcggccgctctagaactagtggatcccccgggctgcaggaattcgcacgagaccattacctagaacatcctaatcgaaaagtcaatgcaagtttgtccattcgcattggtctgaatactgtagctactagcgcgagtgccactgtgccgcagctgcctggctcccattactgcaaggtggggtcaatcaaaggttaagttaggggtcccttctacgttctgggggcccggcgtgaggcggggttgggggcgggggcctaacgcgaaagggggggcgggtggacgaaggccccccccggggggggggggggggcagggcgcgcgggggggggggcttgttgcnttggtggggcgttgggggggggcccgcgggcgggcgggccgcgggggcgtgcggggcgaagatgtggggggcgccggcggcgcgcggacggaagcgtgcgatcggcagccggagcgggcgggcgcgcgcaccccgttagtttgttggtgggcttcacctcgccgcgcatggagcccggtggggggggcggagggtgccgccccgcccgcacgcgacccccccactcccctagcgtccgccgcgcgtaagatggaggggggagatggggcggcggcggtggtggcgcccacacaaaaaaacn

SEQ ID NO: 16271 - DNA, 657 bp, Zea mays
  misc_feature: Ceres CLONE 1380003-F
  misc_feature: Encodes the peptide sequence at SEQ ID NO. 16272
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaaaagaccaagatagaccacccaagcattgaagccgtagccgccgccgccggacgagacaggttgaggcggggcggcaatggccgccggggaccttgaggtgctcaccgcgctcgacaccgcgaagacgcaatggtaccacttcaccgccatcgtggtcgccggcatggggttcttcaccgacgcctacgacctcttctgcatctccctcgtgactaagctcctcggccgcatctactacaccgtggaggggtccgcgacgcccggcaccctcccgccgcacgtgtccgcgtccgtcaacggcgtggccttcgtgggcacgctgtcagggcagctcttcttcggctggctgggcgacaagctcgggcgcaagaaggtctatggcatgacgctcatgctcatggtcctctgttccgtcgcgtcggggctctcgttcgggcacaccccggcgtccgtcatggcgacgctgtgcttcttccgcttctggctcggggtcggcatcggcggcgactacccgctgtcgncgaccatcatgtccgagtacgccaacagaagacc

SEQ ID NO: 16272 - protein, 159 aa, Zea mays
  misc_feature: Ceres CLONE 1380003-F
  misc_feature (149)..(149): Xaa is any aa, unknown, or other
MAAGDLEVLTALDTAKTQWYHFTAIVVAGMGFFTDAYDLFCISLVTKLLGRIYYTVEGSATPGTLPPHVSASVNGVAFVGTLSGQLFFGWLGDKLGRKKVYGMTLMLMVLCSVASGLSFGHTPASVMATLCFFRFWLGVGIGGDYPLSXTIMSEYANRR

SEQ ID NO: 16273 - DNA, 734 bp, Zea mays
  misc_feature: Ceres CLONE 1380006-F
  misc_feature: Encodes the peptide sequence at SEQ ID NO. 16274
  misc_feature (22)..(22): n is a, c, t, g, unknown, or other
  misc_feature (26)..(26): n is a, c, t, g, unknown, or other
  misc_feature (46)..(46): n is a, c, t, g, unknown, or other
aaaaaaaaccccccaccccccncctntccccccccgcccgtcgccnggggagaggagcagagctggagctccaccgcggtggcggccgctctacaactagtggatcccccgggctgcaggaattcgcacgagaccattacctagaacatcctaatcgaaaaaatcagaaatcgacgagtgatgtacgtaactgatccagccaccccggtcgagtgccacccactccacggcgccgaatcgcagataatgtagagtgcgccgcgccgtgacggcgtggatgagaaagcctccaaacctctctgtttcgggctctccgtccccggcgtccaacacccatactctccccaggttgtgtgccacacccacactcaactatatacgaaaaccgccggcgcctggcccctaggccctagtcacagacccttgttctttcttcgacgcgcccccgggcatggcgaaccgcagtgttgccatgggcttggccctcgcgttcgtggccatgaccgcgctctgttgcgcgccgggcgccgcggagttgccccggctggaccacccggccaggagcgacggatcgctgaagctgctcgccgtcggggactggggacgcaaggggactcacaaccagttccggatcgccgaccaggatggggaagggtcggaggagaaggctcgatatcgaactgtggttataatccacccgggggacaaccttcctacaagaaacgggccctcca

SEQ ID NO: 16274 - protein, 94 aa, Zea mays
  misc_feature: Ceres CLONE 1380006-F
MANRSVAMGLALAFVAMTALCCAPGAAELPRLDHPARSDGSLKLLAVGDWGRKGTHNQFRIADQDGEGSEEKARYRTVVIIHPGDNLPTRNGPS

SEQ ID NO: 16275 - DNA, 663 bp, Zea mays
  misc_feature: Ceres CLONE 1380011-F
  misc_feature (319)..(319): n is a, c, t, g, unknown, or other
  misc_feature (320)..(320): n is a, c, t, g, unknown, or other
  misc_feature (329)..(329): n is a, c, t, g, unknown, or other
  misc_feature (330)..(330): n is a, c, t, g, unknown, or other
  misc_feature (377)..(377): n is a, c, t, g, unknown, or other
  misc_feature (411)..(411): n is a, c, t, g, unknown, or other
  misc_feature (438)..(438): n is a, c, t, g, unknown, or other
aaagctggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccgaatgctcacaagctcctatagcttcccttcttcccccgtacctctcaccagtggtgtcttcggtatgtcaaaacccaattctttgacccnntacagatcnnacagcaatcgcagctggcatcttacctttatcaccctttgtcctccnacatcatcagccctattacagcaggtacctttgntgcatttatttgcacaaacatcagggnacaacaactaacacaacttgtgctagcaaacctttgctgctactctcagcaacagcagtttcctcccatccaccaactagctgcattgaactctggctcttatttggaaacaacacaactaacattcagccaggtaactggttgctacccccaggaaatttcttccatcaacccaactggaaaaattgaaccttcctggcttattaccggggcaacacctactac

SEQ ID NO: 16276 - DNA, 741 bp, Zea mays
  misc_feature: Ceres CLONE 1380014-F
  misc_feature: Encodes the peptide sequence at SEQ ID NO. 16277
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (741)..(741): n is a, c, t, g, unknown, or other
ggggggcggatgcctcgtccgcggcgccggggcgcggngcnnnggggnggggcagcactgggactcaccgcggtggcggccgctctagaactaggggatcccccgggctgcaggaattcgcacgagaccattacctagaacatcctaatcgaaaaggccagatgcgaccaaattcctcctattccctctcctctccgcccacccttctctcggccgcgtaactcctctctgtcgcctaccaaaagcggagcaaccgaggcaagaggaagggggtgggcgaggaaaagcgatttggcttctcttccagttccggattcgtcgtaagaaacacatgactgcagtggatattagaagcatgaaaagggaaaccatctcactcttcaaacaggtcacttagcacacttaatgacggaggtgtttgcatgacattctctttgagctgatatatatgggtggctgcattggtaatttaagaaaatctcagtcacttccagattctaagccgaaaccatctttaagaaagaaatctctggattcatctactggaaacagaagacgatggcaatcgaggcgagaaggaatggagaagaacggtagcatatcacgtttctcttggaggggaatatctccttctattcccaactccgatagtcaacgcacttctaacaaccggcacgggaaaacgcgggcgacaaagcgtcagttgaatcgaaccatgggtggttcaaagaaaggggactn

SEQ ID NO: 16277 - protein, 97 aa, Zea mays
  misc_feature: Ceres CLONE 1380014-F
MGGCIGNLRKSQSLPDSKPKPSLRKKSLDSSTGNRRRWQSRREGMEKNGSISRFSWRGISPSIPNSDSQRTSNNRHGKTRATKRQLNRTMGGSKKGD

SEQ ID NO: 16278 - DNA, 672 bp, Zea mays
  misc_feature: Ceres CLONE 1380015-F
  misc_feature: Encodes the peptide sequence at SEQ ID NO. 16279
tcagaactagtggatcccccgggctgcaggaattcgcacgagaccattacctagaacatcctaatcgaaaagcctctgtatccgagcatactagcggatcctggcccgatccctcttcccacctacctccgcttctctccgagtgaggaaccccaagccctcgccgtggcgtcgcggatcctggcccgatccaagtcccttcacctcgtcgccgccctcacccctgccgctgccaaagcagcaacgcctatcgccggagcccgcgcgctctcgtccctgccccgctacccgtctgccccgtcgccccatgggctcggcaaggttctgggatatgaaccaacatcggcgggggggggaccacaagttttacctcgttggttttcctctctagcatccaatggatctcaggtggcagaagtcacagatctctgagacatacaaggcaggtggtgaaatgaaacagtctgagacacggaaatcaagggaggaagccacaccaagagtggggggggtcagtccgcctaaaggcagctattcgctaaacctaagaagtagccccctggaaaggggagagtttcttaaaggaggggcaatccgaaaataagaaccccagggcccacttttttaaatggatccccagcccttggcttttttggcctcccaaggaagaaa

SEQ ID NO: 16279 - protein, 68 aa, Zea mays
  misc_feature: Ceres CLONE 1380015-F
MDLRWQKSQISETYKAGGEMKQSETRKSREEATPRVGGVSPPKGSYSLNLRSSPLERGEFLKGGAIRK

SEQ ID NO: 16280 - DNA, 699 bp, Zea mays
  misc_feature: Ceres CLONE 1380016-F
  misc_feature: Encodes the peptide sequence at SEQ ID NO. 16281
  misc_feature (154)..(154): n is a, c, t, g, unknown, or other
  misc_feature (336)..(336): n is a, c, t, g, unknown, or other
  misc_feature (341)..(341): n is a, c, t, g, unknown, or other
  misc_feature (412)..(412): n is a, c, t, g, unknown, or other
  misc_feature (459)..(459): n is a, c, t, g, unknown, or other
aagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagnttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcgncgaanaagccggcggcgcaccctccctacgctgagatgattgtagagcgatccttgcccgtcaggagaggaagggntccagctcggtggcattcacaagtacgtcgagggggaaccacggggnaagctccccaccactttcggagggagtttaccggggatttaaaaaagtttccttcccccggaaagttgaagaggtgtaaaaattcctttagggttgcgggcccccggccccaagtttaggggcgcccaagcccaggggaccccggggggggcccaaaccccaggcctttcccaaaagggaaggcccaaaaccctgttaaaacccaggggggggttcccccccccccggggggggggcggg

SEQ ID NO: 16281 - protein, 128 aa, Zea mays
  misc_feature: Ceres CLONE 1380016-F
  misc_feature (49)..(49): Xaa is any aa, unknown, or other
  misc_feature (50)..(50): Xaa is any aa, unknown, or other
  misc_feature (74)..(74): Xaa is any aa, unknown, or other
  misc_feature (90)..(90): Xaa is any aa, unknown, or other
MSTEEAVVAEVPVTEVPAEVPAAQVAEAPKAKKAPKEKKAPKEKKPSAXXKPAAHPPYAEMIVERSLPVRRGRXPARWHSQVRRGGTTGXAPHHFRREFTGDLKKFPSPGKLKRCKNSFRVAGPRPQV

SEQ ID NO: 16282 - DNA, 674 bp, Zea mays
  misc_feature: Ceres CLONE 1380017-F
  misc_feature: Encodes the peptide sequence at SEQ ID NO. 16283
  misc_feature (341)..(341): n is a, c, t, g, unknown, or other
  misc_feature (342)..(342): n is a, c, t, g, unknown, or other
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccnngtgacagaccattgggggaggtgatgatgctttcaccacttcttcagggagactgcgctgggaaacacgtcccccgtgctgtttttggtgaccttgagcccctgtcatcgaggagggagggatggaactatccccaggtttttcatcctgggaagttattggggggaggggggtgggggccaaaattggcctcggggccctacacccattgaaaggaatttttacactgggccttacccgataggaaaatttgaaaatattgccggggccccgggtttcccccctttaaggggttggggggggaaaagggtctgtggtttttctcccccccc

SEQ ID NO: 16283 - protein, 37 aa, Zea mays
  misc_feature: Ceres CLONE 1380017-F
MRECISIHIGQAGIQVGNACWELYCLEHGIQADGQMP

SEQ ID NO: 16284 - DNA, 682 bp, Zea mays
  misc_feature: Ceres CLONE 1380018-F
  misc_feature: Encodes the peptide sequence at SEQ ID NO. 16285
  misc_feature (537)..(537): n is a, c, t, g, unknown, or other
ccccaaagctggagctccccgcgggtggcggccgctctagaactagtggatcccccgggctgcaggaattcgcacgagaccattacctagaacatcctaatcgaaaaaaactcaccctgcagccgccacctcatgaccctgcagcaccctcaggcctcaccgcctcagctgccaccctcaccctgcatccgagagagagagagaggagagttgccgccggagggagggggtcgccgcggaggggaggggctcgccggtaggggacatcgccggcgcctggagagctcgtggaggggacagccaccgtcaccgccaggagacaagcgccgccgccgctaggaatcaggagacaagcgagcgcgatggtgagctccgcactgaggcgctgtctcccctgccatgcctctctctgtcatgccttccctccccatccgctgctggccgctgccggcgtcttccgtcgttcattccagtccggggatggtgagactatggacgaattcgaagaacggttgtttgggggcaaggacacagacnaaggatcactctacgagaagctcgatagggctgagaacactgcgacaggagcagttcaggatggatggatggttatgattcttttagtgatggcttaaatgatacaatggctaatgcggcacgcaacatccaaatggaggaggac

SEQ ID NO: 16285 - protein, 90 aa, Zea mays
  misc_feature: Ceres CLONE 1380018-F
  misc_feature (59)..(59): Xaa is any aa, unknown, or other
MVSSALRRCLPCHASLCHAFPPHPLLAAAGVFRRSFQSGDGETMDEFEERLFGGKDTDXGSLYEKLDRAENTATGAVQDGWMVMILLVMA

SEQ ID NO: 16286 - DNA, 640 bp, Zea mays
  misc_feature: Ceres CLONE 1380020-F
  misc_feature: Encodes the peptide sequence at SEQ ID NO. 16287
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcgggtggtgcaagcatgcgtgccagtggcaggacgggaggggacaccccgcggaaagagggaatgctagagcgagtgccgccgaccggcaccagcaagcctgacgcggggcgagaaccggccacggcgggcgtgggacgccctacgtcctccccgcttcggggaaggggcgaaggggccgggggccagggcgctggcccccgcccccaagggcccagcccgtggggaaaaccccagaaggggcattgaggggggggcccgccccccccgggacctggcccgccccaatgtgaagccaaagaagtaccggtcccggggcaatggagaaa

SEQ ID NO: 16287 - protein, 64 aa, Zea mays
  misc_feature: Ceres CLONE 1380020-F
MGKGSVGASWWAFLLLAGVLLVVAATAGAEDGVVERDRKEDLRVVQACVPVAGREGTPRGKREC

SEQ ID NO: 16288 - DNA, 678 bp, Zea mays
  misc_feature: Ceres CLONE 1380022-F
  misc_feature: Translation starting site: 222
  misc_feature (410)..(410): n is a, c, t, g, unknown, or other
agagctggagctccccgcggtggcggccgctctagaactagtggatcccccgggctgcaggaattcgcacgagaccattacctagaacatcctaatcgaaaacccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaaccaccctggacctgctcccggctaagggcgccaagcgcggnttttctgacgaggcgccgacgccatcgcccggtgcagcttccggggaagggaaagaaggaaccgggagaagaggacaacaagaaggttgcagcgaccccgcaggcggtcgcaaaaagtcaggggggggggatggccaccaatcccaagctaccgcaagaacacgatgtctaccaccccagctgagggcagcaagggaggatgctgaggccaacaagggccaggggtttcctggaacctcaaggtcaccatggaatgccgccccgaacg

SEQ ID NO: 16289 - DNA, 679 bp, Zea mays
  misc_feature: Ceres CLONE 1380026-F
  misc_feature: Encodes the peptide sequence at SEQ ID NO. 16290
  misc_feature (352)..(352): n is a, c, t, g, unknown, or other
  misc_feature (556)..(556): n is a, c, t, g, unknown, or other
  misc_feature (570)..(570): n is a, c, t, g, unknown, or other
  misc_feature (571)..(571): n is a, c, t, g, unknown, or other
  misc_feature (573)..(573): n is a, c, t, g, unknown, or other
  misc_feature (632)..(632): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaatgcacactcactcactccagtgcccactgcccactgcccactgcccgacgaggaagtttcacgatcccaacccgtataaatcgacgccgcgagggggagcgacgagcgatccccgtaattaacctgtcccagccgcaccgatccaccccccctcggcctcggcctccctccggccatggaggtgttctactacgtcgtgttcggcgcgctggccgccgtcgtggcggggctcgagctcggcaagagcggnaaggaccgcgtcgccgccacgtccgcattcaactccttcaagaacaactacgtcctcgtctactccctcatgatgtccggggactggctgcagggcccctacgtctactacctctacggccagtatggcttccacaagggggacatcggccgcctcttcctcgccggcttcggatcgtccatgctcctcgggaccattcggcgnctccgtcgccgacnnanagggccgccaggagggcctggcgtcacctaattgggtccagctaactccctcaggtggnatcaccaagcacttcccccgaaggacagggnttcctcctggatggcg

SEQ ID NO: 16290 - protein, 108 aa, Zea mays
  misc_feature: Ceres CLONE 1380026-F
  misc_feature (98)..(98): Xaa is any aa, unknown, or other
  misc_feature (99)..(99): Xaa is any aa, unknown, or other
MEVFYYVVFGALAAVVAGLELGKSGKDRVAATSAFNSFKNNYVLVYSLMMSGDWLQGPYVYYLYGQYGFHKGDIGRLFLAGFGSSMLLGTIRRLRRRXXGPPGGPGVT

SEQ ID NO: 16291 - DNA, 827 bp, Zea mays
  misc_feature: Ceres CLONE 1380027-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (208)..(208): n is a, c, t, g, unknown, or other
nnnnnnnnnaaaccctccccccccccccgccccccgggggggggnnnntggggcaaagctggagctccccgcggtggcggccgctctagaatagtggatcccccgggctgcaggaattcgcacgagaccattacctagaacatcctaatcgaaaaagccaccagtcccaccaccaccaccctctgtcttcgcctccgctgccgattcnaaagcacccgtcctgtcccctcgcaaaaccctagctccagccaccatgaagggcaaggctgacacctccaagaaggacgagggcaggctccgggcgggcggcgccgccggatagcgcaaggaaggcggcgcgagcggaaaggccaagcgcccgccctccgccttcttcgtcttcatggctggaattcagggaggagtatcaggcggctgcaccctgagcgggggggggggggccaaccggtgagctaagcccagcagggggaaaaaagggggggtggtattggtcaggagggaggaggagggcgccccttttggggggacccaggctggggcgggggaagaaaggcggggggcctatgtgagaagaagctaaagggcgagaaattttggggtaagagaaggggggaggccccccggcctcccaagaaaagggcgtaagaaaatgttgggaggggggggggggggccctcaaaagccccaaggtttgaataaagcaggaggtttgccgcgcggggggccggggggaagagcggtgggcgggggggggggaaaaggggcgggccgggggggcccagggtgggaacaatcgggggggtagagccccgccaattggaagattc

SEQ ID NO: 16292 - DNA, 630 bp, Zea mays
  misc_feature: Ceres CLONE 1380029-F
  misc_feature: Encodes the peptide sequence at SEQ ID NO. 16293
  misc_feature (455)..(455): n is a, c, t, g, unknown, or other
agagctggagctccccgcggtggcggccgctctagaactagtggatcccccgggctgcaggaattcgcacgagaccattacctagaacatcctaatcgaaaaaagctcgatcgatctcactctcagctggtcgctcactcttgcagctccacccttcactcagtcttaggctcttagctctaggctctagctagccgcgccactccttcgtgtagccatcagccttctcatcgccaccaatggccactgccgaggtccagaccccgaccgtcgtggcggccgaggaagcgccagtggtgggagaccccgacggccggccgtcgtggacggaggagtctgcccccgccgaggcccaagctaaggctgaggctgaggctgctggtcctgctgatcccaaggaactcccgcggccgagcagaaggagccgccgagcccgaggccgctcttcctgctgntgccaaggaaccccgcgtgggcccaaccggcccctgaaggggaaggttggtgctcctgttgggccccaagaaaattcctgcggttcaaaatagaaggaatccccccaagggaggaggggggctgcctcccccccctggctgggggccaaggaaccccccccccggggcgagaccc

SEQ ID NO: 16293 - protein, 102 aa, Zea mays
  misc_feature: Ceres CLONE 1380029-F
  misc_feature (72)..(72): Xaa is any aa, unknown, or other
MATAEVQTPTVVAAEEAPVVGDPDGRPSWTEESAPAEAQAKAEAEAAGPADPKELPRPSRRSRRARGRSSCXCQGTPRGPNRPLKGKVGAPVGPQENSCGSK

SEQ ID NO: 16294 - DNA, 730 bp, Zea mays
  misc_feature: Ceres CLONE 1380033-F
  misc_feature: Encodes the peptide sequence at SEQ ID NO. 16295
  misc_feature (371)..(371): n is a, c, t, g, unknown, or other
  misc_feature (392)..(392): n is a, c, t, g, unknown, or other
  misc_feature (396)..(396): n is a, c, t, g, unknown, or other
  misc_feature (437)..(437): n is a, c, t, g, unknown, or other
  misc_feature (438)..(438): n is a, c, t, g, unknown, or other
agagctggagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtccatgctggtgctgtccgcnctgatcgtgggcggcaccgtnatcncgctcacggtggccacccccgtgctggtgatctcaccgggnnttgggggggggcggccccccatcggcgctggggtttatggggggggccggggttcgtcacctccgggggggcctcgggggtccctgggcctgggccgggtttcctccggggatggaccaagtaacctgggaagggcaagccacccggccggggcggccaacccagctggaaccaccccaaaggggggagggctgggccttccaagggcccgtcgacaatgcaggggatggcaggaccaggcaccgcatccacccaagggggccagggggggtctttggagaaaaaaaaaccc

SEQ ID NO: 16295 - protein, 177 aa, Zea mays
  misc_feature: Ceres CLONE 1380033-F
  misc_feature (67)..(67): Xaa is any aa, unknown, or other
  misc_feature (81)..(81): Xaa is any aa, unknown, or other
MADHHRGATGGGGGYGDLQRGGGMHGEAQQQQKQGAMMTALKAATAATFGGSMLVLSALIVGGTVIXLTVATPVLVISPGXGGGRPPIGAGVYGGGRGSSPPGGPRGSLGLGRVSSGDGPSNLGRASHPAGAANPAGTTPKGGGLGLPRARRQCRGWQDQAPHPPKGARGGLWRKKN

SEQ ID NO: 16296 - DNA, 694 bp, Zea mays
  misc_feature: Ceres CLONE 1380035-F
  misc_feature: Encodes the peptide sequence at SEQ ID NO. 16297
  misc_feature (131)..(131): n is a, c, t, g, unknown, or other
  misc_feature (211)..(211): n is a, c, t, g, unknown, or other
  misc_feature (298)..(298): n is a, c, t, g, unknown, or other
  misc_feature (425)..(425): n is a, c, t, g, unknown, or other
  misc_feature (456)..(456): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctagaacatcctaatcgaaaaatcgcttcagctcggcgtcttcacaaacngccggcgcaaactcctcgccgcgagcccgacagatctctaattccccataccgtccaccggtcgaccttcacgccagtcntcggtctcttccgaaggcgtcgcgcgcggttgtttgagaggagaggaggaagatgagggagtgcatctccgtccacatcgggcaggncggcatccaagtcggcaacgcgtgctgggaactttactgcctcgagcacggcatccagcctgatggccaagtgcctggaggatagaccgcgggacatcacgatgatggcttcagcacctttctcagncagactgtggctgggagcacggtccccgtgncatctttcgtgatctagaccccactgggatcgatgaggtgggcactgggacgtaccggcnggctcttccccctggagaagttcatcagtgggagggggggtggcggttaaaatttcgccgggggcccctacccatttggcaggggaaattgttaattttggccctttacccgattccgaagtttgggtgaaaaaggggccccggcccccagggttttctgggtttcaagggggggggg

SEQ ID NO: 16297 - protein, 39 aa, Zea mays
  misc_feature: Ceres CLONE 1380035-F
  misc_feature (12)..(12): Xaa is any aa, unknown, or other
MRECISVHIGQXGIQVGNACWELYCLEHGIQPDGQVPGG

SEQ ID NO: 16298 - DNA, 730 bp, Zea mays
  misc_feature: Ceres CLONE 1380039-F
  misc_feature: Encodes the peptide sequence at SEQ ID NO. 16299
  misc_feature (251)..(251): n is a, c, t, g, unknown, or other
  misc_feature (252)..(252): n is a, c, t, g, unknown, or other
  misc_feature (289)..(289): n is a, c, t, g, unknown, or other
  misc_feature (292)..(292): n is a, c, t, g, unknown, or other
  misc_feature (323)..(323): n is a, c, t, g, unknown, or other
  misc_feature (361)..(361): n is a, c, t, g, unknown, or other
  misc_feature (422)..(422): n is a, c, t, g, unknown, or other
  misc_feature (594)..(594): n is a, c, t, g, unknown, or other
aaagctgggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcaaatgccctgcccctgcgcgnngctgcagggcttgtacggcgctggcgccggcctgacnacnatgatgggcgccggcgggctgtacccctacncggagtacctgaggcagccgcagtgcagcccgcctggnggcggcggcctactaacccggggggggggcagcccaaccgccatggtccagccggtccggnaaacggggtgtccggacaaaatggaggtattggtggccgtggaaatcccctccccgaagaaattttaaaaaaaatatgggcctttgagggggggccctttcgccccaaaaaaaccctttaaaaaaccgttttttaaaagaaaaaaaaaaaaggggtggtgggggcccgaggntctccccccccgggggccttaggagttggccaaaaaagggcggccccgggggggggaaaatttataaaaggagagggggggcccaaaagcggacaaaccccggggggggggcccgcccttttattatcccccaaat

SEQ ID NO: 16299 - protein, 107 aa, Zea mays
  misc_feature: Ceres CLONE 1380039-F
  misc_feature (29)..(29): Xaa is any aa, unknown, or other
  misc_feature (53)..(53): Xaa is any aa, unknown, or other
  misc_feature (86)..(86): Xaa is any aa, unknown, or other
MKMVIVLVVCLALSAASASAMQMPCPCAXLQGLYGAGAGLTTMMGAGGLYPYXEYLRQPQCSPPGGGGLLTRGGGSPTAMVQPVRXTGCPDKMEVLVAVEIPSPKKF

SEQ ID NO: 16300 - DNA, 743 bp, Zea mays
  misc_feature: Ceres CLONE 1380040-F
  misc_feature: Encodes the peptide sequence at SEQ ID NO. 16301
  misc_feature (536)..(536): n is a, c, t, g, unknown, or other
  misc_feature (631)..(631): n is a, c, t, g, unknown, or other
  misc_feature (655)..(655): n is a, c, t, g, unknown, or other
  misc_feature (666)..(666): n is a, c, t, g, unknown, or other
  misc_feature (725)..(725): n is a, c, t, g, unknown, or other
  misc_feature (743)..(743): n is a, c, t, g, unknown, or other
aaagctggagctccccgcggtggcggccgctctagaactagtggatcccccgggctgcaggaattcgcacgagaccattacctagaacatcctaatcgaaaatacctagaacatcctaatcgaaaaaatatctcaaaaagcccatcttctcttcctctctcgcagcaccgcctctcaacctccgccgccgctcgcccggggcgtcacccacccgcgcagaaggcccccgccgctcaagctaccggtgccctaaaccccgatatcttcttcgcctccctttcctcctcagcacccaatccccgaccttcagggttccgccgccatgccgcagggagaccacatcgagcttcaccagaagcgccatggcaagcgcctggaccacgatgaacgcaagcgcaagcgcgaggcgcgcgaggtgcacaggcgctcgaaggacgcccgcaatttgattggtgctaagggcaagaggttcgccaagaaacgctatgctgagaaggcacagatgaagaagaccctgaaaatgcacgatgaatcanataagcgacagaaggttgatgatgatgtccaagaaggtgctcttcctccgtatctactcgatcgtgatcagacacagcgtggcaaggtcctcagncacacaatcaagcaaaagaagaanggaaaggctgncaaatggggatgtccgctgccaaaggtcagacctgtagctgaagaagaaaatgtcaggntgctacgaactggcaagn

SEQ ID NO: 16301 - protein, 140 aa, Zea mays
  misc_feature: Ceres CLONE 1380040-F
  misc_feature (1)..(140): Pfam Name: Ribosomal_S8e Pfam Description: Ribosomal protein S8e
  misc_feature (72)..(72): Xaa is any aa, unknown, or other
  misc_feature (103)..(103): Xaa is any aa, unknown, or other
  misc_feature (111)..(111): Xaa is any aa, unknown, or other
  misc_feature (115)..(115): Xaa is any aa, unknown, or other
  misc_feature (135)..(135): Xaa is any aa, unknown, or other
MPQGDHIELHQKRHGKRLDHDERKRKREAREVHRRSKDARNLIGAKGKRFAKKRYAEKAQMKKTLKMHDESXKRQKVDDDVQEGALPPYLLDRDQTQRGKVLXHTIKQKKXGKAXKWGCPLPKVRPVAEEENVRXLRTGK

SEQ ID NO: 16302 - DNA, 745 bp, Zea mays
  misc_feature: Ceres CLONE 1380051-F
  misc_feature: Encodes the peptide sequence at SEQ ID NO. 16303
  misc_feature (448)..(448): n is a, c, t, g, unknown, or other
  misc_feature (704)..(704): n is a, c, t, g, unknown, or other
tggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaaccctacaggatccaacaggcaatcgcagctggcatcttacctttatcacccttgttcctccaacaatcatcagccctattacaacagttacctttggtgcatttattggcacaaaacatcagggcacaacaactacnacaacttgtgctagcaaaccttgctgcctactctcagcaacagcagtttcttccattcaaccaactaggttcattgaactctgcttcttatttgcaacacaacaactaccattcagccagctacctgctgcctacccccagcaatttcttcatttcaccaactggcagcattgaactctccctgcttattacacagcaacaactactaccattcagccagctagctggtgtgagccctgctacccttctgaccaancacaggtgttgccgtcctaccagcacgttgcgcctaacgct

SEQ ID NO: 16303 - protein, 198 aa, Zea mays
  misc_feature: Ceres CLONE 1380051-F
  misc_feature (100)..(100): Xaa is any aa, unknown, or other
  misc_feature (185)..(185): Xaa is any aa, unknown, or other
MAAKIFCLLMLLGLSASAATATIFPQCSQAPIASLLPPYLSSAVSSVCENPILQPYRIQQAIAAGILPLSPLFLQQSSALLQQLPLVHLLAQNIRAQQLXQLVLANLAAYSQQQQFLPFNQLGSLNSASYLQHNNYHSASYLLPTPSNFFISPTGSIELSLLITQQQLLPFSQLAGVSPATLLTXHRCCRPTSTLRLT

SEQ ID NO: 16304 - DNA, 642 bp, Zea mays
  misc_feature: Ceres CLONE 1380052-F
  misc_feature: Encodes the peptide sequence at SEQ ID NO. 16305
  misc_feature (284)..(284): n is a, c, t, g, unknown, or other
  misc_feature (360)..(360): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (528)..(528): n is a, c, t, g, unknown, or other
  misc_feature (538)..(538): n is a, c, t, g, unknown, or other
aaagctggagctccccgcggtggcggccgctctagaactagtggatcccccgggctgcaggaattcgcacgagaccattacctagaacatcctaatcgaaaaaagagctccaattcctcgtgcctctgccaatccctccggccctccttccaggcttcaggaccttctcctgcgacgccagcaccgccccgagccgcggcccgaatctagggttcccctctcccgccgtcgacagccggatcgcacatagtgcacctccacgatgctgccgtgcgcgaggtcgntgcttcgaaggagggggctggcatcttccgtcccgcggaggtgcggcggggagggcgagtgctccacttgcgcggnggagctggtcgccaatgccaggtgttcgagcacgctggctgcgctcggcggcggcgggcgcgtgctccagcatggcgggcggtgggcatatccgcagacgggcgtgattgggcgcgggcggatgacgcgcacgcagacgagtgttctgnnnnnnnngggggaaacggnaaggaagggncccgtggttctccaagggtctatggaggaggggggcggtgattgggtactcaccagaaccagatggtttgcttggtgtcgccgtcagtggacctcctacgagga

SEQ ID NO: 16305 - protein, 126 aa, Zea mays
  misc_feature: Ceres CLONE 1380052-F
  misc_feature (8)..(8): Xaa is any aa, unknown, or other
  misc_feature (33)..(33): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (89)..(89): Xaa is any aa, unknown, or other
MLPCARSXLRRRGLASSVPRRCGGEGECSTCAXELVANARCSSTLAALGGGGRVLQHGGRWAYPQTGVIGRGRMTRTQTSVLXXXGETXRKGPVVLQGSMEEGGGDWVLTRTRWFAWCRRQWTSYE

SEQ ID NO: 16306 - DNA, 767 bp, Zea mays
  misc_feature: Ceres CLONE 1380054-F
  misc_feature: Translation starting site: 221
  misc_feature (347)..(347): n is a, c, t, g, unknown, or other
  misc_feature (381)..(381): n is a, c, t, g, unknown, or other
  misc_feature (382)..(382): n is a, c, t, g, unknown, or other
aagctggagctccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcagctgcaggaggagatgaacgacgctgccggcggcggcctcaggctgcctcccagggtccgcttccacccgagcgacttcgagattgtcagcttctacctcaccnacagggtgctcacacgcgctcacctggaccggcnntcaggaggccggacctaacaggatggagccatgggacctccctagcaggggaaaatgggcaaaaaaaagggtacttcttttaaccaaaggccccgaggccccaacgggggttgaggggaaccgggcccccggagccgtttcttggagggcacgggcaaagaaagggggtcccccccccccgaaagggggggggccctgggccataaaaaaaaaccctccttttcaaggggggggggcccccggggggagaaaaaaaaggtgggttgccaaaaaagggtgaagggggggggggcccccccccccctttgggtcaaaaagtttcccgccccccccagggggggggtttaatatttttttttaaaaaagagggggggggcggcggtcc

SEQ ID NO: 16307 - DNA, 801 bp, Zea mays
  misc_feature: Ceres CLONE 1380055-F
  misc_feature: Translation starting site: 227
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (49)..(49): n is a, c, t, g, unknown, or other
  misc_feature (59)..(59): n is a, c, t, g, unknown, or other
  misc_feature (62)..(62): n is a, c, t, g, unknown, or other
  misc_feature (64)..(64): n is a, c, t, g, unknown, or other
  misc_feature (617)..(617): n is a, c, t, g, unknown, or other
  misc_feature (801)..(801): n is a, c, t, g, unknown, or other
ttttnnnnttttttttttttttnnnnnnntnnnttttttttttcgtttngggggggggnttngntgcaaagcgggggctccccgcggtggcggccgctctagaactagtggatcccccgggctgcaggaattcgcacgagaccattacctagaacatcctaatcgaaaccatccactcccaagtcccaacacccgtcggcgtcgagcagcggcagcggcggcggcgatgacgacgagcctgaagaagaaccggaagaagcgcgggcacgtgtcggcggggcacggccgcatcggcaagcaccggaagcacccgggaggccgcggcaacgccggcgggatgcaccaccacggcatcctcttcgacaagtaccacccgggctacttcggggaggggggggatgcgctacttccacagggtccgcaacaagttccactggcccgtcgggcaacgtgggagcgggctctggggcgatggggccccggccgggaagggcccggggaaggcggggcgggggcgggaaccaggcccccggctccgtccgagcgaggacgccaggttccgggttacgttccggggggggcttccgcccaagggggaatggcctgccggtccccanggccccgtccggggggccagggggccaggcctccctcgctcccaggggtgcccccgaaaaaaaaagagaaacgagggggttgggcggggggaggcgcccgggccgggggtggaggggggtttaaagggccccgttgtgggcaggccggggggtcgccgaagcaaggggtggcggggcaaagagn

SEQ ID NO: 16308 - DNA, 592 bp, Zea mays
  misc_feature: Ceres CLONE 1380057-F
  misc_feature: Translation starting site: 114
  misc_feature (52)..(52): n is a, c, t, g, unknown, or other
  misc_feature (164)..(164): n is a, c, t, g, unknown, or other
  misc_feature (533)..(533): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (556)..(556): n is a, c, t, g, unknown, or other
  misc_feature (558)..(558): n is a, c, t, g, unknown, or other
aaagctggagctccccgcggtggcggccgctctagaactagtggatcccccngggctgcaggaattcgcacgagaccattacctagaacatcctaatcgaaaaggtctaggccatggccatgtccgcttcctcctcctcgcgcgccctcctccgccggatcggnggggcgctcctccgccgctccttctcctcctcatccgccgccgccgccgcagggtaccacgtcgcgggcgggcccagctacatgcggcggcgccggtctttctgggaggccccggccgcccggctcacggctcgaaggaggtcccgcatggccgcggccccaggggccggggaaggtccctcatcaagaaaccaaaagcccctggggggggtcttggccccctccccgaagggggcgggggggcgccccaaaaagggggaggggccccccctttttttctccccaacgcccccccggagggggggggggggggggccccccaaaaaagaaaacaacccccgcgggagaagaagggggggggggttggtntaaaacaaggggagggggnnngnanaaaaaacgccccctcgggggggggggggaggaga

SEQ ID NO: 16309 - DNA, 634 bp, Zea mays
  misc_feature: Ceres CLONE 1380060-F
  misc_feature: Encodes the peptide sequence at SEQ ID NO. 16310
  misc_feature (358)..(358): n is a, c, t, g, unknown, or other
  misc_feature (394)..(394): n is a, c, t, g, unknown, or other
  misc_feature (395)..(395): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
aagctggagctccccgcgggtggcggccgctctagaactagtggatcccccgggctgcaggaattcgcacgagaccattacctagaacatcctaatcgaaaagaatgaaacccgattcacaaaaccctagcgacctcgattcctcaccagcatggccgtcggcccctactctctcggcctctctccgccgccgcggcttgataccatcctcttcccacagctgcggcctcacctacgccgccgcgtgcctgctcgggttgctgcagccggcactagctggtctcccgccgccggtgactccgaagacggggtcggcggctggtggtttcccgagtacgagaaatcgatgaaacaggcnagggggaaggattgggtttaagagaggctgtcgtgnntngnnttgggagctttctgcggcgatcggcctgggctggggctggcggtggcgcttcccatctttcccagaagcgtatacggcaactcattggtggctccattaccctatattcaggagaaattggcaacaatagaggtcaacggaggacatccagggaggatgcaagtgacaggggaatctgatggaaatttaaattttcaagggcacgccatgggaaaaaaaggctgaagcaaatac

SEQ ID NO: 16310 - protein, 75 aa, Zea mays
  misc_feature: Ceres CLONE 1380060-F
MAVGPYSLGLSPPPRLDTILFPQLRPHLRRRVPARVAAAGTSWSPAAGDSEDGVGGWWFPEYEKSMKQARGKDWV

SEQ ID NO: 16311 - DNA, 664 bp, Zea mays
  misc_feature: Ceres CLONE 1380065-F
  misc_feature: Encodes the peptide sequence at SEQ ID NO. 16312
  misc_feature (404)..(404): n is a, c, t, g, unknown, or other
  misc_feature (444)..(444): n is a, c, t, g, unknown, or other
  misc_feature (489)..(489): n is a, c, t, g, unknown, or other
  misc_feature (490)..(490): n is a, c, t, g, unknown, or other
  misc_feature (545)..(545): n is a, c, t, g, unknown, or other
  misc_feature (600)..(600): n is a, c, t, g, unknown, or other
  misc_feature (622)..(622): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcnagagcgagtgccgcgagcggcaccagcaagctgacgcggncgaggacggcgacagcggcgtggacgcctacgtctcccgctcggnnaaggggcgagtgccggcgccagtgcctgcgccgccacgagggccagccgtggagnacccaggagggcatgagggcgtgccgccgccgccggactggccgtcgacatgagncaagagtacggtcgcggcagcnagagcgcgggcagtgccccgggagaagtgcgagcgccacccg

SEQ ID NO: 16312 - protein, 127 aa, Zea mays
  misc_feature: Ceres CLONE 1380065-F
  misc_feature (64)..(64): Xaa is any aa, unknown, or other
  misc_feature (77)..(77): Xaa is any aa, unknown, or other
  misc_feature (92)..(92): Xaa is any aa, unknown, or other
  misc_feature (111)..(111): Xaa is any aa, unknown, or other
MGKGSVGASWWAFLLLAGVLLVVAATAGAEDGVVERDRKEDLRWCKQACEWQYGKDTPRKRECXSECRERHQQADAXEDGDSGVDAYVSRSXKGRVPAPVPAPPRGPAVEXPGGHEGVPPPPDWPST

SEQ ID NO: 16313 - DNA, 714 bp, Zea mays
  misc_feature: Ceres CLONE 1380067-F
  misc_feature: Encodes the peptide sequence at SEQ ID NO. 16314
  misc_feature (359)..(359): n is a, c, t, g, unknown, or other
aaagctggagctccccgcggtggcggccgctctataactagtggatcccccgggctgcaggaattcgcacgagaccattacctagaacatcctaatcgaaaaattcttccttccttcttttcttcaccaatggccacgaggatagccttgtgtcttctcggccacgtcctcctcgccgtcgcgtctatggcagtggcggcggcggccggtgacgcgggcaagatcggcatctgccacggccgcgttggcagtaacctcccgccgccgtcggccgccgcggcactgctcaagcggaacgggatcaccaaggcgcggctctttctgacggacccggccgtgctcccgggcttcggcgcggngagcatcgacctcatgtggggcgggcccaaacgaaaacctcaccttccctggccgcggcggggcccagaggggcgcggcccagtggctggcgttccctggtccttggcccacgcccccggcgaggggaggtcgggggcctcccccttcgggaaaggaggggcttgaacaacaaaccaaggtcttttggggcccccccttccgggccggccactggggaaaactgtggaccccggtgttttgccccccctggggggtggggaacggcaaagggtaaaggttttccttccgggggcaggccttcctggggggggtgggcggccccctaaaacgccccctcccggcgggaggcttttt

SEQ ID NO: 16314 - protein, 131 aa, Zea mays
  misc_feature: Ceres CLONE 1380067-F
  misc_feature (77)..(77): Xaa is any aa, unknown, or other
MATRIALCLLGHVLLAVASMAVAAAAGDAGKIGICHGRVGSNLPPPSAAAALLKRNGITKARLFLTDPAVLPGFGAXSIDLMWGGPKRKPHLPWPRRGPEGRGPVAGVPWSLAHAPGEGRSGASPFGKGGA

SEQ ID NO: 16315 - DNA, 752 bp, Zea mays
  misc_feature: Ceres CLONE 1380069-F
  misc_feature: Translation starting site: 283
  misc_feature (417)..(417): n is a, c, t, g, unknown, or other
  misc_feature (466)..(466): n is a, c, t, g, unknown, or other
aaagctggagctccccgcggtggcggccgctctagaactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaagttcttctttctgatttgaagtcaatcgcggttgggaacttatatgctcttactagatgcaaagttgctttgttgatgacatagaagaaaagaagggagggagcagaaggagagtattgntaatggtatcagagagactgtcaaaaaatatactctgtccatgtttctncttttgaaaacatgaaaatatcaaattcaaggagtttagaacacagtttaaacccaacgaagggttcctccctcgctaagaaaaatttgatgcagtttgctcttgggcctttcggctgggaaggaaaccatccctgcctctttaaagttcccaaaaattctttaggggggaatggctggtttataccaaattcccaaggggagaggttgaaaacttattttgcctcctaagaaaaattccacttttacagggcggggaatactgggcaaaaaatggtgtattttaa

SEQ ID NO: 16316 - DNA, 772 bp, Zea mays
  misc_feature: Ceres CLONE 1380081-F
  misc_feature (558)..(558): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaaaccgagaaacaaaaattgaaggaaattgaaggggccgcagtgcagcaggacgatggtcagaacagtgaagacgggtggacctggttcagtagacccagcgtgagtactctcgcgccactcgcctccgcgtccgccaccgccttctccacacacgccccactgcgtacaggccttgcttggactggtactgcatccaaaggcatgttagtagaacacaccacacacacgcatatgtgtatccgttacgtgctagtagcatgcagtacagtacctggagaggtgtatcttggaacgacccacgtctcgagcttgagcttggggaagctgttggcctccgacctgaagggggtcccggtcccgccgaggaacccgggcagggggcaccccaccgccgcccccaaaaccttgttggtttttttgttaaggcccccaaaagggaaccccggcggcccccgnccgggggaaaaaccaccnnnnnnngggggggggggggggnnnnnnnncccccccctttttttgggcggggagggggggaccacccgnggggtttcccccccatggggttttttaaggggtctcttttaaaagggccccctcttatttttccccgcggcccaaatggggggcccaaacgcgtttaaaaaaaggagtttttttccgcaaaacgcgg

SEQ ID NO: 16317 - DNA, 740 bp, Zea mays
  misc_feature: Ceres CLONE 1380083-F
  misc_feature: Encodes the peptide sequence at SEQ ID NO. 16318
  misc_feature (424)..(424): n is a, c, t, g, unknown, or other
  misc_feature (615)..(615): n is a, c, t, g, unknown, or other
  misc_feature (673)..(673): n is a, c, t, g, unknown, or other
  misc_feature (685)..(685): n is a, c, t, g, unknown, or other
  misc_feature (686)..(686): n is a, c, t, g, unknown, or other
tggagctccccgcggtggcggccgctctagaactagtggatcccccgggctgcaggaattcgcacgagaccattacctagaacatcctaatcgaaaatcagcatctcgcgcttcagatctcgcccaccgatctggaactggaattccctcccgatctgtatgtatctcacgcacgcttgctcgcgttcttggctttgctcccacctctctctagcagagtaacagtctagcagagcaagcatgtcgtcgtcggcggagaacgaccccacggtgacggtgaccgagcgcggaggcaaggacaagcacgaggacggcggcgacaaggagcagggcggcggcggcttcatcgacaaggtgaaggacttcatccacgacatcgggaaaaaatatgcaaggaggggtcgtcgggttcggcaagcccacnggccgacgtgtgcggcatccacatcccgcacatcagcctccaccgcgccgacctccgtcgtggacgtgctcatcaagaacccgaacccggtcccgatcccgctcgtggacatcgactacctcatcgacagcgacggccgcaaggctggtgtcgggcctcatcccggacgccggcacatccacgcgcacggncaggagacgtcaaagatcccggtgtcgctcgtcttcgacgacatcaagagcacctacnaggacatccagnncgggagcatcatcccctaactcgtcgcgtcgtggtccctcgtcgacgtcccatc

SEQ ID NO: 16318 - protein, 154 aa, Zea mays
  misc_feature: Ceres CLONE 1380083-F
  misc_feature (33)..(154): Pfam Name: LEA_2 Pfam Description: Late embryogenesis abundant protein
  misc_feature (62)..(62): Xaa is any aa, unknown, or other
  misc_feature (145)..(145): Xaa is any aa, unknown, or other
  misc_feature (149)..(149): Xaa is any aa, unknown, or other
MSSSAENDPTVTVTERGGKDKHEDGGDKEQGGGGFIDKVKDFIHDIGKKYARRGRRVRQAHXPTCAASTSRTSASTAPTSVVDVLIKNPNPVPIPLVDIDYLIDSDGRKAGVGPHPGRRHIHAHGQETSKIPVSLVFDDIKSTYXDIQXGSIIP

SEQ ID NO: 16319 - DNA, 700 bp, Zea mays
  misc_feature: Ceres CLONE 1380086-F
  misc_feature: Encodes the peptide sequence at SEQ ID NO. 16320
  misc_feature (239)..(239): n is a, c, t, g, unknown, or other
  misc_feature (274)..(274): n is a, c, t, g, unknown, or other
  misc_feature (288)..(288): n is a, c, t, g, unknown, or other
  misc_feature (291)..(291): n is a, c, t, g, unknown, or other
  misc_feature (341)..(341): n is a, c, t, g, unknown, or other
  misc_feature (343)..(343): n is a, c, t, g, unknown, or other
  misc_feature (351)..(351): n is a, c, t, g, unknown, or other
  misc_feature (359)..(359): n is a, c, t, g, unknown, or other
  misc_feature (362)..(362): n is a, c, t, g, unknown, or other
  misc_feature (399)..(399): n is a, c, t, g, unknown, or other
  misc_feature (452)..(452): n is a, c, t, g, unknown, or other
  misc_feature (458)..(458): n is a, c, t, g, unknown, or other
  misc_feature (476)..(476): n is a, c, t, g, unknown, or other
  misc_feature (623)..(623): n is a, c, t, g, unknown, or other
aaagctggagctccccgcggtggcggccgctctagaactagtggatcccccgggctgcaggaattcgcacgagaccattacctagaacatcctaatcgaaaacatcaccaccactgggtcttcagaccattagctttatctactccagagcgcagaagaacccgatcgacaccatgagggtgttgctcgttgccctcgctctcctggctctcgctgcgagcgccacctccacgcatacnagtcgcggctgcggctgccagccacccgcgccggntcatctaccggcgncgntgcatctgccacctccggttcacctgccacctccggtgcatctcccaccngncgggtccnactggcgncgncggggtcactgccaccgccggttcatgtggccccccnccggttcattctggcgggcgacacatggcactaccctactcaaccgccccggnctcagnctcattcccagcaaaccnatgcctgggccaaaggcgaattcaaggccggggctagtggaggaactctgggtgatttgtagcccccgatccgtgggccaggggagaaagtttttgggggtatctggggacccaagggagtttccttatggtcccccaagtgaatantctgggggaatccttggtcccaatctccaggggggggggtcccatcccgtatccgggctaattggtgtggtccccac

SEQ ID NO: 16320 - protein, 74 aa, Zea mays
  misc_feature: Ceres CLONE 1380086-F
  misc_feature (49)..(49): Xaa is any aa, unknown, or other
MPGPKANSRPGLVEELWVICSPRSVGQGRKFLGVSGDPREFPYGPPSEXSGGILGPNLQGGGSHPVSGLIGVVP

SEQ ID NO: 16321 - DNA, 740 bp, Zea mays
  misc_feature: Ceres CLONE 1380090-F
  misc_feature: Encodes the peptide sequence at SEQ ID NO. 16322
  misc_feature (641)..(641): n is a, c, t, g, unknown, or other
  misc_feature (684)..(684): n is a, c, t, g, unknown, or other
  misc_feature (716)..(716): n is a, c, t, g, unknown, or other
  misc_feature (717)..(717): n is a, c, t, g, unknown, or other
aaagctggagctccccgcggtggcggccgctctagaactagtggatcccccgggctgcaggaattcgcacgagaccattacctagaacatcctaatcgaaaaactcccccacaccacactcgagagccatctcccagcacacgagcgcgatggcttccaccaccaccaccaccttcctcgccatcttgctagtcgtggcagcttcggcggcgccggcacggtcctgctcaccgcgcgacatccacgcgctgctgagcgtgaagcaggcgctgggcaacccggcgtcgctgtcgacgtggacgccggcgtcgcccaactgctgcgcgtgggaccacctccgatgcaacgacgccgggcgcgtgaacaacgtcttcatcgacggcgcggacgacgtgcgcggccagatcccgtcggcggtgggcgggctgacggagctcatgtcgctgacgctgttccggctgccggggctgacgggcgccatcccggcctgcctcacggcgctgtcgaacctccagttcctcaccatctcccacaccaacgtgtccggcgccatcccgggagtcgcttggcgcggctgcgcggcctcgactcccgtggacctgtccagcaacccggctgacgggcggcattccccgggcggngttcgccgacctgcccagccctccgggtcgctggacctccggnacaaccagctgacgggccccatccccgggggnngctgggggcaggggccagttccc

SEQ ID NO: 16322 - protein, 197 aa, Zea mays
  misc_feature: Ceres CLONE 1380090-F
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
  misc_feature (179)..(179): Xaa is any aa, unknown, or other
  misc_feature (190)..(190): Xaa is any aa, unknown, or other
MASTTTTTFLAILLVVAASAAPARSCSPRDIHALLSVKQALGNPASLSTWTPASPNCCAWDHLRCNDAGRVNNVFIDGADDVRGQIPSAVGGLTELMSLTLFRLPGLTGAIPACLTALSNLQFLTISHTNVSGAIPGVAWRGCAASTPVDLSSNPADGRHSPGGVRRPAQPSGSLDLRXNQLTGPIPGGXWGQGPVP

SEQ ID NO: 16323 - DNA, 675 bp, Zea mays
  misc_feature: Ceres CLONE 1380091-F
  misc_feature: Encodes the peptide sequence at SEQ ID NO. 16324
  misc_feature (335)..(335): n is a, c, t, g, unknown, or other
  misc_feature (377)..(377): n is a, c, t, g, unknown, or other
  misc_feature (407)..(407): n is a, c, t, g, unknown, or other
  misc_feature (420)..(420): n is a, c, t, g, unknown, or other
  misc_feature (421)..(421): n is a, c, t, g, unknown, or other
  misc_feature (429)..(429): n is a, c, t, g, unknown, or other
  misc_feature (430)..(430): n is a, c, t, g, unknown, or other
  misc_feature (443)..(443): n is a, c, t, g, unknown, or other
aaagctggagctccccgcggtggcggccgctctagaactagtggatcccccgggctgcaggaattcgcacgagaccattacctagaacatcctaatcgaaaaccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacnacggtatccctcttcctaacgtcaactcccagatcctatccnagggtatcgagtactgcaacaagcacgtanatgggcgcgccgnncgcgccgnncgctcgaagggcnttccgacgacgtgggtgccgcctccggcacagcaccgccgcctcgggtgaggactcagaactgggatgcggacttcctcagggcgacagggccagcttttcgacctcatcttgggtggaactatctgaaactcaaggggtctgctccacctgacccggtaaaaatggtggtgacttggtccaggggaaaaaccccaaaaaattccccaagcccttcccactccaaaagggct

SEQ ID NO: 16324 - protein, 95 aa, Zea mays
  misc_feature: Ceres CLONE 1380091-F
  misc_feature (8)..(68): Pfam Name: Skp1_POZ Pfam Description: Skp1 family, tetramerisation domain
  misc_feature (44)..(44): Xaa is any aa, unknown, or other
  misc_feature (58)..(58): Xaa is any aa, unknown, or other
  misc_feature (68)..(68): Xaa is any aa, unknown, or other
  misc_feature (72)..(72): Xaa is any aa, unknown, or other
  misc_feature (75)..(75): Xaa is any aa, unknown, or other
  misc_feature (80)..(80): Xaa is any aa, unknown, or other
MAAEGEKKMITLKSSDGEEFEVEEAVAMESQTIRHMIEDDCADXGIPLPNVNSQILSXGIEYCNKHVXGRAXRAXRSKGXPTTWVPPPAQHRRLG

SEQ ID NO: 16325 - DNA, 742 bp, Zea mays
  misc_feature: Ceres CLONE 1380092-F
  misc_feature: Encodes the peptide sequence at SEQ ID NO. 16326
  misc_feature (284)..(284): n is a, c, t, g, unknown, or other
  misc_feature (294)..(294): n is a, c, t, g, unknown, or other
  misc_feature (298)..(298): n is a, c, t, g, unknown, or other
  misc_feature (343)..(343): n is a, c, t, g, unknown, or other
  misc_feature (346)..(346): n is a, c, t, g, unknown, or other
  misc_feature (355)..(355): n is a, c, t, g, unknown, or other
  misc_feature (370)..(370): n is a, c, t, g, unknown, or other
  misc_feature (505)..(505): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggncgangcggaggacggagtggtcgaacgggaccgcaaggaggacctgcgntgntgcaagcangcgtgcgagtggcantacggaaaggacaccccgcggaagagggaatgcgagagcgagtgccgcgagcggcaccagcaagctgacgcgggcgaggacggcgacagcggcgtggacgcctacgtctcccgctccgggaggggcaagtgccgncgccagtgcctgcgccgccacgagggccagccgtgggagacccagaagtgcatgagggggtgccgccgccccggaattggcctcaaactggaacaagaatacgggccgggaatcaagagcgcggcaaatgccgggaaaaggtgcaaccccccccccgccggggattggggggaaaaggcccgctgccctgattgactgcaaaaaacccgaaatcgaaagaaaaaagcgcgccaccgg

SEQ ID NO: 16326 - protein, 161 aa, Zea mays
  misc_feature: Ceres CLONE 1380092-F
  misc_feature (24)..(24): Xaa is any aa, unknown, or other
  misc_feature (27)..(27): Xaa is any aa, unknown, or other
  misc_feature (28)..(28): Xaa is any aa, unknown, or other
  misc_feature (44)..(44): Xaa is any aa, unknown, or other
  misc_feature (47)..(47): Xaa is any aa, unknown, or other
  misc_feature (52)..(52): Xaa is any aa, unknown, or other
MGKGSVGASWWAFLLLAGVLLVVXATXXAEDGVVERDRKEDLRXCKXACEWXYGKDTPRKRECESECRERHQQADAGEDGDSGVDAYVSRSGRGKCRRQCLRRHEGQPWETQKCMRGCRRPGIGLKLEQEYGPGIKSAANAGKRCNPPPAGDWGEKARCPD

SEQ ID NO: 16327 - DNA, 674 bp, Zea mays
  misc_feature: Ceres CLONE 1380094-F
  misc_feature: Encodes the peptide sequence at SEQ ID NO. 16328
  misc_feature (558)..(558): n is a, c, t, g, unknown, or other
  misc_feature (625)..(625): n is a, c, t, g, unknown, or other
  misc_feature (626)..(626): n is a, c, t, g, unknown, or other
aaagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaaggccgcgccccagcccggcggatggattccgccgccgtggccatcgtgacggtgccgttcccggcgcagggccacctgaaccagctgctgcacctgtccctgctcctggcatcgcgggggcttcctgtccacttcgccgcgccggagccgcacctccgggaggcccgcgcgcgcctgcacggctgggggcccgaccccgcgtcggtgtgcttccgcgcgctggacgtgcccgcgcacgactccccctccccggaccatcctcccccgtccgggngcacatgcagcccctggtcgagggcttctgcaccggcgcgcgggcctcgctagccgcgctccttgcnngagctggcgcgtcgcaccggcgcgtcgtcgtcctctacgaccgatggg

SEQ ID NO: 16328 - protein, 101 aa, Zea mays
  misc_feature: Ceres CLONE 1380094-F
  misc_feature: SWISSPROT Homolog: EC 2.4.1.215 Cis-zeatin O-beta-D-glucosyltransferase
  misc_feature (85)..(85): Xaa is any aa, unknown, or other
MDSAAVAIVTVPFPAQGHLNQLLHLSLLLASRGLPVHFAAPEPHLREARARLHGWGPDPASVCFRALDVPAHDSPSPDHPPPSGXTCSPWSRASAPARGPR

SEQ ID NO: 16329 - DNA, 736 bp, Zea mays
  misc_feature: Ceres CLONE 1380100-F
  misc_feature: Encodes the peptide sequence at SEQ ID NO. 16330
  misc_feature (398)..(398): n is a, c, t, g, unknown, or other
  misc_feature (424)..(424): n is a, c, t, g, unknown, or other
  misc_feature (505)..(505): n is a, c, t, g, unknown, or other
  misc_feature (506)..(506): n is a, c, t, g, unknown, or other
  misc_feature (698)..(698): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggagaggacaccccgcggaagaggnaatgcgagagcgagtgccgcgagcgncaccagcaagctgacgcgggcgaggacggcgacagcggcgtggacgcctacgtctcccgctccgggaggggcgagtgccgnncgcagtgcctgcgccgccacgagggccagccgtgggagaaccaggagtgcatggaggcgtgccgccgccgcggactgggcgtcgactggagcaagagtacggtcgcggcagcgagagcgcggcaagtggccggagagtgcgagcgccacaccgcgggactgggtggagagcacgctgctgtgatgaaaaaanncggggggggggaaggagagggcgcacgcggccccccg

SEQ ID NO: 16330 - protein, 174 aa, Zea mays
  misc_feature: Ceres CLONE 1380100-F
  misc_feature (62)..(62): Xaa is any aa, unknown, or other
  misc_feature (98)..(98): Xaa is any aa, unknown, or other
  misc_feature (162)..(162): Xaa is any aa, unknown, or other
MGKGSVGASWWAFLLLAGVLLVVAATAGAEDGVVERDRKEDLRWCKQACEWQYGEDTPRKRXCESECRERHQQADAGEDGDSGVDAYVSRSGRGECRXQCLRRHEGQPWENQECMEACRRRGLGVDWSKSTVAAARARQVAGECERHTAGLGGEHAAVMKKXGGGEGEGARGPP

SEQ ID NO: 16331 - DNA, 696 bp, Zea mays
  misc_feature: Ceres CLONE 1380101-F
  misc_feature: Encodes the peptide sequence at SEQ ID NO. 16332
  misc_feature (365)..(365): n is a, c, t, g, unknown, or other
  misc_feature (426)..(426): n is a, c, t, g, unknown, or other
  misc_feature (479)..(479): n is a, c, t, g, unknown, or other
  misc_feature (488)..(488): n is a, c, t, g, unknown, or other
  misc_feature (489)..(489): n is a, c, t, g, unknown, or other
  misc_feature (540)..(540): n is a, c, t, g, unknown, or other
  misc_feature (568)..(568): n is a, c, t, g, unknown, or other
aagctggagctccccgcggtggcggccgctctagaactagtggatcccccgggctgcaggaattcgcacgagaccattacctagaacatcctaatcgaaaagaaaactaggaaccccactccccctcccgaaactaccgccgccgccgctgccgccgcgatccaggtctcccgcggtcccgccccgcctgagctctcgacctcttcactcctcgccgccgctgctcgccctcccgcgtatcctcgtctcagctctcaggttttcagcctgatcaaaccggtgtaaccagccgtgcatgactgcattggttcggctcgccggaagagcagcttcgcggagcagggtcggcatagcggcggcggcgncaccctctcctgtcggcttgtccgtgcagcgccggagggcgttccagggcgtgagaatggnagacgggggcagcaaggggcggcgtggcgctctggtggtcctggaaggcctgnaccgagcgnnaaaacttcgcagtgtgcccggctgctgtccttccctcaaggcaaggctacnatgcgaaggatggaggtccccgataggnccacagtgtgggcagatgaatctgcctacctcgctacgatcgcagctggtgacggacgattatctggtctcagggccaccgctggagaaagagcttgatgaaagcaagtacttaggaactatctcatg

SEQ ID NO: 16332 - protein, 133 aa, Zea mays
  misc_feature: Ceres CLONE 1380101-F
  misc_feature (24)..(24): Xaa is any aa, unknown, or other
  misc_feature (44)..(44): Xaa is any aa, unknown, or other
  misc_feature (62)..(62): Xaa is any aa, unknown, or other
  misc_feature (65)..(65): Xaa is any aa, unknown, or other
  misc_feature (82)..(82): Xaa is any aa, unknown, or other
MTALVRLAGRAASRSRVGIAAAAXPSPVGLSVQRRRAFQGVRMXDGGSKGRRGALVVLEGLXRAXKLRSVPGCCPSLKARLXCEGWRSPIGPQCGQMNLPTSLRSQLVTDDYLVSGPPLEKELDESKYLGTIS

SEQ ID NO: 16333 - DNA, 748 bp, Zea mays
  misc_feature: Ceres CLONE 1380106-F
  misc_feature: Translation starting site: 590
  misc_feature: SWISSPROT Homolog: EC 3.4.21.92 Endopeptidase Clp
  misc_feature (391)..(391): n is a, c, t, g, unknown, or other
  misc_feature (392)..(392): n is a, c, t, g, unknown, or other
  misc_feature (401)..(401): n is a, c, t, g, unknown, or other
  misc_feature (551)..(551): n is a, c, t, g, unknown, or other
aaagctggagctccccgcggtggcggccgctctagaactagtggatcccccgggctgcaggaattcgcacgagaccattacctagaacatcctaatcgaaaaatttcttctcctctctgctctgttcacttcgttctagtggggagcgccgccgctgcagttgccgccgccaccagagcagtccacctcggtctgatatggcgaccgggagtgcaagtgccatcgcgtccttctccgtggcggcggcagcggctgctgctctgcgcgtcaggcgggcatgcgctcgcgcttgcgcttgggccccctcgcagcgaccgcagcaaggggcactcgtcagcctcaagccttgcgcctcactggcaccacagctcctctgtggcgcgcggagtcnnatgccgcgngggggtggtgccggccccggcgatgtcatgggcctccctcctcggggagcgcatagtcttcccctcgcacgagatcgaggacttcctcgcggacgccgtcgtcagccagctccctctcctttgacgcatcgacccggactctgacatccngctcttcgtcactcaccagggggatcccttagcgcagcatgggcatctatgatgtaatgcagcttgtggaggcagacgtgtccactatgggatggggcatagctggatcacagcttctattatccttgggtgggtgcacgaagggcaagcgatttgccatggccaacaccaggatatgattcatcaggctggtcggg

SEQ ID NO: 16334 - DNA, 692 bp, Zea mays
  misc_feature: Ceres CLONE 1380109-F
  misc_feature: Encodes the peptide sequence at SEQ ID NO. 16335
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggaaagggggcgagtgcccggcgccagtgcctgcgcccgcacgagggccaggcgtgggagacccaggagtgcaatgaggcgggtgcggccgccgcgggactgggcgtcgactgggagcaaagagtacggtcgcggcagcgagagcgcggggcagtggcccgggagaggtgcgagcgccaccaccgcgggggacttgggggggagg

SEQ ID NO: 16335 - protein, 159 aa, Zea mays
  misc_feature: Ceres CLONE 1380109-F
MGKGSVGASWWAFLLLAGVLLVVAATAGAEDGVVERDRKEDLRWCKQACEWQYGKDTPRKRECESECRERHQQADAGEDGDSGVDAYVSRSGKGASARRQCLRPHEGQAWETQECNEAGAAAAGLGVDWEQRVRSRQRERGAVARERCERHHRGGLGGE

SEQ ID NO: 16336 - DNA, 676 bp, Zea mays
  misc_feature: Ceres CLONE 1380111-F
  misc_feature: Translation starting site: 285
  misc_feature (653)..(653): n is a, c, t, g, unknown, or other
agagctggagctccccgcggtggcggccgctctagaactagtggatcccccgggctgcaggaattcgcacgagaccattacctagaacatcctaatcgaagagcccactcccagaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagcctgaagacctccaagaaactggatgtctccgccatggctgtatacaaggtgaagcttgtcgggcctgaaggtgaagagcacgagtttgatgctccagacgacgcctacgtccttgacgcagccgagactgccgggtgtggagttgccatactcggggccgtgctggggcttgctccacctgtgccggcaaaatcgaggctgggtcgggtgaccaggcggatgggtccttcctggatgacnggcagcaggagggagggtatgtg

SEQ ID NO: 16337 - DNA, 670 bp, Zea mays
  misc_feature: Ceres CLONE 1380113-F
  misc_feature: Encodes the peptide sequence at SEQ ID NO. 16338
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttctttcattcaaccaactgtctacattgggccgtgctgcttatttgcagcaacaactataaccattcagccagctagctactgcctactctcagaacaacaacttcttccatttaaacaattggcgcactgaaccccgctgcttatn

SEQ ID NO: 16338 - protein, 138 aa, Zea mays
  misc_feature: Ceres CLONE 1380113-F
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLSFNQLSTLGRAAYLQQQL

SEQ ID NO: 16339 - DNA, 713 bp, Zea mays
  misc_feature: Ceres CLONE 1380114-F
  misc_feature: Encodes the peptide sequence at SEQ ID NO. 16340
aaagctggagctccccgcggtggcggccgctctagaactagtggatcccccgggctgcaggaattcgcacgagaccattacctagaacatcctaatcaaaaaaagcagagtctgcccctccccgcgccgttctttttggttccccactccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaggcgcacgacatccgtgggcagcacgtggggttcctgggctccttcagctcgccgtcggtcatattcgagaaaatcttcggtaatcttcgcggtgcccagggtattcattggctcaattcctccggcggtggcctttctccccccggggttatttcgagggggtttaagaaagaggggaaatttcccccccggttcacccccgggggggtttttctcgaaggacccccaagggggggggggggcgcaaacaagaggggtgtattaataaaacacctccccgggtccggaggaggggttcttttctccggagaaaaagacccttgtcgggggtttaaaaaaagagggttcccccctttctgtg

SEQ ID NO: 16340 - protein, 145 aa, Zea mays
  misc_feature: Ceres CLONE 1380114-F
  misc_feature: SWISSPROT Homolog: EC 2.7.6.1 Ribose-phosphate diphosphokinase
MEVVVAAKQKAKKHIHLFYCSECEELALKIAASSDAIELQSINWRSFDDGFPNLFINRRTTSVGSTWGSWAPSARRRSYSRKSSVIFAVPRVFIGSIPPAVAFLPPGLFRGGLRKRGNFPPGSPPGGFFSKDPQGGGGAQTRGVY

SEQ ID NO: 16341 - DNA, 688 bp, Zea mays
  misc_feature: Ceres CLONE 1380118-F
  misc_feature: Encodes the peptide sequence at SEQ ID NO. 16342
  misc_feature (535)..(535): n is a, c, t, g, unknown, or other
aaagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcgcaaatgatgatgccacaatgtcactggcgacgccgtctcgcagattaatgctgcacagcangtaccattcatgttcaacccgatgggcatgacgattccacccatgttcttacagcaccccttttgtggtgctgcattctagatagaaatatttgtgttgtaccgaataatgagttgcttgcccatcgcgtgtgactcattattaacaataaaa

SEQ ID NO: 16342 - protein, 119 aa, Zea mays
  misc_feature: Ceres CLONE 1380118-F
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVLPSMMSQMMMPQCHWRRRLAD

SEQ ID NO: 16343 - DNA, 709 bp, Zea mays
  misc_feature: Ceres CLONE 1380124-F
  misc_feature: Encodes the peptide sequence at SEQ ID NO. 16344
  misc_feature (492)..(492): n is a, c, t, g, unknown, or other
  misc_feature (539)..(539): n is a, c, t, g, unknown, or other
  misc_feature (593)..(593): n is a, c, t, g, unknown, or other
acaagctggagctccccgcggtggcggccgctctagaactagtggatcccccgggctgcaggaattcgcacgagaccattacctagaacatcctaatcgaaaagcatcctgagctctctcctggaccagccgagatttctcgctctgcgcatctctgattcatcttcgtcgagaggagctgttcctcttctttgccgcctcgaatctgggactggtcggttttctggatccctgctgcctgtcgggttctcgagaggtgtaaaatccaatggagggtgtgtcatcgttgaaccagccgttgatcaacgacgaccggcagcccgtgcccagcagtatcgccaagggtgatcaaatccaaggcctgttgtcgggtgaatggacaaatgagcggcacagctcgtacataagctccatggaggcatctttcgtggagcaactccgtagtggttccaaggcccatccaggagggcttgtgccagagcatgaggattnccgagggatgatgctcgcagccatgacgtccctgagagtcgtggggnggggggggggagggggttcaggggccccacgcggtgtccaccatggcgtggggnaaatggaaagtgggaactttttggtccgatgggtatgggggatcagggtactgacacggcccccggaaaaaaaagggtccggacccacgcaaaaagaataaccgaaagcttctggt

SEQ ID NO: 16344 - protein, 141 aa, Zea mays
  misc_feature: Ceres CLONE 1380124-F
  misc_feature (75)..(75): Xaa is any aa, unknown, or other
  misc_feature (91)..(91): Xaa is any aa, unknown, or other
  misc_feature (109)..(109): Xaa is any aa, unknown, or other
MEGVSSLNQPLINDDRQPVPSSIAKGDQIQGLLSGEWTNERHSSYISSMEASFVEQLRSGSKAHPGGLVPEHEDXRGMMLAAMTSLRVVGXGGGGGSGAPRGVHHGVGXMESGNFLVRWVWGIRVLTRPPEKKGSGPTQKE

SEQ ID NO: 16345 - DNA, 716 bp, Zea mays
  misc_feature: Ceres CLONE 1380128-F
  misc_feature: Encodes the peptide sequence at SEQ ID NO. 16346
aaagctggagctccccgcggtggcggccgctctagaactagtggatcccccgggctgcaggaattcgcacgagaccattacctagaacatcctaatcgaaaaatgctgtcaccggcagttctgacataacacaccgcttcttccccagttcaagtgccacaccgctcgtcgccttcccatctcgccgcgacatgaatttctgccgccacctgctcctcgccgcggtgttcgcgctcctcctcgctgtctgcgcttctgcggagagcaggggcgctggttccttcgacccatcccgagtggtccaactctcgtggcgccccagggcgttcctgcacaaaggtttcctgtcggatgcgaagtgccaccacctcatcgggctgggcagggacaagctggagaaatctatgggggcccaataacgagtcccggtaagagtgtccaggagtgaggggcgcaccagcctccgggaatgtttctccgaggaggaagcagggatgaaagtactaaacggaaaattagagggaaagggatatcctggttgggaaaatgttcttcccaccaaagaaatggccgaacccatttcaaattattacactacccagaaggggggagaaaaagataaacccccactagcaactaacttccagggacaaaaaaaaatcaaggccctttggggggcccatcccaatcgccccctggggtgaaggacccctctt

SEQ ID NO: 16346 - protein, 75 aa, Zea mays
  misc_feature: Ceres CLONE 1380128-F
MNFCRHLLLAAVFALLLAVCASAESRGAGSFDPSRVVQLSWRPRAFLHKGFLSDAKCHHLIGLGRDKLEKSMGAQ

SEQ ID NO: 16347 - DNA, 680 bp, Zea mays
  misc_feature: Ceres CLONE 1380130-F
  misc_feature: Encodes the peptide sequence at SEQ ID NO. 16348
  misc_feature (502)..(502): n is a, c, t, g, unknown, or other
  misc_feature (629)..(629): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggcaatgggaccgccctggtgctcttcctctccccggtgcctacgttcatccgcatctggaagaaggggtcggtggagcagtactcgccgatcccgtacgtggcgacgctgctgaactgcatgatgtgggtgttgtacgggctgccgctgntgcacccgcacagcatgctggtgatcaccatcaacgggaccgggatgctcatccagctggactacgtggcgctcttcctcgtctactccgcgggggcggcgcgccgcaaggtgtccctcctgctgcngcgcgagggtcgcttcctcggcgccgtcgccgcgctggtgctcggcctggn

SEQ ID NO: 16348 - protein, 123 aa, Zea mays
  misc_feature: Ceres CLONE 1380130-F
  misc_feature (9)..(98): Pfam Name: MtN3_slv Pfam Description: MtN3/saliva family
  misc_feature (65)..(65): Xaa is any aa, unknown, or other
  misc_feature (107)..(107): Xaa is any aa, unknown, or other
MVSSDTIRTAIGVIGNGTALVLFLSPVPTFIRIWKKGSVEQYSPIPYVATLLNCMMWVLYGLPLXHPHSMLVITINGTGMLIQLDYVALFLVYSAGAARRKVSLLLXREGRFLGAVAALVLGL

SEQ ID NO: 16349 - DNA, 651 bp, Zea mays
  misc_feature: Ceres CLONE 1380138-F
  misc_feature: Encodes the peptide sequence at SEQ ID NO. 16350
  misc_feature (393)..(393): n is a, c, t, g, unknown, or other
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtaaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggntgctgtcgggctggcgctgacggcctccgtggtggggctggccgtggccacgccggtgttcctgatcttcagccccgtgctcgtccccgccgcgctgctcatcgggacggccgtcatggggttccctcacgtcgggcgcgctggggctcggggggcctgccctcgctcacgtgccctcgcaacacgggggggggagggttcccagcgcaccccggactacgtgggaggaagcgcaccgcaggatggcggaagcccgcn

SEQ ID NO: 16350 - protein, 148 aa, Zea mays
  misc_feature: Ceres CLONE 1380138-F
  misc_feature (44)..(148): Pfam Name: Oleosin Pfam Description: Oleosin
  misc_feature (63)..(63): Xaa is any aa, unknown, or other
MADRNRSGIYGGAHATYGQQQQQGGGGRPMGEQVKGMLHDKGPTASQALTVVTLFPLGGLLLXAVGLALTASVVGLAVATPVFLIFSPVLVPAALLIGTAVMGFPHVGRAGARGACPRSRALATRGGEGSQRTPDYVGGSAPQDGGSP

SEQ ID NO: 16351 - DNA, 605 bp, Zea mays
  misc_feature: Ceres CLONE 1380139-F
  misc_feature: Encodes the peptide sequence at SEQ ID NO. 16352
  misc_feature (190)..(190): n is a, c, t, g, unknown, or other
  misc_feature (315)..(315): n is a, c, t, g, unknown, or other
  misc_feature (530)..(530): n is a, c, t, g, unknown, or other
aagctggagctccccgcggtggcggccgctctagaactagtggatcccccgggctgcaggaattcgcacgagaccattacctagaacatcctaatcgaaaaaggtttcgtctttttccgttcacaggcggccgtcggtgttcggtgcccctctcctgccaaacgatcccgagcagtgccaccggtgcggncgtgcagaggaagcggccgggatacagtacaggatgcgggggttgacacgcgctgcgaaacgcgcaggggagatggcgttcaacgccggtggtggcgccgtcaactgattcccgggccacatggncgcggcctcccgcgccatccgcgatcgtctcaagctcgccgacctcatcatcgaggtccgcgacgcccgcattcatttatctcagcaaatgaagaccttcaacagtgctctcagcaaagaggcgaattcttgctctaaaacaggaggatctagcaaaccccacataatgaataggtggctgaatcattttgatcatgcagcaggattgtatctcnataatgcacatagtccagttctgttaccagctttctggttttgctgagctgaactaagggaagcatctcaaaggg

SEQ ID NO: 16352 - protein, 88 aa, Zea mays
  misc_feature: Ceres CLONE 1380139-F
  misc_feature (2)..(2): Xaa is any aa, unknown, or other
  misc_feature (74)..(74): Xaa is any aa, unknown, or other
MXAASRAIRDRLKLADLIIEVRDARIHLSQQMKTFNSALSKEANSCSKTGGSSKPHIMNRWLNHFDHAAGLYLXNAHSPVLLPAFWFC

SEQ ID NO: 16353 - DNA, 680 bp, Zea mays
  misc_feature: Ceres CLONE 1380141-F
aaagctggagctccccgcggtggcggccgctctagaactagtggatcccccgggctgcaggaattcgcacgagaccattacctagaacatcctaatcgaaaactacactgacaagcgtacagattggctacttcctactcgcctatctccgcgagacaaagtgttcccccttctcccattcttctctcatttctcaccaccgcctgccgctaccccctttcaacaacaccatgagggagtgcatctcgatccacatcgtccaggccgccatccactccacaaacgcgagctgagagctgtactgcctcgagcatggcattcaggctgatgaccacatgcccggtgacaagaccattggcttaggtgatgatgctattcagcacgcttctcactgatactggcgctgagagaacgtcccccgagctgtttttgttgaccttgagccctctgtcatctaggaggtgaggagtggcacctatcgccagaatcttctatccggagcagctcatcagtgtcaaggaggatgcaacctgcgacttcattctggggcactacaccattgacaaggagattgctgacctgccgcttgaccgcatcacgaatcttgcagataattgcactagcctctaggggttcctcgtcttcaacgctgatggagtagcaatgggctctgggcttgg

SEQ ID NO: 16354 - DNA, 682 bp, Zea mays
  misc_feature: Ceres CLONE 1380145-F
  misc_feature: Encodes the peptide sequence at SEQ ID NO. 16355
  misc_feature (412)..(412): n is a, c, t, g, unknown, or other
  misc_feature (434)..(434): n is a, c, t, g, unknown, or other
  misc_feature (446)..(446): n is a, c, t, g, unknown, or other
  misc_feature (473)..(473): n is a, c, t, g, unknown, or other
  misc_feature (488)..(488): n is a, c, t, g, unknown, or other
  misc_feature (591)..(591): n is a, c, t, g, unknown, or other
ggagctccccgcggtggcggccgctctagaactagtggatcccccgggctgcaggaattcgcacgagaccattacctagaacatcctaatcgaaaaattattatttcttcttccagcggcaattcctggccaccaccgggcgcgctatattactccgggttcgtggacaagcatgcagaggggcgtgtccttccctggcggaatggcgaaggagtgcccgcccgccgagctctggctcccggacgagttcctggacgacgacttcttctccgaggaggagaaggcggcggtcgcggccaaagcgagagcgacgaggaggaagggatggacggcctctcgcgccgcgcggccgggctcgtcgtcgggggtgggagggggacggttcccctgcaaaggcgcaagtgttagccgnctcgccgcagtcgattctgtgncggctgcatgcnttccggggaggacagcccccacgggcnggcgtcgcaggtcancttcgccgccgtcgtcgccggctggagaagaccccggccgaccactgggacctgctcaaagaggcggcccggccaggtggcccgcatgcgcacaactagcggncatcctggtggcaacgaacgcgggcgacatcaaaacaccgttccccgcccggttggggagaagctctctgcgcggcgaagggtccaaaaag

SEQ ID NO: 16355 - protein, 170 aa, Zea mays
  misc_feature: Ceres CLONE 1380145-F
  misc_feature (88)..(88): Xaa is any aa, unknown, or other
  misc_feature (92)..(92): Xaa is any aa, unknown, or other
  misc_feature (101)..(101): Xaa is any aa, unknown, or other
  misc_feature (106)..(106): Xaa is any aa, unknown, or other
  misc_feature (140)..(140): Xaa is any aa, unknown, or other
MQRGVSFPGGMAKECPPAELWLPDEFLDDDFFSEEEKAAVAAKARATRRKGWTASRAARPGSSSGVGGGRFPCKGASVSRLAAVDSVXAACXPGRTAPTGXRRRSXSPPSSPAGEDPGRPLGPAQRGGPARWPACAQLAXILVATNAGDIKTPFPARLGRSSLRGEGSKK

SEQ ID NO: 16356 - DNA, 545 bp, Zea mays
  misc_feature: Ceres CLONE 1380146-F
  misc_feature: Encodes the peptide sequence at SEQ ID NO. 16357
  misc_feature (234)..(234): n is a, c, t, g, unknown, or other
  misc_feature (246)..(246): n is a, c, t, g, unknown, or other
  misc_feature (247)..(247): n is a, c, t, g, unknown, or other
  misc_feature (361)..(361): n is a, c, t, g, unknown, or other
aaagctggagctccccgcggtggcggccgctctagaactagtggatcccccgggctgcaggaattcgcacgagaccattacctagaacatcctaatcgaaaaaaaccctagaagcctccaccctccagcgcctccaccttcctcgccgcctcactccctctgaggtcgcagatccgtccggttagacgaagccgcccgcacccatggcctccggtgagctcgcctgcacctacngccgccctcatnncctcagcgacgacggcatcgccatcaccgccgagaagatcgccaccatcgtggagggcggcaacatcagggcgaggtctactggcggggctcttcgtaactcctgaaaacccancggtaagactatcctctccggggatctgggggggggctgctccgttgtggttccgccccaattggggggggtggaattgtttgttgccccccctgtggggagggaaaaaaaggaaagccccccggggggggttttgagagaacatgggggttttaccccgggtttgaaaagggagaaccccccc

SEQ ID NO: 16357 - protein, 49 aa, Zea mays
  misc_feature: Ceres CLONE 1380146-F
  misc_feature (11)..(11): Xaa is any aa, unknown, or other
  misc_feature (15)..(15): Xaa is any aa, unknown, or other
MASGELACTYXRPHXLSDDGIAITAEKIATIVEGGNIRARSTGGALRNS

SEQ ID NO: 16358 - DNA, 669 bp, Zea mays
  misc_feature: Ceres CLONE 1380147-F
  misc_feature: Encodes the peptide sequence at SEQ ID NO. 16359
  misc_feature (365)..(365): n is a, c, t, g, unknown, or other
  misc_feature (458)..(458): n is a, c, t, g, unknown, or other
aaagctggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcggaggccagactcncagggagcagctggggcagcaggggtacagcgagatggggaagaagggcggtctgagcaccacggacgaggtccggcggcgagcgcgccgccnggggagggcgtcagcatcgacgagtccaagttcaccaagtagtcctatcgcgtgcgtgcgtacgcagcggtcgtagctgtctgcgtagggtacctgggccggagctagtgctactctctactttggagtagctgaatggatataatgtacctagcagcatgcattggagcgatcatacatacgtacgtacccaggtacgtgtggtgtgatc

SEQ ID NO: 16359 - protein, 103 aa, Zea mays
  misc_feature: Ceres CLONE 1380147-F
  misc_feature (1)..(92): Pfam Name: LEA_5 Pfam Description: Small hydrophilic plant seed protein
  misc_feature (48)..(48): Xaa is any aa, unknown, or other
  misc_feature (79)..(79): Xaa is any aa, unknown, or other
MASGQESRKELDRKAREGETVVPGGTGGKSVEAQEHLAEGRSRGGQTXREQLGQQGYSEMGKKGGLSTTDEVRRRARRXGRASASTSPSSPSSPIACVRTQRS

SEQ ID NO: 16360 - DNA, 676 bp, Zea mays
  misc_feature: Ceres CLONE 1380148-F
  misc_feature (264)..(264): n is a, c, t, g, unknown, or other
  misc_feature (352)..(352): n is a, c, t, g, unknown, or other
  misc_feature (365)..(365): n is a, c, t, g, unknown, or other
  misc_feature (366)..(366): n is a, c, t, g, unknown, or other
  misc_feature (373)..(373): n is a, c, t, g, unknown, or other
  misc_feature (374)..(374): n is a, c, t, g, unknown, or other
  misc_feature (393)..(393): n is a, c, t, g, unknown, or other
  misc_feature (404)..(404): n is a, c, t, g, unknown, or other
  misc_feature (478)..(478): n is a, c, t, g, unknown, or other
aaagctggagctccccgcggtggcggccgctctagaactagtggatcccccgggctgcaggaattcgcacgagaccattacctagaacatcctaatcgaaaaacaaatttctctacttttcttcgaccgtcctaccctatccgctcccctcgccggcgccgcggcggcggcgagaaagagagaacgcgctcctcttccttctcgactcgatctgccccttccagcccgctcgcccctcatcgagcgggccttccgtagccctanggtgatccgcgcctccttcccgcgcagcggaacaggacgcctgaccgtcgaccgtcgaagcgattcctctctcgcgggcggtctcgtntcgccctcctcgnnctctcgnntgcagtggggtcgcgcggnaaggcaatccntcgggctacgggcgatttggtctccactggctggtgaactttaatagaccatggatctggaaaccgaaaaccgnctggcttcttactacttgaaaaggcccgaaattacaattaaggctaacgggggagggggtcaaggctttttgcgaaaacttaggggtagggttgcccaaaatcccgggttcccaaaacccaaggttgggggagtaaaaaaacaaaattgggttgggggagaaaatggaaaggggggggccccagaaaaaagaaattgg

SEQ ID NO: 16361 - DNA, 747 bp, Zea mays
  misc_feature: Ceres CLONE 1380150-F
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (20)..(20): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (52)..(52): n is a, c, t, g, unknown, or other
tttttcccccccnncccncnccgccccccggcgcggnnttnntttaatnttnttcaaagctggagctccaccgcggtggcggccgctctagaactagtggatcccccgggctgcaggaattcgcacgagaccattacctagaacatcctaatcgaaaagtggaggtaatgtgaaatggagggctcttcgccttgatactggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaaggagtggtaccctcactcactatggagttgacattggtaggaacaagaaaaccccctgctggcaaagaaggataatgctcacgccacaaggggggtggggggggggagcttgagaaaacaaaaaagagcacccatggcacggggaaacttttgaaaagcgcagggagggaacgaaccctttgacccacacatttggggagaaattttgggaagggggacgggtgggtggcaatggattttcttccccccccctggaacggggggggccgaaggttaatggataaccttcctttggagggtaaaaaaaactttggagtttcttccctggaaaaaaagccttccccgagggaggagaaggcggccaggaaggcgtttgcaaagtttcacaaaaccttctgcccgggg

SEQ ID NO: 16362 - DNA, 714 bp, Zea mays
  misc_feature: Ceres CLONE 1380155-F
  misc_feature: Encodes the peptide sequence at SEQ ID NO. 16363
  misc_feature (393)..(393): n is a, c, t, g, unknown, or other
  misc_feature (628)..(628): n is a, c, t, g, unknown, or other
  misc_feature (714)..(714): n is a, c, t, g, unknown, or other
aagctggagctccccgcggtggcggccgctctagaactagtggatcccccgggctgcaggaattcgcacgagaccattacctagaacatcctaatcaaaaaagttccatatccaacacacacagcaacgctcgctcggcactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtattggacggcgggccccccctggggcggggggggggaccgcacntccggctccgggttccagtccaagagcgagaacctgtttcggaaaaatccacatgcagatcaggctggtgccaaggaaattccggtggcacgggccaccacccttctacttggcggccccagggggccgcggcacgacgaaatcgaatttccaggtccctggggcaacgggggggggagagcccttacccgctggacaaccaaacgggtttcccccccgagaaaggggccccccngaaagaaaacaattccccccccttgggtcaaaacctaaacagtggttttccaccccttaccccgttgttgggagaaccccgcgaan

SEQ ID NO: 16363 - protein, 163 aa, Zea mays
  misc_feature: Ceres CLONE 1380155-F
  misc_feature (57)..(57): Xaa is any aa, unknown, or other
  misc_feature (135)..(135): Xaa is any aa, unknown, or other
MRSFAPVFLSAVVAWLELAGTAQGGNFYQDTEMTWGDGRGKVLDGGPPLGRGGGPHXRLRVPVQEREPVSEKSTCRSGWCQGNSGGTGHHPSTWRPQGAAARRNRISRSLGQRGGESPYPLDNQTGFPPEKGAPXKENNSPPLGQNLNSGFPPLTPLLGEPRE

SEQ ID NO: 16364 - DNA, 647 bp, Zea mays
  misc_feature: Ceres CLONE 1380157-F
  misc_feature: Translation starting site: 229
  misc_feature: SWISSPROT Homolog: EC 2.4.1.207 Xyloglucan:xyloglucosyl transferase
  misc_feature (362)..(362): n is a, c, t, g, unknown, or other
  misc_feature (363)..(363): n is a, c, t, g, unknown, or other
  misc_feature (391)..(391): n is a, c, t, g, unknown, or other
  misc_feature (436)..(436): n is a, c, t, g, unknown, or other
  misc_feature (474)..(474): n is a, c, t, g, unknown, or other
  misc_feature (621)..(621): n is a, c, t, g, unknown, or other
aagctggagctccccgcggtggcggccgctctagaactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtgcccttgctgctgctggtcctgggcgtgctggtgtcgtgctccttcgcggcgggcagcttggaccaggagctggacatcacgtggggcgacgggcggggcaaggtcctggnnacacggcggctgctgacgctgtcgctgnaccgcacgtccggctccggtttcagtccccgcacgagtacctggntcggcagatcgacatgcaactggcggctgggtgcgggnaaactccgccggaaccgtcacccgctactacctggcgtcgcagggcggcgcgcacgacaagatccacttccgagtccctgggcaacggggccggggagccttacccgtgaacaccaaggtgttcaccgggggggaaggggcacgggnaaacaaatttccccccttgtggtcac

SEQ ID NO: 16365 - DNA, 843 bp, Zea mays
  misc_feature: Ceres CLONE 1380161-F
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (24)..(24): n is a, c, t, g, unknown, or other
ngtttcccccccnnnnnncncctncccccctccgggccctcttgggggttggttcagagctggagctccccgcggtggcggccgctctagaactagtggatcccccgggctgcaggaattcgcacgagaccattacctagaacatcctaatcgaaaatcttctctttctccgtcccctcccaacacgcgttccccaaattctcccaccctactagaaatccccatatccgcggcggcgccgtccatcggattcgatccctcctagcgagtcgactccatctgatccggggagccggggcaccagccacgatgtggggcggcatcgtgccttggcgtcttgctgcgcggcgtgcgcgtgggaggcgcgccggaaggcggtcgcggagattcggccgccggttcggccccgcatcggcatattggggggccttctttcgggggtggggcgcggtcgttcggattccctgggggcgcttcgacagggggcccgccgggggccccctcccttgcaaggccgattccccaaggggaatttaacccccttttttccacccggagaaacccccccccaaaaccggcggaaggggggtttccccaaaaaatcggaaccggggccgggactcaagagggtctccgaggcctgggcggaaaagttttgctgtgcttcctttcgaggcagatcctgccggtcgctccgttaatcgggccccgggcgttctcacgggactccaaaaagcggccccccccggggagagcaaagatctcccccccgcgggggggtggggaaggggcccacaaaaaatgtgtgtcgggccgggtgcccctctgctccacatcctcccg

SEQ ID NO: 16366 - DNA, 743 bp, Zea mays
  misc_feature: Ceres CLONE 1380164-F
  misc_feature: Encodes the peptide sequence at SEQ ID NO. 16367
  misc_feature (19)..(19): n is a, c, t, g, unknown, or other
  misc_feature (20)..(20): n is a, c, t, g, unknown, or other
  misc_feature (34)..(34): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttttccccccctccccnnccctttccttcccntgtggtggggnnnngggggcagagctggagctccccgcggtggcggccgctctagaactagtggatcccccgggctgcaggaattcgcacgagaccattacctagaacatcctaatcgaaaaattcgcaccaccgccgcgccgcccaaaccctagccgccgccgccgccgccgccgccatggtcgccgtcaaccgccccctcgtctccgtgaaggccctagagggcgacatggtaaccgacgcccccggcatcgccttaccgcccgtcttcggggcgccgatccgccccgacgtggtcaggttcacccacaagctgctgtcctgcaacaagcgccagccctacgcagtctcccgccgcgccggccaccagacgtcgggcgagtcctgggggacgggggcgcgccgtgtctcgtatcccccgcggtcccccggcgggggcacccaccgcggccggccaggggagcgttcggcaaatgttgccccccgggcggggcgcatggttcgcggccccaccaggatctggggggcaggggggggaccgccgggggcaacatcaaacctccgggcgggggcggccggggggctccgggggtcggcgggcaaggggggggccccggagcccttcggcccaggggggcgggggggcccccgggcatcgggaggggtggggccccggaggaggggcccgcttggcgattgttgcggagat

SEQ ID NO: 16367 - protein, 177 aa, Zea mays
  misc_feature: Ceres CLONE 1380164-F
MVAVNRPLVSVKALEGDMVTDAPGIALPPVFGAPIRPDVVRFTHKLLSCNKRQPYAVSRRAGHQTSGESWGTGARRVSYPPRSPGGGTHRGRPGERSANVAPRAGRMVRGPTRIWGAGGGPPGATSNLRAGAAGGLRGSAGKGGAPEPFGPGGRGGPRASGGVGPRRRGPLGDCCGD

SEQ ID NO: 16368 - DNA, 670 bp, Zea mays
  misc_feature: Ceres CLONE 1380165-F
  misc_feature: Encodes the peptide sequence at SEQ ID NO. 16369
  misc_feature (484)..(484): n is a, c, t, g, unknown, or other
aaagctggagctccccgcggtggcggccgctctagaactagtggatcccccgggctgcaggaattcgcacgagaccattacctagaacatcctaatcgaaaaaactcccccggccgtcctgctcgccggcttctggctggcccctgcatccgcccagtgtgtgtgacctcagggaatcgattcgttcatccaagtgaaggcaaccagactccaggatggagttcaaagccggcgttttcaccgtggcaatgctagccatcgtcgtgctctccacaccagcagccccgcagaagcccaagagccctcccgctccgcgatccccagtcgtcctggcgccggcgccagcgcccgcaccggcggcgccgcaccacgtggacctcgcggacctcctcagcgtggccgggccgttccacacgttcctggactacctgcagaagaccggcgtcatcgagaccttccagaggcaggcgaacgacacgaagcnggggcggcatcacccgtcttcgtgcccagggactcgggcgttcgcggcgctgaaacagaccacggttcgccaacctcacccaggaccagctcagggtcgctgctgctgtgccaccgcgctgccccagtactactcccttgcccgagtttcaccggttggagcgcgtttcgggccgggtgccaaccc

SEQ ID NO: 16369 - protein, 151 aa, Zea mays
  misc_feature: Ceres CLONE 1380165-F
  misc_feature (90)..(90): Xaa is any aa, unknown, or other
MEFKAGVFTVAMLAIVVLSTPAAPQKPKSPPAPRSPVVLAPAPAPAPAAPHHVDLADLLSVAGPFHTFLDYLQKTGVIETFQRQANDTKXGRHHPSSCPGTRAFAALKQTTVRQPHPGPAQGRCCCATALPQYYSLARVSPVGARFGPGAN

SEQ ID NO: 16370 - DNA, 636 bp, Zea mays
  misc_feature: Ceres CLONE 1380173-F
  misc_feature: Translation starting site: 261
  misc_feature: SWISSPROT Homolog: EC 4.1.2.13 Fructose-bisphosphate aldolase
aagctggagctccccgcggtggcggccgctctagaatagtggatcccccgggctgcaggaattcgcacgagaccattacctagaacatcctaatcgaaaaagatcagatccccctttcgctggtttctttccccttggccaagcccaaaccgtctttaaatacacccgtcgtcgtccgcatcccccgcctgccttaaccattcctcccaacaccacctcgcctgcgatcttcgtagcctccgtcgcgtcgagcatcgatcatgtcggcctactgcggaaagtacaggatgagctcatcaagaatgctgcctacattggcacccccggcaagggtatccttgctgctgatgagtccactggcaccattggcaagcgcctttgcagcatcaatgtcaagaacgttgaggagaaccgccgtgccctcggtgagctcctattctgctgccctggtgctctccagtacatcaggggtgtgatcctcttcgaggagaccctgtaccagaagaccaaggatggcaagcctttttgttgatgtcctcaaggagggagggcgtcctccctggcaatcagggtggacaaggccacaatggagggtggtggcactgataaggagaccaccacccagggcatgacgac

SEQ ID NO: 16371 - DNA, 693 bp, Zea mays
  misc_feature: Ceres CLONE 1380174-F
  misc_feature: Translation starting site: 167
  misc_feature (317)..(317): n is a, c, t, g, unknown, or other
  misc_feature (325)..(325): n is a, c, t, g, unknown, or other
aagctggagctccccgcggtggcggccgctctagaactagtggatcccccgggctgcaggaattcgcacgagaccattacctagaacatcctaatcgaaaaacctctagcccgacaggtgaagccgccgccgctgcagtgtccatagccaccgcaggagactggagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacnagatttgnttgtgcgatttaccaacaaggacatcacagcacaaatcatctctgctagtatagcaggtgaatatgggttcttgcttctgcttactcgcatgagttgccacgattgggtctttgaagttggtctgaccaactatgcagctgcctactgcactgggccttctgttgggctcgccgtgtgtcaaaggacccgtggtttagataagggatatgagggccaatgttgaggcacttgggggagaatttctctgttgagccagctgatgagaggagggcctttccgtgttcctccttggatgttggccttattaggactacgactggggacccgtggtctttggtgcctccagggaactttttgggatgggggg

SEQ ID NO: 16372 - DNA, 718 bp, Zea mays
  misc_feature: Ceres CLONE 1380177-F
  misc_feature: Encodes the peptide sequence at SEQ ID NO. 16373
  misc_feature (294)..(294): n is a, c, t, g, unknown, or other
  misc_feature (345)..(345): n is a, c, t, g, unknown, or other
  misc_feature (390)..(390): n is a, c, t, g, unknown, or other
  misc_feature (395)..(395): n is a, c, t, g, unknown, or other
  misc_feature (403)..(403): n is a, c, t, g, unknown, or other
  misc_feature (421)..(421): n is a, c, t, g, unknown, or other
  misc_feature (459)..(459): n is a, c, t, g, unknown, or other
  misc_feature (640)..(640): n is a, c, t, g, unknown, or other
  misc_feature (680)..(680): n is a, c, t, g, unknown, or other
  misc_feature (682)..(682): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggnccgggcggaggacggagtggtcgaacgggaccgcaggaggacctgcggtgntgcaaagcagcgtgcgagtggcagtacggaaaggacaccccgcgnaaganggaatgcnagagcgagtgccgcgagncgcaccagcaagctgacgcgggcgaggacggcgacagncgcgtggacgcctacgtctcccgctccgggaggggcgagtgcccgcgccagtgcctgcgccggcacgaggggcagccgtgggagacccaggagtgcatgaggcggtgccgccgccgcggactgcccgtcgacatggagcaagagtaccgtcgcggcagcgagacgcgggcaagtgccgggnaaggtgccagcgccacccacgcggggactggtggaagagnanccctgctatgtgaaaaaaaaaannnggggggggggg

SEQ ID NO: 16373 - protein, 159 aa, Zea mays
  misc_feature: Ceres CLONE 1380177-F
  misc_feature (35)..(35): Xaa is any aa, unknown, or other
  misc_feature (52)..(52): Xaa is any aa, unknown, or other
  misc_feature (55)..(55): Xaa is any aa, unknown, or other
  misc_feature (61)..(61): Xaa is any aa, unknown, or other
  misc_feature (73)..(73): Xaa is any aa, unknown, or other
  misc_feature (134)..(134): Xaa is any aa, unknown, or other
  misc_feature (147)..(147): Xaa is any aa, unknown, or other
  misc_feature (148)..(148): Xaa is any aa, unknown, or other
  misc_feature (155)..(155): Xaa is any aa, unknown, or other
  misc_feature (156)..(156): Xaa is any aa, unknown, or other
MVGVPPARRRAAGRSSHGPGGGRSGRTGPQEDLRXCKAACEWQYGKDTPRKXECXSECREXHQQADAGEDGDXRVDAYVSRSGRGECPRQCLRRHEGQPWETQECMRRCRRRGLPVDMEQEYRRGSETRASAGXGASATHAGTGGRXXLLCEKKXXGGG

SEQ ID NO: 16374 - DNA, 685 bp, Zea mays
  misc_feature: Ceres CLONE 1380178-F
  misc_feature: Encodes the peptide sequence at SEQ ID NO. 16375
  misc_feature (503)..(503): n is a, c, t, g, unknown, or other
  misc_feature (512)..(512): n is a, c, t, g, unknown, or other
  misc_feature (531)..(531): n is a, c, t, g, unknown, or other
  misc_feature (532)..(532): n is a, c, t, g, unknown, or other
  misc_feature (578)..(578): n is a, c, t, g, unknown, or other
aaagctggagctccccgcggtggcggccgctctagaactagtggatcccccgggctgcaggaattcgcacgagaccattacctagaacatcctaatcgaaaagtcaaagcagagtctgcccctccccgcgccgttctttttggttccccagtccccgccgccgccgaaacccgcagatggaggtcgtcgtcgccgcgaagcagaaggcgaagaaacacatacacctcttctactgctcagaatgcgaggagctcgccctcaagatcgccgccagctccgacgccatcgagctccaatccatcaactggcggagcttcgacgacgggttcccgaacctgttcatcaacaaggcgcacgacatccgtgggcagcacgtggcgttcctgggctccttcagctcgccgtcggtcatattcgagcagatctccgtcatcttcgcgctgccaagctattcatcgcctcattcacgctcgtgctggcattcttccccacgggctcattcnagcgcgttnaggaaaaagggcgatgtcnnccaccgcgttcaccctcgcgcgcatttctctcgatgatccccagtncgcggcgcggggctttaccagcgtcgtcatctacgacatcacgggtttccagggagagtttttactcccgggggacgatggtctgccatgctttcaagaacggggat

SEQ ID NO: 16375 - protein, 130 aa, Zea mays
  misc_feature: Ceres CLONE 1380178-F
  misc_feature: SWISSPROT Homolog: EC 2.7.6.1 Ribose-phosphate diphosphokinase
  misc_feature (112)..(112): Xaa is any aa, unknown, or other
  misc_feature (119)..(119): Xaa is any aa, unknown, or other
MEVVVAAKQKAKKHIHLFYCSECEELALKIAASSDAIELQSINWRSFDDGFPNLFINKAHDIRGQHVAFLGSFSSPSVIFEQISVIFALPSYSSPHSRSCWHSSPRAHSSAXRKKGDVXHRVHPRAHFSR

SEQ ID NO: 16376 - DNA, 790 bp, Zea mays
  misc_feature: Ceres CLONE 1380181-F
  misc_feature (285)..(285): n is a, c, t, g, unknown, or other
  misc_feature (288)..(288): n is a, c, t, g, unknown, or other
aaagctggagctccccgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcattggtgggcgttcctcctgctcgccggcgtgctgctggtcgtancanccacggccggggcggaggacggagtggtcaaacgggacggcaaggaggacctgcggttgtgcaagcaggcgtgcgagtgccactaccgaaagggcccccccgcggaaaagggaattgcgagaagcgagtgccgcgaagcgccaccaagcaagctgacgcgggcagaggacggcgaaaagcggggttggaccccctacgtctcccgcttcccggagggggcaagtgccggccccaaatggcctggcccccccccaaagggccagccggggggaaaaccccaggaggggcttgaggcgggtgcccccccccccggaattggtctcgtcaaaatgtgaccaagaataccggtcccggacaaccaaaaaacccggtcacaattccccggaaaaaaggtgcaaacccccaccccccgcggggtaatctggttgtgaacaagcaaccgtctccttggaggacgcaacaaaaaactcccaggggaaggcgtatttatatcttgcttctt

SEQ ID NO: 16377 - DNA, 775 bp, Zea mays
  misc_feature: Ceres CLONE 1380184-F
  misc_feature: Encodes the peptide sequence at SEQ ID NO. 16378
aagctggagctccccgcggtggcggccgctctataactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcctttcttcccccgtacctctcatcagcggtgtcttcgggatgtgaaaaccccatccttcaaccctacaggatccaacagggaatcgcagctggcatcttacctttatcccccttgttcctccaacaatcatcacccctataacaacagttaccttttggtgcattttatgggcacaaaaactcaagggcacaacaactacaacaactttgtgctaaaaaaactttgctggccaactctccaaaacaagaagtttcctcccattcaacccaactaaggttcattgaaatcctggcttccttattttgaaaaaaaaaacaaattaccctttccagcccaggttaccttgcttgccctaaccccccaaaaattttcttccccattcaccccaaactggggaagaaattggaacccccccccgtgctttattttaaaaaaagggagaccaactttattccccttttctacccccacttttatggttgtggggggagacccccctctcttaaccttttttt

SEQ ID NO: 16378 - protein, 80 aa, Zea mays
  misc_feature: Ceres CLONE 1380184-F
MAAKIFCLLMLLGLSASAATATIFPQCSQAPIASFLPPYLSSAVSSGCENPILQPYRIQQGIAAGILPLSPLFLQQSSPL

SEQ ID NO: 16379 - DNA, 711 bp, Zea mays
  misc_feature: Ceres CLONE 1380187-F
  misc_feature: Translation starting site: 140
  misc_feature: SWISSPROT Homolog: EC 1.2.4.1 Pyruvate dehydrogenase (acetyl-transferring)
  misc_feature (526)..(526): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaatctgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcggaacgcggaaggctggtggcgcgtgcagcagttacagcaaaggcggatgtaccatcgagcacgtccgaacggcatgaggtcttgctgtttgaagctcttcgtgaggccttgatggaagagatggaattagatcccacagtgtgtgtatttggtgaagatggttggcattacggtggttcttacaagggtgacaaagggtttgctgatacgtttgggagaccttcgaggtctggacacccctattgcgaagaactcgtttactggcatgggaagtgagancggaatgaaagggctgacgcccgtcgntgaaggcatgaacatgggattcctgctccttgcttacaacagatctcaataactgtggaatgcttcattacactcccgggggccagttcaaaatcccacttgtgatccgtgccccggggggtgtgggtcgtcagcttggaacaaccactcccaccgcc

SEQ ID NO: 16380 - DNA, 709 bp, Zea mays
  misc_feature: Ceres CLONE 1380198-F
  misc_feature: Encodes the peptide sequence at SEQ ID NO. 16381
  misc_feature (455)..(455): n is a, c, t, g, unknown, or other
  misc_feature (553)..(553): n is a, c, t, g, unknown, or other
  misc_feature (632)..(632): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaaggattggagtgttttcctcgtcttcaagcgagaagggtcttcaggacttgttttttgggcgggcgcagttgcggagatgcagaggctgggggatttcaggctccctcccttcttcaactaccctccttacttcactttgcagcctatgcgtgaaacacgggaaaagcaagtacagttatggaaaaatatgatactcgattactgtagaagtcaaaagatacatacaatatccctggaagaagatttccccatgttctccaatccaaagattgagagatctcttacctatgaagcaaaggaagtgttccttgcagctctcgtcagtgaaggtcgtgctgagtggatggacaangggtcacagaagtgccctagtctttggctaaggatacaggattgggccaattcatattaaactttgtaaaggatatggggttgaagtaatgactattngagaaatacgctctggaattgatacacgtggaactgaacttgaggaatcgatcgtggtggtctcatggcggcgctgcgnactnaaagcaaaagggaaagcagctatcctcaagggccccccggcgatgacaagggcgaaaattttcggaaaagtcc

SEQ ID NO: 16381 - protein, 111 aa, Zea mays
  misc_feature: Ceres CLONE 1380198-F
  misc_feature (7)..(112): Pfam Name: ESCRT-II Pfam Description: ESCRT-II complex subunit
  misc_feature (92)..(92): Xaa is any aa, unknown, or other
MQRLGDFRLPPFFNYPPYFTLQPMRETREKQVQLWKNMILDYCRSQKIHTISLEEDFPMFSNPKIERSLTYEAKEVFLAALVSEGRAEWMDXGSQKCPSLWLRIQDWANSY

SEQ ID NO: 16382 - DNA, 713 bp, Zea mays
  misc_feature: Ceres CLONE 1380200-F
  misc_feature: Encodes the peptide sequence at SEQ ID NO. 16383
  misc_feature (422)..(422): n is a, c, t, g, unknown, or other
  misc_feature (458)..(458): n is a, c, t, g, unknown, or other
  misc_feature (459)..(459): n is a, c, t, g, unknown, or other
  misc_feature (475)..(475): n is a, c, t, g, unknown, or other
  misc_feature (481)..(481): n is a, c, t, g, unknown, or other
  misc_feature (482)..(482): n is a, c, t, g, unknown, or other
  misc_feature (505)..(505): n is a, c, t, g, unknown, or other
  misc_feature (531)..(531): n is a, c, t, g, unknown, or other
  misc_feature (545)..(545): n is a, c, t, g, unknown, or other
  misc_feature (567)..(567): n is a, c, t, g, unknown, or other
  misc_feature (577)..(577): n is a, c, t, g, unknown, or other
  misc_feature (646)..(646): n is a, c, t, g, unknown, or other
caaagctggagctcaccgcggtggcggccgctctagaactagtggatcccccgggctgcaggaattcgcacgagaccattacctagaacatcctaatcgaaaagcatttcacacgcgaaatttccccttttccaacgccacagcaaacagcatccacagcggagagcgtctctttctccttcccctccctctttccacgacaccaaaagaaaccgaaaaccatcgacgcgctccgtccaccctcccctaccccgcgtcctcctcccctacgcctcccagcccagcggcaaaacctaaccctagatgggcgccgtcacctctacggtcgcggcgcgctttgcctttttcccgccgagcccgccgtcgtacgggttcgagcagccggcgccgcttccggcccctgccacacccgagcctccggncccggccacatccaagcccgcgccctccggcccggnncacaccaaagcgccgncagcgnnggagaaaaagggcggtggcgcgntggtggacctcacgggcgtcccgcgnagggttaacgtggnaggcgcgcggctgcggacaaancggggcacgnaggtggtcgcgatgcacgtgcgccagggggggccaagctcacgctgctctactcccacggaaccgccgncgacctcgggcagatggtacgagttcttcgtgagtcagggcccacctaaagtaaactcatgggggag

SEQ ID NO: 16383 - protein, 136 aa, Zea mays
  misc_feature: Ceres CLONE 1380200-F
  misc_feature (40)..(40): Xaa is any aa, unknown, or other
  misc_feature (52)..(52): Xaa is any aa, unknown, or other
  misc_feature (58)..(58): Xaa is any aa, unknown, or other
  misc_feature (60)..(60): Xaa is any aa, unknown, or other
  misc_feature (68)..(68): Xaa is any aa, unknown, or other
  misc_feature (81)..(81): Xaa is any aa, unknown, or other
  misc_feature (88)..(88): Xaa is any aa, unknown, or other
  misc_feature (92)..(92): Xaa is any aa, unknown, or other
  misc_feature (115)..(115): Xaa is any aa, unknown, or other
MGAVTSTVAARFAFFPPSPPSYGFEQPAPLPAPATPEPPXPATSKPAPSGPXHTKAPXAXEKKGGGAXVDLTGVPRRVNVXGARLRTXRGTXVVAMHVRQGGPSSRCSTPTEPPXTSGRWYEFFVSQGPPKVNSWG

SEQ ID NO: 16384 - DNA, 731 bp, Zea mays
  misc_feature: Ceres CLONE 1380201-F
  misc_feature: Encodes the peptide sequence at SEQ ID NO. 16385
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (471)..(471): n is a, c, t, g, unknown, or other
  misc_feature (491)..(491): n is a, c, t, g, unknown, or other
  misc_feature (625)..(625): n is a, c, t, g, unknown, or other
  misc_feature (686)..(686): n is a, c, t, g, unknown, or other
atagctggagctccccgcggtggcggccgctctagaactagtggatcccccgggctgcaggaattcgcacgagaccattacctagaacatactaatcgaaaagtaccatgcatgtgttcaaaacggaaagtctgatctgaagccagcagacgtgaaaccgacagcacgtacgtacgtgtgagggctgagggctgctcggcggccatgggacaatggtgctttaagaaacgcgcagctctggtgattattgtggccattagctcgctgcagctgctcctgataactgctcaagaagctggaggagaccacgaggtgtggtcgtcgtcatcctcgccggccggtggtcgtggtggcggcgccgtcgtcgtcccgacggcgcggatggggcggagtcccnnnnnnnttgtgggtgtggnnnnnnnnnnnnttttttttttttnnnnnggtgggcttcccctctgccccgggggnttcccggccctccccgtggngtccttctccgtcctgcgggggggggtggccctgttggtcgccgtgccccgtttcctggcggggtctttcgcctccgccgggcttcctcgcccccgtcctgtttccggggcgtttcccttcgggcgcctgggtnggtttggggcgggggcccccttgggtgcccccggggggccgtctcccttccggtcctccgntttcttttcctcttcccggcttcgtgggcccctccggtcgggggt

SEQ ID NO: 16385 - protein, 175 aa, Zea mays
  misc_feature: Ceres CLONE 1380201-F
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (71)..(71): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (75)..(75): Xaa is any aa, unknown, or other
  misc_feature (79)..(79): Xaa is any aa, unknown, or other
  misc_feature (80)..(80): Xaa is any aa, unknown, or other
  misc_feature (96)..(96): Xaa is any aa, unknown, or other
  misc_feature (141)..(141): Xaa is any aa, unknown, or other
  misc_feature (161)..(161): Xaa is any aa, unknown, or other
MGQWCFKKRAALVIIVAISSLQLLLITAQEAGGDHEVWSSSSSPAGGRGGGAVVVPTARMGRSPXXXVGVXXXXXFFFXXGGLPLCPGGFPALPVXSFSVLRGGVALLVAVPRFLAGSFASAGLPRPRPVSGAFPFGRLGXFGAGAPLGAPGGPSPFRSSXFFSSSRLRGPLRSG

SEQ ID NO: 16386 - DNA, 747 bp, Zea mays
  misc_feature: Ceres CLONE 1380203-F
  misc_feature: Encodes the peptide sequence at SEQ ID NO. 16387
  misc_feature (272)..(272): n is a, c, t, g, unknown, or other
aaagctggagctccccgcggtggcggccgctctagaactagtggatcccccgggctgcaggaattcgcacgagaccattacctagaacatcctaatcgaaaaaacagcgaacacatctgcttcgcatttcttcccatcccccttcgcaacccaaaccccaactcgctccgcatcgatggcgcccaaggccgagaagaagcccgcggcgaagaagccggcggaggaggagcccgcggctgagaaggcgccccgcgggaagaagccgaaggcgnagaagcgggtccccgctggcaagtccgctgccaaggggaggcgcgagggcaagaagggcaggaagaagggcaggaagagcggtgaaacctacaagatctacctcttcaagggggtgaagcagtgcaccggggacatgggcatcctcctccaggccatggccaaatatgaattcctccattaccgaattcttcaaaaactagttggtggggcgccaagttccggcgcttataaaaaaacccaacctacccctccggggagaaaaaaattccgggggcctccccttttccggggagatccccaaaaaccccctctccgaggggaaccgaggcggcacccaaatccccccccccaaagagggggctcccccccttggaaaaattttccccgggtgccccatttttttggaaaaagggggggggttgtttttttctccccccctctcgtgggaaaatttttttttttaaagaggggggg

SEQ ID NO: 16387 - protein, 190 aa, Zea mays
  misc_feature: Ceres CLONE 1380203-F
  misc_feature (33)..(33): Xaa is any aa, unknown, or other
MAPKAEKKPAAKKPAEEEPAAEKAPRGKKPKAXKRVPAGKSAAKGRREGKKGRKKGRKSGETYKIYLFKGVKQCTGDMGILLQAMAKYEFLHYRILQKLVGGAPSSGAYKKTQPTPPGRKKFRGPPLFRGDPQKPPLRGEPRRHPNPPPQRGGSPPWKNFPRVPHFFGKRGGVVFFSPPLVGKFFFLKRG

SEQ ID NO: 16388 - DNA, 647 bp, Zea mays
  misc_feature: Ceres CLONE 1380205-F
  misc_feature: Translation starting site: 168
aaagctggagctccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggattcggcggcggcggcaactcaggtggggacttacttcctgcggaactactacgacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaagtgagatcaagactgccaattttgtgaactcatgggggcgatggggtgctaggtatggtctctggtctagtgcagaccaaggagtacagccaccaaaggaaatttatccagatggtcttcccttgccctacagagaagggttactttgtcctcaacgattactttcacttcgttgaccaagacatgtgcagcctgcgccagggatgctcagaaaactacgagagcaatttggcacccaaccagttgttgagacgctcctgagtacttcacga

SEQ ID NO: 16389 - DNA, 732 bp, Zea mays
  misc_feature: Ceres CLONE 1380209-F
  misc_feature: Encodes the peptide sequence at SEQ ID NO. 16390
  misc_feature (454)..(454): n is a, c, t, g, unknown, or other
  misc_feature (612)..(612): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaaccgccaccgggatggccggagttcccgccaccttctcctcagccaccgctcagatcgggggcttcctctcgaagaagccttacgcgccgccgttgtgggccacgcacctctcccccatgccttgccataccttctcgctcggccatttcccaacaccgattcacaagtggaatctgcccaatttgccggaaggaacggaagtgtggatcaagcgagacgatttatcaggcatgcagttgagtggaaacaaggtccggaagctggagttcttgatggcagatgccgtagcacaaggcgcggactgcgttattactgttgggggtatacagagtaaccactgccgtggcacagncgtggctgctaagtatctcaatcttgattgctacctgatactacgtaccctccagctttctgtggataaggaccctggtttggttggcaatcttcttgtcgagagactagttgggggaacacgttgatctttgtgtcaaagaaagatatggaaaaatnggcagggtgcttttagctgacctgctgaaaaaaggcttctgggaagaaggnaggaagccgtatggattcctgttggtggaccaaactcttgggaacttggggattattgaggcaaaaggg

SEQ ID NO: 16390 - protein, 155 aa, Zea mays
  misc_feature: Ceres CLONE 1380209-F
  misc_feature: SWISSPROT Homolog: EC 3.5.99.7 1-aminocyclopropane-1-carboxylate deaminase
  misc_feature (114)..(114): Xaa is any aa, unknown, or other
MAGVPATFSSATAQIGGFLSKKPYAPPLWATHLSPMPCHTFSLGHFPTPIHKWNLPNLPEGTEVWIKRDDLSGMQLSGNKVRKLEFLMADAVAQGADCVITVGGIQSNHCRGTXVAAKYLNLDCYLILRTLQLSVDKDPGLVGNLLVERLVGGTR

SEQ ID NO: 16391 - DNA, 746 bp, Zea mays
  misc_feature: Ceres CLONE 1380213-F
  misc_feature: Encodes the peptide sequence at SEQ ID NO. 16392
  misc_feature (262)..(262): n is a, c, t, g, unknown, or other
  misc_feature (283)..(283): n is a, c, t, g, unknown, or other
  misc_feature (286)..(286): n is a, c, t, g, unknown, or other
  misc_feature (292)..(292): n is a, c, t, g, unknown, or other
  misc_feature (296)..(296): n is a, c, t, g, unknown, or other
  misc_feature (297)..(297): n is a, c, t, g, unknown, or other
  misc_feature (301)..(301): n is a, c, t, g, unknown, or other
  misc_feature (308)..(308): n is a, c, t, g, unknown, or other
  misc_feature (316)..(316): n is a, c, t, g, unknown, or other
  misc_feature (390)..(390): n is a, c, t, g, unknown, or other
  misc_feature (402)..(402): n is a, c, t, g, unknown, or other
  misc_feature (422)..(422): n is a, c, t, g, unknown, or other
  misc_feature (428)..(428): n is a, c, t, g, unknown, or other
  misc_feature (442)..(442): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (690)..(690): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
aaagctggagctccccgcggtggcggccgctctagaactagtggatcccccgggctgcaggaattcgcacgagaccattacctagaacatcctaatcgaaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcngcggcgtgctgctggtcgtancanccacgnccgnngcgnaggacgnagtggtcnaaacggacccgcaggaggaccctgcgtggtgcaaagcagcgtgcgagtggcagtacgaaaaggaccccccgcgnaaaaggaatgcnaaagcgagtgcccggagcgncaccanaaacttgacgcggncgaggacggaacggcgggttggaccctacgtttcccgttcgggaaggggggaggggcggcccatggcctgccccccccagggccacccgggggaaacccaaagggttttgggggggcccccccccggaatgggcccaaattgagaaaaaaaaactcccccaaaaaaaaggggcaaaaaccccaaaaaggggccaccccccccccttttttgtggaaaaaacttcttgtgtaaaaaaaaaannnggggngggggnnnnnnnncccccccaccccccccccccccccaaaaaaagaagaaaaaccc

SEQ ID NO: 16392 - protein, 123 aa, Zea mays
  misc_feature: Ceres CLONE 1380213-F
  misc_feature (17)..(17): Xaa is any aa, unknown, or other
  misc_feature (24)..(24): Xaa is any aa, unknown, or other
  misc_feature (25)..(25): Xaa is any aa, unknown, or other
  misc_feature (27)..(27): Xaa is any aa, unknown, or other
  misc_feature (28)..(28): Xaa is any aa, unknown, or other
  misc_feature (30)..(30): Xaa is any aa, unknown, or other
  misc_feature (32)..(32): Xaa is any aa, unknown, or other
  misc_feature (35)..(35): Xaa is any aa, unknown, or other
  misc_feature (70)..(70): Xaa is any aa, unknown, or other
  misc_feature (72)..(72): Xaa is any aa, unknown, or other
  misc_feature (77)..(77): Xaa is any aa, unknown, or other
MGKGSVGASWWAFLLLXGVLLVVXXTXXAXDXVVXTDPQEDPAWCKAACEWQYEKDPPRKRNAKASARSXTXNLTRXRTERRVGPYVSRSGRGEGRPMACPPQGHPGETQRVLGGPPPGMGPN

SEQ ID NO: 16393 - DNA, 745 bp, Zea mays
  misc_feature: Ceres CLONE 1380214-F
  misc_feature: Encodes the peptide sequence at SEQ ID NO. 16394
  misc_feature (318)..(318): n is a, c, t, g, unknown, or other
  misc_feature (319)..(319): n is a, c, t, g, unknown, or other
  misc_feature (368)..(368): n is a, c, t, g, unknown, or other
  misc_feature (409)..(409): n is a, c, t, g, unknown, or other
  misc_feature (422)..(422): n is a, c, t, g, unknown, or other
  misc_feature (435)..(435): n is a, c, t, g, unknown, or other
  misc_feature (455)..(455): n is a, c, t, g, unknown, or other
  misc_feature (485)..(485): n is a, c, t, g, unknown, or other
aaagctggagctcaccgcggtggcggccgctctagaactagtggatcccccgggctgcaggaattcgcacgagaccattacctagaacatcctaatcgaaaaagggaggccgcccccgtcacccatagccaaagtcacgcgccaccaaactttgttctctcacccagtcgctttcgcgttcagcgcgagccgagcccagccggtgggtcggtcgctgaaggcggagccataaaggcgtcggcgacggcaggatgatgagcggcagatcgggcggcagggacggcgaggcggccggccccgtcatcaggatcagggttnnccacggagccaccttccgcgaggtcgtcgtggcggcgcaggctaccttncgtgagttgaagaagatcctttgtcagactactggcttggnagctgagagcagnagctcttcttccngtggaagggaaagagtgacngaaagtccctcaccgcgcaagtgtaaggantgcgcgaattgcttctgtttaaaaagcttcccttgccaactaaaacaaaagtttggcctgggattatgaatgaaaccgtaaaaagcattggaaggtttttcccccgttaaaactgaatttaaaaggttgccgctagagggggggaattgaaaaaaaaaggttttcggggaaaaaattggggaaaaaaaattgtccctttgcggaactttttttaaaaacgggggggaaaactcggggggcccaaatgtgaaggaaaaaaa

SEQ ID NO: 16394 - protein, 100 aa, Zea mays
  misc_feature: Ceres CLONE 1380214-F
  misc_feature (23)..(23): Xaa is any aa, unknown, or other
  misc_feature (39)..(39): Xaa is any aa, unknown, or other
  misc_feature (53)..(53): Xaa is any aa, unknown, or other
  misc_feature (57)..(57): Xaa is any aa, unknown, or other
  misc_feature (62)..(62): Xaa is any aa, unknown, or other
  misc_feature (78)..(78): Xaa is any aa, unknown, or other
MMSGRSGGRDGEAAGPVIRIRVXHGATFREVVVAAQATXRELKKILCQTTGLXAESXSSSSXGRERVTESPSPRKCKXCANCFCLKSFPCQLKQKFGLGL

SEQ ID NO: 16395 - DNA, 678 bp, Zea mays
  misc_feature: Ceres CLONE 1380217-F
  misc_feature: Translation starting site: 235
  misc_feature: Pfam Name: DUF1637 Pfam Description: Protein of unknown function (DUF1637)
  misc_feature: SWISSPROT Homolog: EC 1.13.11.19 Cysteamine dioxygenase
  misc_feature (148)..(148): n is a, c, t, g, unknown, or other
  misc_feature (629)..(629): n is a, c, t, g, unknown, or other
aaagctggagctccccgcggtggcggccgctctagaactagtggatcccccgggctgcaggaattcgcacgagaccattacctagaacatcctaatcgaaaagtgttttcgcttccccttccccatcccctctcctcccctcgccggnttgtcggtctcgccgcgccactggccatacatccaagacgctaatccgtgtgggggaaaagcccccctctctctgaaactattcaaatggcgtggggcgtatccccgcggcggcagccgtcgttcccggtgcaggccctctacgagctctgcaagcgctccttcccctccccttccgccgcctcatcgtctcccccgcccgctgatgtcgtccgcagcatctcctcgctcatggatacgatcactcctgcggatgttgggctcagagattataatcttgaggacgacagggggcatggattttttgactccaacctcctcagggttcaggaaggcttcctcggtgggcgcgggcccatcagtaccttcatatctacagctgtgatgcattctctattggaatattctgcttttgcacttcatcaggcattcctcttcatgatcatcccggaatgactgtactgagcaaatccttttatggntccatgcatgtgaaatcatatgatgggatagaggctactgtgctagcaa

SEQ ID NO: 16396 - DNA, 746 bp, Zea mays
  misc_feature: Ceres CLONE 1380218-F
  misc_feature: Encodes the peptide sequence at SEQ ID NO. 16397
  misc_feature (1)..(1): n is a, c, t, g, unknown, or other
  misc_feature (637)..(637): n is a, c, t, g, unknown, or other
  misc_feature (705)..(705): n is a, c, t, g, unknown, or other
naaagctggagctccccgcggtggcggccgctctagaactagtggatcccccgggctgcaggaattcgcacgagaccattacctagaacatccaatcgaaaaatttcttctcgtacgcgatcgattgcgagttgcgcccctcgccctcgccccccactcccccagcccctcgcaggcgcaccaccgaaactgctccgcctccacgcccgctcgcactgaccacggcgatggccgccgccgccctccgctcctccgcgcgccggctcctgcgcctcgccccagcagcctcgtcggctctgtccgctggttcccgccccaccgccggggctgcgccgctcacgcgccccatcgccgcgctctcaggtggcaacaatcctatctcatggaaactgagacggttctacagttcaaatgaaaaacacttgcctgcaatatctgatccagaaatagaatctgcatttaaggatttgttggctgctagttggaatgaacttccagattctcttgtagcggaagcaaagaaagcagcatctaaagccaccgatgatagtgctggtcaagaggctttgaaaaatgtatttcgtgcagctgaggcatgtgaagaaattagtggaacttttggtaccctaagaatggnctctgatgatctttgtgggctgactggcggaaaatgtggtccctacctggttatattgaagatgctgntaaagctgcatataatcgctacatgacatatctgggagtcc

SEQ ID NO: 16397 - protein, 167 aa, Zea mays
  misc_feature: Ceres CLONE 1380218-F
  misc_feature (137)..(137): Xaa is any aa, unknown, or other
  misc_feature (160)..(160): Xaa is any aa, unknown, or other
MAAAALRSSARRLLRLAPAASSALSAGSRPTAGAAPLTRPIAALSGGNNPISWKLRRFYSSNEKHLPAISDPEIESAFKDLLAASWNELPDSLVAEAKKAASKATDDSAGQEALKNVFRAAEACEEISGTFGTLRMXSDDLCGLTGGKCGPYLVILKMLXKLHIIAT

SEQ ID NO: 16398 - DNA, 741 bp, Zea mays
  misc_feature: Ceres CLONE 1380219-F
  misc_feature: Translation starting site: 141
  misc_feature: SWISSPROT Homolog: EC 1.16.3.1 Ferroxidase
  misc_feature (534)..(534): n is a, c, t, g, unknown, or other
aagctggagctccccgcggtggcggccgctctagaactagtggatcccccgggctgcaggaattcgcacgagaccattacctagaacatcctaatcgaaaaaaaaaaccctcttctcctctgtccgagattcatacaaaaatgcttctcaaatccgcttctgctttctcgctcgtgaacatccatggaggagtcaacaaggacatctctcctctctcctcctcctcctcctcttcattgagtcttcccgtttcttcgggaaaatcaagaaacctctccttctctgtttctgcctccacgcaaaccctgagcggcgtcgttttcgagccgtttgaggaggtgaagaaggagctcgatctcgtcccttcgagtccacagctctctctcgctcgccatctatactctcccgagtgcgaagccgccgtgaacgaacagatcaatgtggagtacaacgtgtcgtatgtgtatcacgccttgtacgcttacttcgatcgtgacaacgttgctctcaaaggtcttgccaagtttttcaggnactcgagtgtggaagagcgagaccacgctgagatgttgatggatatcagaacaaacgtggtggggagggttagttacagcccatggtgatgcctcagtctgagtttgatcacgctgagaaaggagatgctctctatgccatggagctggctctgtcattggagaagctggtcaatgagaacctcctcaacgtgcacagtgtggctcc

SEQ ID NO: 16399 - DNA, 735 bp, Zea mays
  misc_feature: Ceres CLONE 1380220-F
  misc_feature: Encodes the peptide sequence at SEQ ID NO. 16400
  misc_feature (421)..(421): n is a, c, t, g, unknown, or other
  misc_feature (461)..(461): n is a, c, t, g, unknown, or other
  misc_feature (462)..(462): n is a, c, t, g, unknown, or other
  misc_feature (567)..(567): n is a, c, t, g, unknown, or other
  misc_feature (637)..(637): n is a, c, t, g, unknown, or other
  misc_feature (644)..(644): n is a, c, t, g, unknown, or other
  misc_feature (645)..(645): n is a, c, t, g, unknown, or other
caaagctggagctccccgcggtggcggccgctctagaactagtggatcccccgggctgcaggaattcgcacgagaccattacctagaacatcctaatcgaaaaacgcccacgcctccacggccaagcgcctcgaaggcaaagcttccactagccacaggccaacgaaaccccaaagtcaccggccgggctgtacagcctcccgtccacgccaaccaggccgtccccggtgacggtgaccaccgcctccggcgccaccgtcctcaccgtggaacgcctcaacctcggactcatcggggacgagaagccggtgatggagagggtcgagtccgggagagccctccgcgagaaggtgttcgaacggctcagcaaagaagccaccgtgcccagcgacaccgccgcatccgccaacgttgagggagncggccccgccccggatgttggatgggtctccgacctcatnncactgaggaactcgtggaactaccggctcagaagttcaggggggaataacaaaaaaaagtaggaagatttttaatttttttagtctttacaaatattttcctggntccttgtacagatgtcctgctttgtgatagtcttgaaagggtttgtcgaaggaagggagacaggaatggntgatttnngtatgagttcaaatgatggcatgtccgtgaaggaaaaacctagggaggaaacaagtgccagcaaccagggtggaatggatcaagaaactg

SEQ ID NO: 16400 - protein, 70 aa, Zea mays
  misc_feature: Ceres CLONE 1380220-F
  misc_feature (37)..(37): Xaa is any aa, unknown, or other
  misc_feature (50)..(50): Xaa is any aa, unknown, or other
  misc_feature (51)..(51): Xaa is any aa, unknown, or other
MERVESGRALREKVFERLSKEATVPSDTAASANVEGXGPAPDVGWVSDLXXLRNSWNYRLRSSGGNNKKK

SEQ ID NO: 16401 - DNA, 805 bp, Zea mays
  misc_feature: Ceres CLONE 1380220-R
ttaattttgttatcagcaaaagtagcagtactgacatggtccaaggtacatgcatgcaccccataagcagaagcagtagatcaatatggaaatacattgagaaaaatcacagagcagtaataactcgtcgaatcttaaaaggcaaatagcagaatgaacatcaactcaagacgccgttcgttctggaatcgctcgcggaaattatgagttcggtcttggatcgccgccatgatcgcctcccatgctcccacctcacacagacagggaagacaccatgtgcatctcagcatctagacaacccgtatacatggtcgcctgcacatgtcttcttgatccattttccaccatggtttgctgggcaccttgtctcctccctaggcttcttcccttcaccgacatgccatcatctgaaacctcataacaaatcaaccattccctgtctcccctcccttcgacaaccatccaagactattcacaaagcaggaacatctgtacaaggaccaggaaaatatttgtaaagaactaaaaaattaaaaatcttcctactttttttttgttattcccccctgaacttctgagccggtagttccacgagttccctcagttgatgaggtcggagacccatccaacatccggggcgggggccgctccctcaacgttggcggatgcggcggtgtcgctgggcacggtggcttctttgctgagccgttcgaacaccttctcgcggagggctctcccggactcgaccctctccatcaccggcttctcgtccccgatgagtccgagggtgaggcgttccacggta

SEQ ID NO: 16402 - DNA, 667 bp, Zea mays
  misc_feature: Ceres CLONE 1380224-F
tggagctccccgcggtggcggccgctctagaatagtggatcccccgggctgcaggaattcgcacgagaccattacctagaacatcctaatcgaaaaacccatattattgataccaactagcaacatacatagtgaagtacactagcaacatcttagcaccaatgggagccaagatttttgccatccttgccctccttgctctttcagcaagggttgctaccgcgactattattccacaatgctcacaacaatacctctctccggtgacagccgcgagatttgaatacccaactatacaatcctacagggtacaagagggcatcgcagcaagcatcttacggtcggtagcattgaccgtccaacaaccatgggggggagtggaacaaccatccttaatgaatctatatctcggaggaatcgcaggacaacaactacaacaacagttgcttcccacaatcaatcaagtagttgcagggaaccttggctgttacctcccagaacaacattttcttccattcaatcaactaagttggggggaaccctgcttgttacttgcagggacaacagctactaacattccaaccaacttgccgggagccctggtgcttttttactgagaaacagtggtttccattcatctacaagtggggggaaaaattgcttgttt

SEQ ID NO: 16403 - DNA, 746 bp, Zea mays
  misc_feature: Ceres CLONE 1380227-F
  misc_feature: Translation starting site: 213
  misc_feature (256)..(256): n is a, c, t, g, unknown, or other
  misc_feature (290)..(290): n is a, c, t, g, unknown, or other
  misc_feature (320)..(320): n is a, c, t, g, unknown, or other
  misc_feature (322)..(322): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (493)..(493): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (557)..(557): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (574)..(574): n is a, c, t, g, unknown, or other
  misc_feature (575)..(575): n is a, c, t, g, unknown, or other
  misc_feature (587)..(587): n is a, c, t, g, unknown, or other
  misc_feature (588)..(588): n is a, c, t, g, unknown, or other
  misc_feature (610)..(610): n is a, c, t, g, unknown, or other
  misc_feature (612)..(612): n is a, c, t, g, unknown, or other
  misc_feature (613)..(613): n is a, c, t, g, unknown, or other
  misc_feature (624)..(624): n is a, c, t, g, unknown, or other
  misc_feature (628)..(628): n is a, c, t, g, unknown, or other
  misc_feature (646)..(646): n is a, c, t, g, unknown, or other
  misc_feature (687)..(687): n is a, c, t, g, unknown, or other
  misc_feature (688)..(688): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (728)..(728): n is a, c, t, g, unknown, or other
  misc_feature (729)..(729): n is a, c, t, g, unknown, or other
aaagctggagctccccgcggtggcggccgctctagaactagtggatcccccgggctgcaggaattcgcacgagaccattacctagaacatcctaatcgaaaaatcgaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggncgtcgcgctgacgtttcaggcctgccctcgcggnagggagctcaccgcgctggtgcaggagccngnccatacccatgagtaccacaagggcgcgctccctgtcgggcccccatcgcgtcacttcatctggatacgggacttctcggcggccgcagggggcggggatcaccgaattcgtctcgtccttgagggggggggcccgggccgggggaaaggnnnnnnngcgcgcgnnncggnagaaaaacgccgccccccgcgggggcgccaaaaaggtgggggnnnttgtgctcttcagagaaanaaaagcggggnnnncgnncgcgccccgcgnnagagagtttattcccttttacncnncccgccccgcnccgnaggtgtttccccgtttcnaccaaaaaaagagaaggggggggggggggggcccggccccnnccgcccccccccccnnnntttttttccccccccccccccnngccggcggggggggggg

SEQ ID NO: 16404 - DNA, 705 bp, Zea mays
  misc_feature: Ceres CLONE 1380228-F
  misc_feature: Translation starting site: 188
  misc_feature (270)..(270): n is a, c, t, g, unknown, or other
  misc_feature (391)..(391): n is a, c, t, g, unknown, or other
  misc_feature (520)..(520): n is a, c, t, g, unknown, or other
caaagctggagctccccgcggtggcggccgctctagaactagtggatcccccgggctgcaggaattcgcacgagaccattacctagaacatcctaatcgaaaaacggaagtttcggcggcgccggcgtgctcgtgatctcaacccaaggcgtgcctccgctccggtcacccgtcgctccacgcaaccatgtcgaggaggaagacccaggagcccaaggaggagaacgtcacccttggacccactgtccgtgaaggagagtatgtctttgntgtcgctcacatctttgcatcctttcatgacaccttcattcatatcactgatttgtctgggagggaaactctggttcggatcaccggtggcatgaaggtgaaggctgaccgtgacgagtcntcacttacgctgctatgcttgctgctcaagacgtcgcacagcgctgcaaggagcttggcattactgcactgcacattaagcttcgcgccaccggaggcaacaagaccaagaccccctggactggtgccnagtctgccctcagggcgcttgctcgttccgggatgaaaatcggacgcattggagacgttaccccggtcccactgacagactccaaaaaaaggccggtagggaggggagggagctgtaggcgtctcggctgcgtggatttgccggctcttgccggtggcaatatgagctacccctcctgggggtgg

SEQ ID NO: 16405 - DNA, 768 bp, Zea mays
  misc_feature: Ceres CLONE 1380230-F
  misc_feature: Encodes the peptide sequence at SEQ ID NO. 16406
  misc_feature (274)..(274): n is a, c, t, g, unknown, or other
  misc_feature (277)..(277): n is a, c, t, g, unknown, or other
  misc_feature (283)..(283): n is a, c, t, g, unknown, or other
  misc_feature (767)..(767): n is a, c, t, g, unknown, or other
atagctggagctccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancanccaccnggcgggcggatgacggagtggtcgatcgggaccgcaaggaggacctgcgtggtgcaagcaggcgtgcgagtggcagtacggaaaggacaccccgcggaagagggaatgccagagcgagtgccgctagcggcaccagcaagctgacgccggcgaagacggcgacagcggcgtggacccctacctctcccgctccgggaggggcgaagtgcccgggccagtgcctgcgccgccacgagggccagccgtggggaaacccggaatgcatgaggcggtgccccccgccgggaactggccgtcaacatggaaaaagagtacggtccgcggcaacaaaagcgcggggaaattgcccggaaaaagatgccaacccccaccaccggcggggaactgggggagaaaagaaccccttttccctgatggactgaaaaaaaacccccggagaagcgcgggaaaaaaaaaaaggcctttaacccaacaacctccaccnc

SEQ ID NO: 16406 - protein, 166 aa, Zea mays
  misc_feature: Ceres CLONE 1380230-F
  misc_feature (24)..(24): Xaa is any aa, unknown, or other
  misc_feature (25)..(25): Xaa is any aa, unknown, or other
  misc_feature (27)..(27): Xaa is any aa, unknown, or other
MGKGSVGASWWAFLLLAGVLLVVXXTXRADDGVVDRDRKEDLRGASRRASGSTERTPRGRGNARASAASGTSKLTPAKTATAAWTPTSPAPGGAKCPGQCLRRHEGQPWGNPECMRRCPPPGTGRQHGKRVRSAATKARGNCPEKDANPHHRRGTGGEKNPFSLMD

SEQ ID NO: 16407 - DNA, 736 bp, Zea mays
  misc_feature: Ceres CLONE 1380233-F
  misc_feature: Encodes the peptide sequence at SEQ ID NO. 16408
  misc_feature (319)..(319): n is a, c, t, g, unknown, or other
  misc_feature (377)..(377): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
aaagctggagctccccgcggtggcggccgctctagaactagtggatcccccgggctgcaggaattcgcacgagaccattacctagaacatcctaatcgaaaacccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgcccgcgctgcccacgacgacctgaagggtaccgagctccgccttgntctgccggggtcccgttcgccgaaccgcccgtgtgtgctgcccacgcaccaccctggnactgctccngnntaagggcgcaagcgcgggttttctgaaaggcggccaacccatcgccgggggattttccggaaaggaaaaaagtaccgaaaaagaggacaaaaaaggttgaaggaaccccaaccggtcaaaagttcaggggggggatggccccatcccaagttcccgaaaaaccggtgtcccccccccttttaagggcccaagagggttttgtggcaaaaaaaaacagggttcccttaaaaaagaaaaagtggggggcccccccccccgggagaagtccccaaataaaaaaaaaaaagaggcccccgcgcgcggggaaaaaaaaacccccctccccacaggaaaaagagaaaataaat

SEQ ID NO: 16408 - protein, 55 aa, Zea mays
  misc_feature: Ceres CLONE 1380233-F
  misc_feature (33)..(33): Xaa is any aa, unknown, or other
MSPPLDLDYIGLSPAAAARAAHDDLKGTELRLXLPGSRSPNRPCVLPTHHPGTAP

SEQ ID NO: 16409 - DNA, 732 bp, Zea mays
  misc_feature: Ceres CLONE 1380234-F
  misc_feature: Translation starting site: 169
  misc_feature (292)..(292): n is a, c, t, g, unknown, or other
  misc_feature (296)..(296): n is a, c, t, g, unknown, or other
  misc_feature (358)..(358): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (410)..(410): n is a, c, t, g, unknown, or other
aagctggagctccccgcggtggcggccgctctagaatagtggatcccccgggctgcaggaattcgcacgagaccattacctagaacatcctaatcgaaaaaaaattgaccgccattgtgcaaaccagaaccccttcgccattttcaccaactccctccgatcccggccatggcgggggaggactgccgctccggcgcggaaatggacgcgctcgtacgacgcttgaagctccaccggccgtccccatcccctacgaccccgatccggccgcggcccccgtccccgccaccgncggngtacgcgagctgttcccggcgcggagagctgccgtgcttgtctgcctcttccggggagacgngggcgagctccgcgtcatcctcactaagngnntcgttctcctctccacccantccggtgaagtttcattgccagaagaaaggtcgaaggaggtgatgctgatgatgtaccaacagcgttagagagccaaagaagagattggacttgatccagctcttggaactggggttgcctctcttgaaaattcttggcccaagcattctctgggaagttggtcctggtggttgcaaaactgttaaacagaaaaagcatttaaaccccggccctaaaaatgggtggagggaaaaccaaaaaattttgatggaacccctgggaaatggtccccccagggttggaaaaacagggaacctccggaggggggcgaaaaaaaaaggg

SEQ ID NO: 16410 - DNA, 721 bp, Zea mays
  misc_feature: Ceres CLONE 1380235-F
  misc_feature: Translation starting site: 224
  misc_feature: Pfam Name: PspA_IM30 Pfam Description: PspA/IM30 family
  misc_feature (637)..(637): n is a, c, t, g, unknown, or other
  misc_feature (638)..(638): n is a, c, t, g, unknown, or other
  misc_feature (694)..(694): n is a, c, t, g, unknown, or other
caaagctggagctccccgcgggggcggccgctctagaactagtggatcccccgggttgcaggaattcgcacgagaccattacctagaacatcctaatcgaaaaacacgaactcgccctctcgactctcgagagatagagcgaggcaccaagaaggggaaaaagagggacaggaaaaaaaaatcattctcgtttcgcgctgtccgctagaccccgcccgaatcaatggagattagggctccgccgacgagcctgaggctcgcgccgccgcccgcctccgccagcttccgccgaaccccgcttaggacctccttccttcgcggcacgccgtgtcacttaaagttgtgcaagtacggcagccaaatgtcaacagatttacgtgcaatagcatacgaagtaacctctttgataggctaacaaggcttgtcaggtcctacgcacatgcagttctaagttcgtttgaagaccctgagaagattctagaccagccagttctggagatgaatgatgacttgacaaagatgcggcaggccactgcacaggtcttggcatctcaaaagcggcttgagaataacatctaagctgcagaacaagcttctgctgattgatatcggagggctcaacttgctcttcaaaggnntgacgagaatcttgctcgtgaagccttaaggcgcgtaaatcatatgctgacatgcnagctccttaagatccagctgatcagaa

SEQ ID NO: 16411 - DNA, 742 bp, Zea mays
  misc_feature: Ceres CLONE 1380236-F
  misc_feature: Encodes the peptide sequence at SEQ ID NO. 16412
  misc_feature (334)..(334): n is a, c, t, g, unknown, or other
  misc_feature (438)..(438): n is a, c, t, g, unknown, or other
  misc_feature (474)..(474): n is a, c, t, g, unknown, or other
  misc_feature (523)..(523): n is a, c, t, g, unknown, or other
  misc_feature (562)..(562): n is a, c, t, g, unknown, or other
  misc_feature (587)..(587): n is a, c, t, g, unknown, or other
caaagctggagctccccgcggtggcggccgctctagaactagtggatcccccgggctgcaggaattcgcacgagaccattacctagaacatcctaatcgaaaatcaccgcaaggatccaccacaacagcgaaggagaaagcagaccaacctagccacccagggagaaaagaggccaaaagggaggggagagtgtcgtcatggcttccattgtcgcttccaggagggccgttcctctagttcgcgctctggagaagctcatcgcagcgtcctccgctcccgggactggctccgccctcaggccggtggcagtcgccggcggcctccgcggctacnacaccggcgctccgctccgacgctacgagggggccgagtcggaagacgatagcgtccgcgagtacgatgggcggcacggcggccgggactacgctgtgcccagnctggtctcagatattttccgtgatccgcttagtgcngcgcacagcattggcccgctgctgaaccttgtgacgacttggcggtggncgcgccaggtcgtgcggtgcgccgtgctggaacgcgaanggagacgaggagcgctgcacctganggtgacatgccaggcctggggaaggacacgtcaaggtgggggcgagcaaaacagcctggtgatcaagggccgaggcgaagaagaggatagcgaggacgagcccgccccgctccgaaatacagcggtcgcatcgagcttcggccagaggtttaaga

SEQ ID NO: 16412 - protein, 181 aa, Zea mays
  misc_feature: Ceres CLONE 1380236-F
  misc_feature (46)..(46): Xaa is any aa, unknown, or other
  misc_feature (80)..(80): Xaa is any aa, unknown, or other
  misc_feature (109)..(109): Xaa is any aa, unknown, or other
  misc_feature (122)..(122): Xaa is any aa, unknown, or other
  misc_feature (130)..(130): Xaa is any aa, unknown, or other
MASIVASRRAVPLVRALEKLIAASSAPGTGSALRPVAVAGGLRGYXTGAPLRRYEGAESEDDSVREYDGRHGGRDYAVPXLVSDIFRDPLSAAHSIGPLLNLVTTWRWXRQVVRCAVLEREXRRGALHLXVTCQAWGRTRQGGGEQNSLVIKGRGEEEDSEDEPAPLRNTAVASSFGQRFK

SEQ ID NO: 16413 - DNA, 723 bp, Zea mays
  misc_feature: Ceres CLONE 1380237-F
  misc_feature (458)..(458): n is a, c, t, g, unknown, or other
  misc_feature (681)..(681): n is a, c, t, g, unknown, or other
aaagctggagctcaccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcagggcacaacaactacnacaacttgtgctagcaaaaccttgctgcctactctcagcaacatcagtttcttccattcaaccaactagctgcattgaactctgcttcttatttgcaacaacacaactaccattcagccagctatctgctgcctacccccagcaatttcttccatttcaccactgacagcattgaactctcctgcttatttacagcagcaacaactactaccatttcagcagntagctggtgtgagccctgctaccttctgacacaacacaggtg

SEQ ID NO: 16414 - DNA, 710 bp, Zea mays
  misc_feature: Ceres CLONE 1380238-F
  misc_feature: Translation starting site: 188
  misc_feature (563)..(563): n is a, c, t, g, unknown, or other
  misc_feature (568)..(568): n is a, c, t, g, unknown, or other
  misc_feature (569)..(569): n is a, c, t, g, unknown, or other
  misc_feature (577)..(577): n is a, c, t, g, unknown, or other
  misc_feature (591)..(591): n is a, c, t, g, unknown, or other
  misc_feature (710)..(710): n is a, c, t, g, unknown, or other
atagctggagctccccgcggtggcggccgctctagaactagtggatcccccgggctgcaggaattcgcacgagaccattacctagaacatcctaatcgaaaaagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgcccaccccccatcagtcgtcgtcgacgcgatcatcaacagtgggaccccgtgaggatgccacccgtattggtccngctgnntgtgtgangaagcaagccgtgnatatctcacccctggagagggtgaaccagccatctacctcctcacactggtgccagggagaggctttccggacatcaaaacattgccgaagtgcttgcagagagctgatcacgctgccn

SEQ ID NO: 16415 - DNA, 704 bp, Zea mays
  misc_feature: Ceres CLONE 1380240-F
  misc_feature: Encodes the peptide sequence at SEQ ID NO. 16416
  misc_feature (432)..(432): n is a, c, t, g, unknown, or other
  misc_feature (646)..(646): n is a, c, t, g, unknown, or other
aaagctggagctcaccgcggtggcggccgctctataatagtggatcccccgggctgcaggaattcgcacgagaccattacctagaacatcctaatcgaaaacccattcatcgagtctacgctcttcgtctttctccggtccgaattccccaatcggactctcctcttcttgccggatctccacaccccattccaccccgcccatgggtgcccccacccctcgccgctgacctgtgggtacactgccccctgctcccccgccccgctcccgctcgcccacgcgaaccctaggcagctaggctttgctgctagaagagctccagcgaccgacgaggagaggagaataaagctcaaatcttggatgcgcccgaaccgatggcgacacctgccgcagagaagccggaagatgtagagatccgtgaggtttgggcgnacaacctcgagacagagttcgccgtgatccgcgacatcgtcgacgactatccgtatgtggctatggacactgagtttccgggcggtgtgtgtcgtccgctcggcactaacaagtcggcggccgagttcactacgccactcttaaagctaacgtggacatgctgaaagcttatcagctcgggctcacttggccgaagagcatggtggggctgcgncgctaggccagacggtcgtccctgcgtctggaattccactttcgaggatggaccctcg

SEQ ID NO: 16416 - protein, 73 aa, Zea mays
  misc_feature: Ceres CLONE 1380240-F
  misc_feature: SWISSPROT Homolog: EC 3.1.13.4 Poly(A)-specific ribonuclease
  misc_feature (20)..(20): Xaa is any aa, unknown, or other
MATPAAEKPEDVEIREVWAXNLETEFAVIRDIVDDYPYVAMDTEFPGGVCRPLGTNKSAAEFTTPLLKLTWTC

SEQ ID NO: 16417 - DNA, 689 bp, Zea mays
  misc_feature: Ceres CLONE 1380244-F
  misc_feature: Translation starting site: 202
  misc_feature (376)..(376): n is a, c, t, g, unknown, or other
  misc_feature (447)..(447): n is a, c, t, g, unknown, or other
  misc_feature (449)..(449): n is a, c, t, g, unknown, or other
  misc_feature (505)..(505): n is a, c, t, g, unknown, or other
  misc_feature (520)..(520): n is a, c, t, g, unknown, or other
aaagctggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaagggagctcgctctcacgcgtccgccgacgacctctggatctccatctccggcgacgtgtacgacgtcacgccctggctccccccaccacccgggcggngacctcccgcttctcaccctggcgggggaggacgccaccgacggctttcgcggctaacacccgccctcggngngcccgctcctcgccgttttctcgttggccggctctccgatacgccgtctcccccgngtccgccgttaccgncgcctccttcggggagtatccttggcggggctccttcgaaggcgtcggcccacccccaaggccaggtcgtcctgatgggcgttctcttttaggcggggtttacctcgtcctcgcctgggccagggctgggcgaacctcctcggggggggcccaacgggtccgtgggacc

SEQ ID NO: 16418 - DNA, 617 bp, Zea mays
  misc_feature: Ceres CLONE 1380247-F
  misc_feature: Translation starting site: 160
  misc_feature (617)..(617): n is a, c, t, g, unknown, or other
tggagctccccgcggtggcggccgctctagatctagtggatcccccgggctgcaggaattcgcacgagaccattacctagaacatcctaatcgaaaaattcggctgctctcgaccgatcggcgccacgagtgctttctggctgggagcctgggagcgccatggggaggtcgccgtgctgcgagaaggcgcacaccaacaagggcgcttggaccaaggaggaggacgagcggctggtggcgtacgtccgggcgcacggcgaggggtgctggcgctcgctgcccaaggcggcggggctgctgcgctgcggcaagagctgcaggctgcgctggatgaactacctccgcccggacctcaagcgcggcaacttcaccgacgacgaggacgagctcatcatccgcctgcacagcctcctgggcaacaagtgagtggtccctcatcgccgggcagctgcctggccggacggacaacgagatcaagaactactggaacacgcacatcaagcgcaagctcctcgcccgcggcatcgacccgaagacgcaccgcccgctcggcgccggcgccgacgccgccgcgccaacccggagtgttcgcgcaccgggcgctgctgcaccgcgcn

SEQ ID NO: 16419 - DNA, 619 bp, Zea mays
  misc_feature: Ceres CLONE 1380249-F
  misc_feature: Encodes the peptide sequence at SEQ ID NO. 16420
aaagctggagctccccgcggtggcggccgctctataactagtggatcccccgggctgcaggaattcgcacgagaccattacctagaacatcctaatcgaaaactctaagccaccaaacacttgctatgcccgctcctccccgcgcactgctcagcacgccgtgccagtgagaccatggacgcgagcgcggccaccgccaggcgcaagcgcaagcgccccgacgccgacatcaccggcgacgccgcctccgccgccgccgctgccgctgccgccgccccgggcgccgtcgacgaggcctctaacgccgaggtcgaggagttctacgccatcctgcggcgcatccgcgaactcatcccgccggctcgtgcgtgacgtcgcccggtcccccccgcggacgataggaggccggagccgacaccaacccgtgaggacatgtcgtaccgccgagcactggcgcatcgacgccggatacccctaaccccgctgaggaatagtcccagcggccgcgaccctactgacctgtagcgtgcgtttgcactaccgcgactatatgaaaagactcatgggagctagaatgctagcaaagctacggagaatcctcgatggctcgatactggca

SEQ ID NO: 16420 - protein, 65 aa, Zea mays
  misc_feature: Ceres CLONE 1380249-F
MDASAATARRKRKRPDADITGDAASAAAAAAAAAPGAVDEASNAEVEEFYAILRRIRELIPPARA

SEQ ID NO: 16421 - DNA, 626 bp, Zea mays
  misc_feature: Ceres CLONE 1380255-F
  misc_feature: Encodes the peptide sequence at SEQ ID NO. 16422
aagctggagctccccgcggtggcggccgctctagaactagtggatcccccgggctgcaggaattcgcacgagaccattacctagaacatcctaatcgaaaaagaccaccactgcgccattggccagctagagccaaccagaagagcttgcagttactgagagtgtgtgtgagagagaggatgggtggcagcggcagggctgctctgctgctggccctggtggtggtggccgtgagcctggccgtggagatccaggccgacgccgggtacggttacggcggcgggtacaccccgacgccgacgccggccaccccgaccccgaagcccgagaagccccccaccaaggggccgaagccggacaagccgcccaaggagcacgggcccaagccggagaagccgcccaaggagcacaagccgacgccgcccacgtacaccccgagccccaaacccacgccgccgacgtacactcccaccccgacgccccccaagccgacgccacccacatacactcccgcccctacgccccacaaacccacaccaaaacccactcccactcctccgacgtacaccccgacccccaagcctccgacacctaagccgaccccgccgacgtacactccaagcccc

SEQ ID NO: 16422 - protein, 149 aa, Zea mays
  misc_feature: Ceres CLONE 1380255-F
MGGSGRAALLLALVVVAVSLAVEIQADAGYGYGGGYTPTPTPATPTPKPEKPPTKGPKPDKPPKEHGPKPEKPPKEHKPTPPTYTPSPKPTPPTYTPTPTPPKPTPPTYTPAPTPHKPTPKPTPTPPTYTPTPKPPTPKPTPPTYTPSP

SEQ ID NO: 16423 - DNA, 605 bp, Zea mays
  misc_feature: Ceres CLONE 1380260-F
  misc_feature (165)..(165): n is a, c, t, g, unknown, or other
  misc_feature (191)..(191): n is a, c, t, g, unknown, or other
  misc_feature (192)..(192): n is a, c, t, g, unknown, or other
  misc_feature (212)..(212): n is a, c, t, g, unknown, or other
  misc_feature (213)..(213): n is a, c, t, g, unknown, or other
  misc_feature (278)..(278): n is a, c, t, g, unknown, or other
  misc_feature (330)..(330): n is a, c, t, g, unknown, or other
aagctggagctccccgcggtggcggccgctctagaactagtggatcccccgggctgcaggaattcgcacgagaccattacctagaacatcctaatcgaaaaaattccattctcggaagagatcatttccttcctcctgatctctcacggatcttctcgtcatgtnggacgcccgctctccgagccccgtgnncgaacgcccctcgattcccnncgctgatgggagtggcctccgcccaaggaagccggtccttatgggagcggctccgtcgaacctcnttccaaggacgggggcaggcttccggccccttgtttcaaacgaaaccctaangagaccttggtggttgttaaggaaagaaacctcgaaaaaccgggaaagaaaccccccggaaaaaggaaaacccccgccggggttggggcccccacctttttgtaacaccggcttaaaaaaccccccggggggggggggcccttcctcctcccccaccaaaaaaggaaaaaagcggggcccccaccttggttccccccaaaaaaaacccccggggggggaaaaaaaaaaggggggggagcaccccccccccccccaggggtcgttcgcccacccgg

SEQ ID NO: 16424 - DNA, 608 bp, Zea mays
  misc_feature: Ceres CLONE 1380286-F
  misc_feature: Encodes the peptide sequence at SEQ ID NO. 16425
aagctggagctccccgcggtggcggccgctctagaactagtggatcccccgggctgcaggaattcgcacgagaccattacctagaacatcctaatcgaaaaaacgttacttccaggatgggcccagcgcagcagcctcttcttccccgatcccgactccaattctccctctctccttcgcctggcacatcctcggcggcgcggcagcatgcttcttcaccggggtggctgctccttcaccggcgtggcggtctgcttcttcgacgacgcggaggcctgcggcggacgcgacgcggaggcctgcggcggacgcgacgcggcggcctaccgggcggacagatccgcggacgaacggatctccagcgcctggcagatcttcggacgcggcgcggcggcctacctggcggacgaacggatctccggcgtcacggcttgcttcttcaccggtgccgcggcctgattcttcgacgacacggtggtctgccggtcttctccaggcgggtggatctccagcgctcctcgagctggagcaggcaggcgtaccggtcttctccgacgcatcttcggcgtctctagagctggagcaggctctacgctccgatgtactcc

SEQ ID NO: 16425 - protein, 83 aa, Zea mays
  misc_feature: Ceres CLONE 1380286-F
MLLHRGGCSFTGVAVCFFDDAEACGGRDAEACGGRDAAAYRADRSADERISSAWQIFGRGAAAYLADERISGVTACFFTGAAA

SEQ ID NO: 16426 - DNA, 600 bp, Zea mays
  misc_feature: Ceres CLONE 1380294-F
  misc_feature (193)..(193): n is a, c, t, g, unknown, or other
  misc_feature (250)..(250): n is a, c, t, g, unknown, or other
  misc_feature (286)..(286): n is a, c, t, g, unknown, or other
  misc_feature (291)..(291): n is a, c, t, g, unknown, or other
  misc_feature (386)..(386): n is a, c, t, g, unknown, or other
  misc_feature (387)..(387): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (412)..(412): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggntcggtggcggacgacgacacatggggaagggtagtgtgggtgcatcatggtgggcgntcctcctgctcgcccgcgtgctgctggtctaacaancacgncccgggcgaggaaacgaatggtccaacgggacgccagggagacctggggtgtgcaaagaagcgtgcgaatgggaatacggaagggacacccccgnnaaaggaagggnnnaagagggccccnaaacggaaccaaaaactgaccggggcaaggacgcgaaaacgggctgggaaacctaagctctcttcggaaagggggaaaagggagccnnnccatgggctgcccccccccccaaggccaccccggggggaaccaccaggggctttaaggggggggccccccccccgcgaaatggtccccccacatagaga

SEQ ID NO: 16427 - DNA, 624 bp, Zea mays
  misc_feature: Ceres CLONE 1380297-F
  misc_feature: Encodes the peptide sequence at SEQ ID NO. 16428
  misc_feature (236)..(236): n is a, c, t, g, unknown, or other
  misc_feature (240)..(240): n is a, c, t, g, unknown, or other
  misc_feature (253)..(253): n is a, c, t, g, unknown, or other
  misc_feature (269)..(269): n is a, c, t, g, unknown, or other
  misc_feature (538)..(538): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaatgattagaagtcgcccggccgcccgcgcgctgccgagatccatcagctcttatcctcaacatccttccagcttcctggagcagtgccgcctttcatataaaccttatatgggttcttgggtgcgcaccatcacnacgnccttcaggaaagnctgcaccatcttcggnccacaccaggacggcggcgggcagaagcagacgcagcagcggcaaactcagcaacggtggtgcagcacgtcgacggcgagaagggcaagctccacggggagagtgatggcgtgcgcctaacgacgacgtgagaggcatgtgggtccatgctcaccagggcagggatcccgggatctctatggccaggtcgcgaccctaaatttgcggagtctagatttcccctagagaccgcgaaaatgggactaagaacctagccaaatatcccctcncnncnnctctcccccccctccctccnccccccccccccacaaaatttaaaagggttccaaaacttgactcgcgtccgcgtttttct

SEQ ID NO: 16428 - protein, 59 aa, Zea mays
  misc_feature: Ceres CLONE 1380297-F
  misc_feature (11)..(11): Xaa is any aa, unknown, or other
  misc_feature (15)..(15): Xaa is any aa, unknown, or other
MGSWVRTITTXFRKXCTIFGPHQDGGGQKQTQQRQTQQRWCSTSTARRASSTGRVMACA

SEQ ID NO: 16429 - DNA, 636 bp, Zea mays
  misc_feature: Ceres CLONE 1380309-F
  misc_feature: Encodes the peptide sequence at SEQ ID NO. 16430
  misc_feature (382)..(382): n is a, c, t, g, unknown, or other
tggagctccccgcggtggcggccgctctagaactagtggatcccccgggctgcaggaattcgcacgagaccattacctagaacatcctaatcgaaaaaagatccaccaccccaccaaccaactactctcacagtctcacctcccgctcctgccccctccctctcgttctcttcctaaatggcggccgagtccgccaggccgccctcgccgccgcgcgactccggctgccccgcgggcgcgggagactccaccagctcccagctgaccgcgacctacctcggcgtcagcttcgcgctcttcctcgccacgctcccgtcgggcaccgcggcgcgccacgtggcctcgctccagtcgcggggccgcctcctcgcctcgcgcctgntgaccgccgaggacaagctgcggcagctgcgcgcgcgccgccgcgaggactccccgcccaactccccgggccgcctagatcttcccgggcccccggacccagcttaattgaagacaaacgcccccttgaaaccccaaccctcccccgccctgggacttagccgcattccctctgaccaacaatggggcgactccagctcattaaaaaaattagggtcctggccccgcccccaactgatccccttgaacgaggca

SEQ ID NO: 16430 - protein, 103 aa, Zea mays
  misc_feature: Ceres CLONE 1380309-F
  misc_feature (69)..(69): Xaa is any aa, unknown, or other
MAAESARPPSPPRDSGCPAGAGDSTSSQLTATYLGVSFALFLATLPSGTAARHVASLQSRGRLLASRLXTAEDKLRQLRARRREDSPPNSPGRLDLPGPPDPA

SEQ ID NO: 16431 - DNA, 632 bp, Zea mays
  misc_feature: Ceres CLONE 1380310-F
  misc_feature: Encodes the peptide sequence at SEQ ID NO. 16432
  misc_feature (452)..(452): n is a, c, t, g, unknown, or other
  misc_feature (530)..(530): n is a, c, t, g, unknown, or other
aagctggagctccccgcggtggcggccgctctagaactagtggatcccccgggctgcaggaattcgcacgagaccattacctagaacatcctaataaaaatcgcgggctcacatagcaccgcacagctgaggtgcagtttctactagcagcaatatcatggattctgaggtagtgcatgtggtagagtcgtcgtttgtagtgccgagcgagccgacaccgtcggaggggctctcgctctctccgctggacctcgttctgcccagcagaggccacaccccaacagtctacctgtacagccccagcgatgttgccgccgccgatggtttcttcgacgtggccaggctcaaggaggctatggccaagaccttggtggccttctaccccctcgctggccgcctcggcgtcaacaacgatggaaggggtagagatcacctgcaccggcgagggcgcncttctttgtggtcgctcatgctgaccctcagtgttggtgacatcgaggacgacttcaggccgtcgccggagcttgagnaaggctggtttgttccatgcattgagccagcatccatcatattggccatacaggtgactttcctcaaggtccggaggtgtggtgctaagggacggctctcct

SEQ ID NO: 16432 - protein, 158 aa, Zea mays
  misc_feature: Ceres CLONE 1380310-F
  misc_feature (99)..(99): Xaa is any aa, unknown, or other
  misc_feature (125)..(125): Xaa is any aa, unknown, or other
MDSEVVHVVESSFVVPSEPTPSEGLSLSPLDLVLPSRGHTPTVYLYSPSDVAAADGFFDVARLKEAMAKTLVAFYPLAGRLGVNNDGRGRDHLHRRGRXSLWSLMLTLSVGDIEDDFRPSPELEXGWFVPCIEPASIILAIQVTFLKVRRCGAKGRLS

SEQ ID NO: 16433 - DNA, 591 bp, Zea mays
  misc_feature: Ceres CLONE 1380336-F
  misc_feature (229)..(229): n is a, c, t, g, unknown, or other
  misc_feature (235)..(235): n is a, c, t, g, unknown, or other
  misc_feature (266)..(266): n is a, c, t, g, unknown, or other
  misc_feature (362)..(362): n is a, c, t, g, unknown, or other
aaagctggagctccccgcggtggcggccgctctagaactagtggatcccccgggctgcaggaattcgcacgagaccattacctagaacatcctaatcgaaaactccaccagtccaccatcgccacctacgcccaaccaaacccaactccatctcttccgactataaacgcaacccaccaccgctggcgcgaacctctgcgctccgataccccagacccccgatctcccnatgggncacgcatttcgctgcgcgctgcggcccgggncacgctcccgcggcgcttccgaatcaactcgcggggagggtcgtgcccgtggctctgcactgggcggacccggaaagctggtggcgcgtgcaccantaacgcaaaggcgatggacatcgagccgtccgagggcatgagggcttggtggttgaagtcttcgggaggcctgatgggaaaattggaattaatccaacgggggggattgggggaaaaagttgcctttaaggggggtcttacaggggaaaaaaggtttgggtgtaaacttgggaaacccctgaggtttgggacccccttggggggaaaacggtatggggtgggggggggg

SEQ ID NO: 16434 - DNA, 645 bp, Zea mays
  misc_feature: Ceres CLONE 1380349-F
  misc_feature: Encodes the peptide sequence at SEQ ID NO. 16435
aagctggagctccccgcggtggcggccgctctagaactagtggatcccccgggctgcaggaattcgcacgagaccattacctagaacatcctaatcgaaaatacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaagggagatgcagccaacaacttcgctcgtggtcactacaccattggcaaggagattggtgacctgtgcctttgacgcatcaggaagcttgcagataattgcactggtctccaggcttcctcgtcttcaacgt

SEQ ID NO: 16435 - protein, 119 aa, Zea mays
  misc_feature: Ceres CLONE 1380349-F
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKGDAANNFARGHYTIGKEIGDLCL

SEQ ID NO: 16436 - DNA, 634 bp, Zea mays
  misc_feature: Ceres CLONE 1380350-F
  misc_feature: Encodes the peptide sequence at SEQ ID NO. 16437
  misc_feature (306)..(306): n is a, c, t, g, unknown, or other
  misc_feature (375)..(375): n is a, c, t, g, unknown, or other
  misc_feature (491)..(491): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcnggctgtacccctacgcggagtacctgaggcagccgcagtgcagcccgctggcggcggcgccctactacngccggtgtgggcagccgagcgccatgttccagccgctcccggcacagtgctgccagcagcagatgaggatgatggacgtgcagtccgtcgcgcagcagctgcagatgatgatgcanctttgagcgtgccgctgcccgcagcagcagcctgtacgagccagctctgatgcagcagcagcagcagctgctggcagcccagggtctcacccatggcccatgattgatgccgcaaacatgcccggccagtggntggactctac

SEQ ID NO: 16437 - protein, 110 aa, Zea mays
  misc_feature: Ceres CLONE 1380350-F
  misc_feature (48)..(48): Xaa is any aa, unknown, or other
  misc_feature (71)..(71): Xaa is any aa, unknown, or other
  misc_feature (109)..(109): Xaa is any aa, unknown, or other
MKMVIVLVVCLALSAASASAMQMPCPCAGLQGLYGAGAGLTTMMGAGXLYPYAEYLRQPQCSPLAAAPYYXRCGQPSAMFQPLPAQCCQQQMRMMDVQSVAQQLQMMMXL

SEQ ID NO: 16438 - DNA, 583 bp, Zea mays
  misc_feature: Ceres CLONE 1380360-F
  misc_feature (219)..(219): n is a, c, t, g, unknown, or other
  misc_feature (220)..(220): n is a, c, t, g, unknown, or other
  misc_feature (258)..(258): n is a, c, t, g, unknown, or other
  misc_feature (283)..(283): n is a, c, t, g, unknown, or other
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaaatcatcctctccgtgtaggccgcgggattccgtgtccctctccaatccggcgtagccatcgtcgccggatacaggatccggtccccgcgatggagccctcaccaacctcctcctcgnncggtgtggcgcgccggttgtcgccggaggtaaggaggntgcgaagcgggcgctgaaggagttngtgaagcaggtccagcgggctgttgaaatgctgcgcgatgccaacgtgatctcgccatctctctctcggagagaccgcaacaccctcgccggggggcggaggaaccgcaaggaaccaatgtttggggggcccccaagggaaaaaaaaggtttgggggnaacaccccccgctggggggggggactccctttaaaaaaaaaaaaacaaaaaggggggggcctcttttataaaaaaaaggggggggggccccccggggcttttcttaaaaaaggagggggggtgtttaaaaaaaaaagaaaaa

SEQ ID NO: 16439 - DNA, 666 bp, Zea mays
  misc_feature: Ceres CLONE 1380364-F
  misc_feature: Encodes the peptide sequence at SEQ ID NO. 16440
  misc_feature (447)..(447): n is a, c, t, g, unknown, or other
  misc_feature (455)..(455): n is a, c, t, g, unknown, or other
  misc_feature (504)..(504): n is a, c, t, g, unknown, or other
  misc_feature (600)..(600): n is a, c, t, g, unknown, or other
aagctggagctccccgcggtggcggccgctctagaactagtggatcccccgggctgcaggaattcgcacgagaccattacctagaacatcctaatcgaaaaaacatcacaaggctaacctgcatcgccgccgtgcgcgccagcgctgcccagcccgcgcagatggaacgcaggcaggaggcgaaggttgtgaagctgcgggcggtggaggccacgcccgagtccttcgcttcgttcgggcaggtcatcggcgcctcccccgacggcgacgagttcggcccccacgacgcccagctcgatctcagccgcggcatcccaaggttctacatcatgcggttgcagaaccggccgctgaaattctctaccatcacccaccacgccagcgtgacccagtgcctgggctccgtcggcggccaggactgggtacctcggggtggccaagccgtcnatcgtggnatggggcgtccgagagagtgggcccgaagggggaaggaaggtcttgcgntctgccgcagggcactattacctgcctctgtccccagcgaggggctgggggggtttcccggggtttcctgccccccaagtttctcaagctgaaacnaggggactttgcatgccccgggccttgggttcagggggggacccccccgttgattttctataaatc

SEQ ID NO: 16440 - protein, 144 aa, Zea mays
  misc_feature: Ceres CLONE 1380364-F
  misc_feature (96)..(96): Xaa is any aa, unknown, or other
  misc_feature (115)..(115): Xaa is any aa, unknown, or other
MERRQEAKVVKLRAVEATPESFASFGQVIGASPDGDEFGPHDAQLDLSRGIPRFYIMRLQNRPLKFSTITHHASVTQCLGSVGGQDWVPRGGQAVXRGMGRPREWARRGKEGLAXCRRALLPASVPSEGLGGFPGVSCPPSFSS

SEQ ID NO: 16441 - DNA, 651 bp, Zea mays
  misc_feature: Ceres CLONE 1380367-F
  misc_feature: Translation starting site: 207
  misc_feature: SWISSPROT Homolog: EC 2.5.1.6 Methionine adenosyltransferase
  misc_feature (433)..(433): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (572)..(572): n is a, c, t, g, unknown, or other
  misc_feature (644)..(644): n is a, c, t, g, unknown, or other
  misc_feature (645)..(645): n is a, c, t, g, unknown, or other
aaagctggagctccccgcggtggcggccgctctagaactagtggatcccccgggctgcaggaattcgcacgagaccattacctagaacatcctaatcgaaaacgtgccacacatccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaaatgggtgatggtgttcggcgagatcaccaccaaggcgagcgtggactacgagaagatcgtgcgcgacacctgccngcgagatcgggttcacctcccgacgacgtggggctcgacgccgaccgctggcaagggtgctggtgaacatcgagcagcagtcccccgacatcggcgcaggggcgtgcacgggcacttcacgagcgnnnccccgaggagnatcggcgccggcgacagggccacacctgtgtttcgggtaccgccaccgacgagaacccccgagtttgatgcnngctgaa

SEQ ID NO: 16442 - DNA, 585 bp, Zea mays
  misc_feature: Ceres CLONE 1380371-F
  misc_feature (228)..(228): n is a, c, t, g, unknown, or other
aagctggagctccccgcggtggcggccgctctagaactagtggatcccccgggctgcaggaattcgcacgagaccattacctagaacatcctaatcgaaaaatcacacagcgccaccgcgtggttcgttaggataggaaatcgattcgcccgcatcggatctcttcggtgctagagaaatataggccgccgacttctcatcattctgagaaaggtgggcggtttaggntggcagatctcttgactcacgacacgatcagcataattcctcgagggaccctggttggctggagagggtcggtgcctcgggggatctttgaaaatggaagggctaatgggaacccaggctgggtaaaaaagtgtaggaataactctcttctccctgatggaccgaaatcccctttggtacagcctcgggggtatccgggctgggggcggattaaaggaaggtttcgctggttttatcggaatggggcgagggaggcatcctgggatttctggtggccatccccctcctaagagggggataaaccccacgggttttgtttttttgggtcccccaaaaccccccccgctaaatggtttt

SEQ ID NO: 16443 - DNA, 637 bp, Zea mays
  misc_feature: Ceres CLONE 1380372-F
  misc_feature: Encodes the peptide sequence at SEQ ID NO. 16444
aaagctggagctccccgcggtggcggccgctctatacactagtggatcccccgggctgcaggaattcgcacgagaccatacctagaacatcctaatcgaaaaaacgcccccatccgtttcttcctccttgccaggacaggagtctcaactctcaagtctcaaccacgtggagagtggagtagtggaccgaccatggccaccgccgccgacatccgcgtctccatcggctaccagacccgcttcgggctccgcctcgccgccgcgctctcctccccacccccatcccccggcagcaactccgccttctccccgctctccctccacgtcgcgctcagcctcctcgccgccggcgcgggtggagccacgcgcgaccagctcgccgccgtcctcggatgcgacgcgcccgccgggaccgacggcctgcacgcgctcgccgagcaggtcttgctatgtcagctcgccgacggatacgagcatcggcgtcccgtcatgcaggatttacacatgtcgaatgcaaaaaaactcgactgtttctcaagcaatgcttggatgaattcgactagcgaaagaaggagcctgaaaccgctgagaagatgctttgaagtacaatctggatctggaagagatcgtacacctg

SEQ ID NO: 16444 - protein, 148 aa, Zea mays
  misc_feature: Ceres CLONE 1380372-F
MATAADIRVSIGYQTRFGLRLAAALSSPPPSPGSNSAFSPLSLHVALSLLAAGAGGATRDQLAAVLGCDAPAGTDGLHALAEQVLLCQLADGYEHRRPVMQDLHMSNAKKLDCFSSNAWMNSTSERRSLKPLRRCFEVQSGSGRDRTP

SEQ ID NO: 16445 - DNA, 572 bp, Zea mays
  misc_feature: Ceres CLONE 1380380-F
  misc_feature (450)..(450): n is a, c, t, g, unknown, or other
  misc_feature (451)..(451): n is a, c, t, g, unknown, or other
  misc_feature (490)..(490): n is a, c, t, g, unknown, or other
aagctggagctcaccgcggtggcggccgctctagaactagtggatcccccgggctgcaggaattcgcacgagaccattacctagaacatcctaatcgaaaaatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacaggcaatcgcagcaggcatcttacctttatcacccttgttcctccaacaaccgtcagccctattacagcagttacctttggtgcatttgttggcacaaaacatcaaggcacaacaactacnnacacttgtgctaagaaaaccttgctgcctactctcaggnaacagcagtttcctccattcaaaccaaatggttgaatggaaactctggctgccttatttggaaccaacaaattaaccattca

SEQ ID NO: 16446 - DNA, 628 bp, Zea mays
  misc_feature: Ceres CLONE 1380390-F
  misc_feature: Encodes the peptide sequence at SEQ ID NO. 16447
  misc_feature (355)..(355): n is a, c, t, g, unknown, or other
  misc_feature (356)..(356): n is a, c, t, g, unknown, or other
  misc_feature (388)..(388): n is a, c, t, g, unknown, or other
  misc_feature (479)..(479): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaattctggagggccaccgtacgcagagagaccagccagcaggcggcgatgttcgcgacggcggtgcggtgggcggccaagaagggcaagcccagatggctgcgatcgagctgacggcgccgccggacatgatgactccatcgcgcgcgccatcttcgacgccgtcagagagcacggcccgctcaccgtatacgacgtctggtaccacgtcaaggatgtcaggcttcgaggtctgcaagctagtagcagatgaannatctgctgcgttgaatgacggagcgctgaagntaaagctcatctgctgacacgacggtctgcacaagcagttcctctacactagctgatttaccacccccaggagacgcgcgcagagtcccantctcgagtccattgtcaaggggataggctccccaccttcccttcccttcgaagnactgtgacgaggtattgtttcttgctcccggcactgtttctgtgccccgacataatgttcgaatcccaccaaagctagatttgctcaggcgattt

SEQ ID NO: 16447 - protein, 29 aa, Zea mays
  misc_feature: Ceres CLONE 1380390-F
  misc_feature (14)..(14): Xaa is any aa, unknown, or other
  misc_feature (25)..(25): Xaa is any aa, unknown, or other
MSGFEVCKLVADEXSAALNDGALKXKLIC

SEQ ID NO: 16448 - DNA, 617 bp, Zea mays
  misc_feature: Ceres CLONE 1380391-F
  misc_feature: Encodes the peptide sequence at SEQ ID NO. 16449
  misc_feature (364)..(364): n is a, c, t, g, unknown, or other
  misc_feature (435)..(435): n is a, c, t, g, unknown, or other
  misc_feature (441)..(441): n is a, c, t, g, unknown, or other
  misc_feature (476)..(476): n is a, c, t, g, unknown, or other
  misc_feature (477)..(477): n is a, c, t, g, unknown, or other
  misc_feature (549)..(549): n is a, c, t, g, unknown, or other
aaagctggagctccccgcggtggcggccgctctagaactagtggatcccccgggctgcaggaattcgcacgagaccattacctagaacatcctaatcttttcggaggaggcggaccaggtaagcagcagcaggaaccctagcaccgccgcatccgcagccatgggtatcgacctcgttgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtncagttcatggaaggaaaggagaagaacattgctgtgattgttggcacagtcacagatgacaagaggatccnagaggntccagcatgagggtactggccccctgagtcacganngacgcagggccaggatgtcatgctggggggggagtggctcacattgacagcttgctctccgggtcacttgcngagaccagtccctcttggagggcccaaaaatgcccctggaggggggaaagcactcggaagggttccgg

SEQ ID NO: 16449 - protein, 96 aa, Zea mays
  misc_feature: Ceres CLONE 1380391-F
  misc_feature (12)..(96): Pfam Name: Ribosomal_L18e Pfam Description: Eukaryotic ribosomal protein L18
  misc_feature (92)..(92): Xaa is any aa, unknown, or other
  misc_feature (94)..(94): Xaa is any aa, unknown, or other
MGIDLVAGGRNKKTKRTAPKSDDVYLKLLVKLYRFLVRRTKSNFNAVILKRLFMSKTNRPPISMRRLVQFMEGKEKNIAVIVGTVTDDKRIXEXPA

SEQ ID NO: 16450 - DNA, 656 bp, Zea mays
  misc_feature: Ceres CLONE 1380393-F
  misc_feature: Translation starting site: 314
  misc_feature: SWISSPROT Homolog: EC 1.1.1.1 Alcohol dehydrogenase
  misc_feature (433)..(433): n is a, c, t, g, unknown, or other
atagctggagctcaccgcggtggcggccgctctagttctagtggatcccccgggctgcaggaattcccacgagaccattacctagaacatcctaatcgaaaactgaattcttttctactatagctagagccaggcagtcagtcaacgcctagcggggtaggttgactcttctgtctacagcacctacctcttcacatcaactgccgcccctgctccgagaaccagaatggccgccgccgatgcatcttcgttgcctccgtccgccatcacctgccgagtgccgatggcgtggtgaccggaccagccactggtgatggaggaggtggatgtcgccccggcggctcccatggagatccgtgtcaaggtcgtctccacctccgtctggcgcagcgacgtcactgcctggcaatccaagctgagagcctgagacaancgatctctctgatcgaatttgctcatctgtgatctctttcgattccaacatgcatgagcaacttgatctgttccccagagttctacgccacgaggcatccggagtagaatagagtggtcgtgaagggggtgaccgagctcaaagtcggtggacaccgttctcactggccttcatgggggatgcgaaaagctgccaaccctgcctctcaaaggagaaacaactt

SEQ ID NO: 16451 - DNA, 641 bp, Zea mays
  misc_feature: Ceres CLONE 1380404-F
  misc_feature: Encodes the peptide sequence at SEQ ID NO. 16452
aagctggagctccccgcggtggcggccgctctagatctagtggatcccccgggctgcaggaattcgcacgagaccattacctagaacatcctaatcgaaaacctaccagtacgcgctgaatcgggcgtccctcgccctcgtcgcgagaagggagtcgagcctccggcacgtcgccgaccgagcactcgagctcggcgcgcgcgacgtcgtcgtcctcccaggcgacgtctccacccccgacgactgcgacaggttcgttcggaccgcgatcagtcactacgaccgattggaccatctcgtgtgcaatgctggcgtcgcgagcgtcggcgcgttcgaggagatcccggacgtcaccagctacagctcccagcttaggagccgaggaagaatcgtggtgacggcatctgcgaccggatggaacccagttcctagaatgagcatctacaacgctgccaacgctgcgctcatcaacttcttcgagacgctgcggaccgagctagggaaccaggtcgggatcacggtgatgacgcccgggtgggtggagtccgagatgtccagaggggagttcctcaaggagcacggccaagtggaggtcgatcaagagatgcgcgacgctcagatcggcctgttcccggtggagt

SEQ ID NO: 16452 - protein, 69 aa, Zea mays
  misc_feature: Ceres CLONE 1380404-F
MSIYNAANAALINFFETLRTELGNQVGITVMTPGWVESEMSRGEFLKEHGQVEVDQEMRDAQIGLFPVE

SEQ ID NO: 16453 - DNA, 649 bp, Zea mays
  misc_feature: Ceres CLONE 1380409-F
  misc_feature (378)..(378): n is a, c, t, g, unknown, or other
  misc_feature (503)..(503): n is a, c, t, g, unknown, or other
  misc_feature (529)..(529): n is a, c, t, g, unknown, or other
  misc_feature (537)..(537): n is a, c, t, g, unknown, or other
  misc_feature (574)..(574): n is a, c, t, g, unknown, or other
  misc_feature (591)..(591): n is a, c, t, g, unknown, or other
cgctctgtactagtggatcccccgggctgcaggaattcccacgagaccattacctagaacatcctaatcgaaaaaagaaccgatctccctttttctccccaatcctcctggtctcctcgcctccacctactaaatcagcaccacccaaggcgaatcctagcaacggccgcgcaatggtgccctctgatgatgaaatgcaggcccccggacacgcagcgggcggcggctacttgcgcatgatctcctcgaaggacctccgctctcacgcgtccgcccacgacctccggatctccatctccgaggacgtaggaccgaggtcccggcccggcgacccctatttttttttttcgccccccaccccccttctcgcccctgggngcacccagtacgtccaccgactgcttccgaccccgaccaccagaacctcgaagaggccgggtccttttggagggaccctccttggggcggccgcgccaaagagcggcctcctaccccccaggtcngaacaagcaaccgaacggcaaccccntgcgcggngggatacatccagaggaatcccctttggacctctggncaaaacacacacccccncaggtccaagaaataagaagtgggaaagccccgaaacgactttacttacgggagagtt

SEQ ID NO: 16454 - DNA, 647 bp, Zea mays
  misc_feature: Ceres CLONE 1380422-F
  misc_feature: Encodes the peptide sequence at SEQ ID NO. 16455
  misc_feature (617)..(617): n is a, c, t, g, unknown, or other
aaagctggagctccccgcggtggcggccgctctagatctagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaacaagacatggaaaatcgatactggaaacaggacatttgagatagaattggcgatgttgtcaagtgctcaccatgtggagatgacccccagtgatgctggctttcaggacaggtatggtgttcagggagtcatcaaagagatggcgaagaaccaggccattgatggccaaagcaagagagcatttaaagttctttgtgttaatggagtcgancagctctcacgagaagccaagcatcccctc

SEQ ID NO: 16455 - protein, 150 aa, Zea mays
  misc_feature: Ceres CLONE 1380422-F
  misc_feature: SWISSPROT Homolog: EC 2.1.2.11 3-methyl-2-oxobutanoate hydroxymethyltransferase
  misc_feature (140)..(140): Xaa is any aa, unknown, or other
MLWVDKYRPKTLDKVTVHDQVAQNLRKFVSEQDCPHLLFYGPSGSGKKTLILALIKQMFGAGAEKVKLENKTWKIDTGNRTFEIELAMLSSAHHVEMTPSDAGFQDRYGVQGVIKEMAKNQAIDGQSKRAFKVLCVNGVXQLSREAKHPL

SEQ ID NO: 16456 - DNA, 623 bp, Zea mays
  misc_feature: Ceres CLONE 1380439-F
  misc_feature: Encodes the peptide sequence at SEQ ID NO. 16457
  misc_feature (460)..(460): n is a, c, t, g, unknown, or other
  misc_feature (620)..(620): n is a, c, t, g, unknown, or other
  misc_feature (623)..(623): n is a, c, t, g, unknown, or other
aaagctggagctccccgcggtggcggccgctctataactagtggatcccccgggctgcaggaattcgcacgagaccattacctagaacatcctaatcgaaaaatatcacacatattattgagaccaactagcaacatagaaagcacaatagtgtaccaacaatggcagctaaaatattttgcctccttatgctccttggtctttctgcaagtgctgctacggcgaccattttcccacaatgctcacaagctcctatagcttcccttcttcccccgtacctctcaccaacggtgtcttcggtatgtgaaaacccaattcttcaaccctacaggatccaacaggcaatcgcagctggcatcttacctttatcacccttgttcctccaacaatcatcagccctattacagcagttacctttggtgcatttattggcacaaaacatcagggcacaacaactacnacaacttgtgctagcaaaccttgctgcctactctcagcaacagcagttttctccatttcaccaactagctgcattgaactctgcttttctatttgcacacaaacactaccattcagccagctatctgctgcctacccccagcaatttcttccattcaccnacn

SEQ ID NO: 16457 - protein, 154 aa, Zea mays
  misc_feature: Ceres CLONE 1380439-F
  misc_feature (100)..(100): Xaa is any aa, unknown, or other
MAAKIFCLLMLLGLSASAATATIFPQCSQAPIASLLPPYLSPTVSSVCENPILQPYRIQQAIAAGILPLSPLFLQQSSALLQQLPLVHLLAQNIRAQQLXQLVLANLAAYSQQQQFSPFHQLAALNSAFLFAHKHYHSASYLLPTPSNFFHSPT

SEQ ID NO: 16458 - DNA, 625 bp, Zea mays
  misc_feature: Ceres CLONE 1380440-F
  misc_feature (507)..(507): n is a, c, t, g, unknown, or other
  misc_feature (617)..(617): n is a, c, t, g, unknown, or other
aagctggagctccccgcggtggcggccgctctagaactagtggatcccccgggctgcaggaattcgcacgagaccattacctagaacatcctaatcgaaaaacatttcgttgtgtaccgcaaacagcagagagaaaacggaatcccagatccacccttccccatctccatccgcggccatggcctccgccgacgccgacgccggcccgtgggatgccctcccgttgcacctccaggagcgcatcctctccctcctccccatcaccgaactagttcccgttgccgccgtgtcccgcgccttccaccgccttctgcgctccccgaccttccatgccctcctctccccgcatcgcctcgacgccttcttcctcctttccccacggctcgccgtccacccgctgtctcgccgcgtccgcactatgcccgcgttcgccgcgctctctcctccttctacccgctcgtctcctccccgtcccatcactccttatcaccctgcgctcactccagntcctcccgccgatccccgacggagcctacctcctatccgctatcgtcccgtcgcgtgggtcctccacctctgcacccttggtcgcgtcatcaccggggcagcgggcgttnctaaaccc

SEQ ID NO: 16459 - DNA, 633 bp, Zea mays
  misc_feature: Ceres CLONE 1380444-F
  misc_feature: Encodes the peptide sequence at SEQ ID NO. 16460
aaagctggagctccccgcggtggcggccgctctagtctagtggatcccccgggctgcaggaatttgcacgagaccattacctagaacatcctaatcgaaaatctccattccaaaactccgagcaatcagtccaaacccgtgtccaccgaaagtttgatgggatcaggcctctcaagcagcagcagccaccggagcagcggcgcgtcgtcgtcgcttcaccagccaccggcggcggccccggccctggtcgtcgcggtcgacggctcgctacgggagttcgtcacgccggcggcggtgccgctcctcccccccgtctccgtctccgacgtgctgggcgcgaatgcggacgacggtcggtccttcgtgtgcagctccagcgcgctctacttcgagaccgacgtcccggcgctcggcgccagcgagctgctccggccggagcagctctacttcgtcctccccgcggcgatgctcggcaggccgctctcgggcgccgacatggacgcgctggccgtgcgcgccagccaggtgctggcggcgggagcgaagccgtcgcgtgccgggcgacgccctctccggtccaccagggcgcgcgtcatggcggcggcggcggcgcaccacgcgcacgcgcacgtg

SEQ ID NO: 16460 - protein, 159 aa, Zea mays
  misc_feature: Ceres CLONE 1380444-F
MGSGLSSSSSHRSSGASSSLHQPPAAAPALVVAVDGSLREFVTPAAVPLLPPVSVSDVLGANADDGRSFVCSSSALYFETDVPALGASELLRPEQLYFVLPAAMLGRPLSGADMDALAVRASQVLAAGAKPSRAGRRPLRSTRARVMAAAAAHHAHAHV

SEQ ID NO: 16461 - DNA, 666 bp, Zea mays
  misc_feature: Ceres CLONE 1380446-F
  misc_feature: Encodes the peptide sequence at SEQ ID NO. 16462
  misc_feature (467)..(467): n is a, c, t, g, unknown, or other
  misc_feature (523)..(523): n is a, c, t, g, unknown, or other
  misc_feature (544)..(544): n is a, c, t, g, unknown, or other
  misc_feature (551)..(551): n is a, c, t, g, unknown, or other
  misc_feature (557)..(557): n is a, c, t, g, unknown, or other
  misc_feature (560)..(560): n is a, c, t, g, unknown, or other
  misc_feature (563)..(563): n is a, c, t, g, unknown, or other
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaatccgactaaaaagggccagggccagggccttcgcttgcttactactcctgcttaccacactctaccttgtctcttcacgtgcacacgacgcctcccccaatggctgcggtggcggaggaggaggtgatcgtcgtcggcgcggggcagtcggggctagcggtggcggcgtgcctgtccctgcgcggcgtgcgggcgctggtcctggagcgcgacgactgcgtggggtcgctgtggcggaagcgcgcctacgaccgcctccacctccacctcaccaagaagtactgcgcgctgccgcacgcgccgcacccggccgaggcccccgcgtacctgcaccgcgacaacttcgcgcggtacctggacggtancgccgcgcggttcgccgtccgcccgcgcctccgccgcgaggtccggtcggcgcggnacgaccccgcgagcgcgcggngggaggngcaggncgnggncctccccgcgggcacggtcgagcggcncgcggccgggcccctgggggcccgcccccggggccgccaaccggggagtacctccgcgagccactagttccggggc

SEQ ID NO: 16462 - protein, 151 aa, Zea mays
  misc_feature: Ceres CLONE 1380446-F
  misc_feature (89)..(89): Xaa is any aa, unknown, or other
  misc_feature (108)..(108): Xaa is any aa, unknown, or other
  misc_feature (115)..(115): Xaa is any aa, unknown, or other
  misc_feature (117)..(117): Xaa is any aa, unknown, or other
  misc_feature (119)..(119): Xaa is any aa, unknown, or other
  misc_feature (120)..(120): Xaa is any aa, unknown, or other
  misc_feature (121)..(121): Xaa is any aa, unknown, or other
  misc_feature (130)..(130): Xaa is any aa, unknown, or other
MAAVAEEEVIVVGAGQSGLAVAACLSLRGVRALVLERDDCVGSLWRKRAYDRLHLHLTKKYCALPHAPHPAEAPAYLHRDNFARYLDGXAARFAVRPRLRREVRSARXDPASARXEXQXXXLPAGTVERXAAGPLGARPRGRQPGSTSASH

SEQ ID NO: 16463 - DNA, 662 bp, Zea mays
  misc_feature: Ceres CLONE 1380451-F
  misc_feature: Translation starting site: 235
  misc_feature (662)..(662): n is a, c, t, g, unknown, or other
tggagctccccgcggtggcggccgctctagaactagtggatcccccgggctgcaggaattcgcacgagaccattacctagaacatcctaatcgaaaaaaaatcccgctctcctccctcgcccctctctctctcctcatccaccaccagtgcctccacgaatcttcaacaggcaaagccaatcaataatcaccagccacatcaatccattccctttcctctcccgctccacttccatgggcaaggtgcggtccttcttctcgcgctcccgcagcggcaagcgcggcagcgcccggagagcaggctcgtcctcgccgcactcctccgcggccagcgcgccgccgtccccgtccccactcccgaggaggtcaccgtcgtcgtcgtcaaccacaaccagggacgagacggagcgcgtggtccgcaaggtcgacgcgaacggcgacgggaagatctcgcggactcgaggtgaccgcgctgatccagggagtgtctcacaacgctgactgactactatcagcacgacgaatgcatgaattcaaccaactgtctacactgaaccctgctgcttatttgcagcaacaactattaccatttagccagctagctactgcctactctcagcaacaacaacttcttccatttaaccaattggccgcactgaacn

SEQ ID NO: 16464 - DNA, 642 bp, Zea mays
  misc_feature: Ceres CLONE 1380454-F
  misc_feature: Encodes the peptide sequence at SEQ ID NO. 16465
  misc_feature (360)..(360): n is a, c, t, g, unknown, or other
  misc_feature (361)..(361): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (548)..(548): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaacatttcgctagctccatagcacttgttccagctagctaggagagagagctttgtttaggcggcggcaagatgaacaggaagccaggagactgggactgcagggcgtgccagcacctcaacttcagccgtcgggatgcatgccagcgctgcagtgaaccacgtggagttggtgatcgtagcggcggtggtggcgacttgggtgggcgtggtggttcctccttcggcggtggctttggtgctgggctctgatgtcccgccctggnngaagggaaaggggtcccgggggggcaaaaaaaatttttgcccggggacgccccccaaggggttttaggggggccccccccaaaacaaaaaaaaaggagcccccccccccgcccccctctttttaaaaaaaagaaagaggggggnnngaagcacccaccccccccgggagacccaagaatgctgtcgntaccgctcccgcgctacgggcgagggaaggnnnntaaaggggtgggggggggggggtcggatanaccccccccccccccccaccccttgggggg

SEQ ID NO: 16465 - protein, 59 aa, Zea mays
  misc_feature: Ceres CLONE 1380454-F
  misc_feature (4)..(33): Pfam Name: zf-RanBP Pfam Description: Zn-finger in Ran binding protein and others
MNRKPGDWDCRACQHLNFSRRDACQRCSEPRGVGDRSGGGGDLGGRGGSSFGGGFGAGL

SEQ ID NO: 16466 - DNA, 826 bp, Zea mays
  misc_feature: Ceres CLONE 1380456-F
  misc_feature: Encodes the peptide sequence at SEQ ID NO. 16467
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (21)..(21): n is a, c, t, g, unknown, or other
  misc_feature (44)..(44): n is a, c, t, g, unknown, or other
  misc_feature (46)..(46): n is a, c, t, g, unknown, or other
ggcgcccctcttttnnntttnccgcccggtcccggcagcccaananaataaaaaaatggagctccaccgcggtggcggccgctctataactagtggatcccccgggctgcaggaattcgcacgagaccattacctagaacatcctaatcgaaaacccgtgtttctaactccggtggctccaccaccaggaacccgtgcagcgagcccaccccgaccactgccatgtcgaggcgcggcgactgggtctacgagaacaacggcgggcactgcgtggccatcgccggcgccgattactgtgtcgtagaggaggacacacgcctctctgtcggatacagcatcctcatgcgcgaccactctacgatctgccacctggctgacaaaatgtgaactagtcaacttgtgggtctgaggaagatatttaacgctccggacaaggaacctaatcttggccacagagttcgcttactcccccccaccatcataactaaaaggatggaagctggacctgcacttggatacagcatccttcatccagataccccatgaactctaaaaggagcgttctttccacatatgaacgcactttcccttggcgcgccccgcgggccctccactagccggaggcgtccagcggccggccgtcctccaccccaaatgacggccagacagcgcttcctcacgccgccgcacccctgcccatatacttgcgctcaacccgacacctgccccccccagccgcggccccaccccgcgcgttacctgggaacccagccaaaatgtttatatagctgcacgctgcctcataggacgtctctcccctgcgccg

SEQ ID NO: 16467 - protein, 54 aa, Zea mays
  misc_feature: Ceres CLONE 1380456-F
  misc_feature: SWISSPROT Homolog: EC 3.4.25.1 Proteasome endopeptidase complex
MSRRGDWVYENNGGHCVAIAGADYCVVEEDTRLSVGYSILMRDHSTICHLADKM

SEQ ID NO: 16468 - DNA, 655 bp, Zea mays
  misc_feature: Ceres CLONE 1380458-F
  misc_feature: Encodes the peptide sequence at SEQ ID NO. 16469
ggagctcaccgcggtggcggccgctctagaactagtggatcccccgggctgcaggaattcgcacgagaccattacctagaacatcctaatcgaaaaatcgatccagtgcaaactagctcgctcgcaagcgtaacccacccatgtctacgttctaacagacgaagcatcgaaggcaggcagccagataaacccacaccacacatggctcgtatcgtggcgatggtcgacttcgacaagacgatcatcgaccgtgtacagcgacaactgggtggcggacagcctcgcgctcaccgagctgtgcgagggcctcctccccaccacgacctggaacacgctcatgcacacgatgatgggcgagctgcacgcgcagcgcaggacgatggccgagctgaccgaggcgctcagggcggcgcccatcgacccgcgagagcccgacgacgtcaggtacgagcacgcgctcgacatgcgactagctgtgatcaacgtacgcaaagtactcttcagtcaaactgtcttggacaacacggactgatcgactgcttctcccagttaatttcaccccagccggggtaaaacccaagggcggaattcgaatggggacttgccagaacctgggggggggcaccccaaggtttgggaggttcggaccttgccc

SEQ ID NO: 16469 - protein, 64 aa, Zea mays
  misc_feature: Ceres CLONE 1380458-F
MHTMMGELHAQRRTMAELTEALRAAPIDPREPDDVRYEHALDMRLAVINVRKVLFSQTVLDNTD

SEQ ID NO: 16470 - DNA, 709 bp, Zea mays
  misc_feature: Ceres CLONE 1380465-F
  misc_feature: Encodes the peptide sequence at SEQ ID NO. 16471
ggagctcaccgcggtggcggccgctctagaactagtggatcccccgggctgcaggaattcgcacgagaccattacctagaacatcctaatcgaaaatttagctgccatctgtttctgaaccatggatccatttgttctctccatcctcttatgctcatcgatctttgttgtagtgtactggagaaggctgaacagcatgaggctaagacttccaccgggacctccaacatggccaattttcggcaatcttctccagttgagccctcttccccacaaagactttgcccaattttgcaccaaatatggccctctcgtctatcttcgcctgggaaccatcgatgccatcaccactgatgaccccgaagtgatccgtgaaatactcatccggcaagatgaggtctttgcttcgcggcctcggacactggctgccgtccatctcgcctatgggtgtggggatgtgggtctagctccactgggacccacctggaaaaggatgaggagagtttgcatggagcacttgctgacgaccaggcggctcgagtctttcgctgctcaccgagttcaggaggccgagcacctctgccaaggttgtgggggctaaatctcagtcccgggaagcccgtgaccctcagagaaggtcctccggggccttctccgatggaacaacggccccccgcccgaacggcctccgccccccgaaggccgggag

SEQ ID NO: 16471 - protein, 159 aa, Zea mays
  misc_feature: Ceres CLONE 1380465-F
  misc_feature: SWISSPROT Homolog: EC 1.14.13.21 Flavonoid 3'-monooxygenase
MDPFVLSILLCSSIFVVVYWRRLNSMRLRLPPGPPTWPIFGNLLQLSPLPHKDFAQFCTKYGPLVYLRLGTIDAITTDDPEVIREILIRQDEVFASRPRTLAAVHLAYGCGDVGLAPLGPTWKRMRRVCMEHLLTTRRLESFAAHRVQEAEHLCQGCGG

SEQ ID NO: 16472 - DNA, 734 bp, Zea mays
  misc_feature: Ceres CLONE 1380475-F
  misc_feature: Encodes the peptide sequence at SEQ ID NO. 16473
  misc_feature (592)..(592): n is a, c, t, g, unknown, or other
  misc_feature (625)..(625): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccggcgccagtgcctgcgccgccacgagggccagccgtgggagacccaggagtgcatgaggcggtgccgccgccgcggactggccgtcgacatggangcaagagtacggtcgcggcagcgagagcgcggncagtggcccgggagaggtgcgagcgccacaccgcgnnngacttggtgggagaggcagcgctgcctgagatgaaaaaaacacccggaaaggggaaaaaaagaagccccca

SEQ ID NO: 16473 - protein, 162 aa, Zea mays
  misc_feature: Ceres CLONE 1380475-F
  misc_feature (128)..(128): Xaa is any aa, unknown, or other
  misc_feature (152)..(152): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRRHEGQPWETQECMRRCRRRGLAVDMXARVRSRQRERGQWPGRGASATPRXTWWERQRCLR

SEQ ID NO: 16474 - DNA, 672 bp, Zea mays
  misc_feature: Ceres CLONE 1380482-F
  misc_feature: Translation starting site: 170
  misc_feature (281)..(281): n is a, c, t, g, unknown, or other
aaagctggagctccccgcggtggcggccgctctagaactagtggatcccccgggctgcaggaattcgcacgagaccattacctagaacatcctaatcgaaaactctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggctggtacggcgctggcngccggctgacgacgatgatgggcgccggcgggctgtacccctacgcggagtacctgaggcagccgcagtgcagcccgctggcggcggcgccctactaacgccgggtgtgggcagccgagcgccatgttccagccgctccggcaacagtgctgccagcagcagatggagatgatggacgtgcagtccgtcgcgcagcagctgcagatgatgatgcagcttgagcgtgccgctgccgccagcagcagcctgtacgagccagctctgatgcagcagcatcagcatctgctggcaccccagggtctcaaccccctggctattgatgatggcccgccacttgctccccccagggtgtaatctactcgctccacccgccgcctcaccgccccacccc

SEQ ID NO: 16475 - DNA, 491 bp, Zea mays
  misc_feature: Ceres CLONE 1380484-F
  misc_feature (429)..(429): n is a, c, t, g, unknown, or other
tccccgcggtggcggccgctctagaactagtggatcccccgggctgcaggaattcgcacgagaccattacctagaacatcctaatcgaaaatccactcgccctcccacacagaaaaccctagccgccgccaccgaagcggcctcccaggtaagcaggagcgtccaccccgccgccgtcatgaagcgcaatccccgcgtcacgagctcccgccggaaagtgccgaaagccgcacttttagggcccccgtccctccggtcgggcggggtttttcattgtccccccggggtttgttcaacagaaattcccccccaaaaaaaaaaaaagggggggggtcccattcccccaataccccaagagagaaaaaaaaaaaaaagggggtgtaaagtttgggggggggggggggggggcacccaaaaaaaaaaaaaccnccccccccgcgggggggaaaaaaaagggggtggtggcagaaaaaatttcttcccccccccgc

SEQ ID NO: 16476 - DNA, 734 bp, Zea mays
  misc_feature: Ceres CLONE 1380486-F
  misc_feature: Translation starting site: 181
  misc_feature: SWISSPROT Homolog: EC 1.3.1.9 Enoyl-[acyl-carrier-protein] reductase (NADH)
  misc_feature (392)..(392): n is a, c, t, g, unknown, or other
  misc_feature (413)..(413): n is a, c, t, g, unknown, or other
  misc_feature (440)..(440): n is a, c, t, g, unknown, or other
  misc_feature (463)..(463): n is a, c, t, g, unknown, or other
  misc_feature (475)..(475): n is a, c, t, g, unknown, or other
  misc_feature (478)..(478): n is a, c, t, g, unknown, or other
  misc_feature (513)..(513): n is a, c, t, g, unknown, or other
tccccgcggtggcggccgctctagaactagtggatcccccgggctgcaggaattcgcacgagaccattacctagaacatcctaatcgaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgcccttgcatttcggcctcgccaggaattcttaccgcacgggtagcagtttctaggactgattgcatgctcagtaccactgctacattccccaaaatcagctgctcctggcctctaaggtttaagcgcaatgatgttgttgtaagagcatatcggaagagtgtggcccngcagggcttcccattgatctncagagtaaaagggcattcattgctggnagtgctgatgataatggctatgnatgggcaatgcnaangcacttgctgcggctggtgctgaaatcctgggggnacatggtggccgccacttaactatttggaaaaagtctgagggctggaaagttttattaatccccggaacctgccaaaggatcccttttgggaattgtgtaaaggcttccccttttgggggtgttacaattcccccgggatgggtgcccgaaaatgggcaaaaccaaaaaaaaatttgggggggcctccacctgggacaaaaaaaggatttgttaaaaccgg

SEQ ID NO: 16477 - DNA, 719 bp, Zea mays
  misc_feature: Ceres CLONE 1380488-F
  misc_feature: Translation starting site: 432
  misc_feature: SWISSPROT Homolog: EC 1.11.1.7 Peroxidase
  misc_feature (375)..(375): n is a, c, t, g, unknown, or other
  misc_feature (376)..(376): n is a, c, t, g, unknown, or other
  misc_feature (383)..(383): n is a, c, t, g, unknown, or other
  misc_feature (663)..(663): n is a, c, t, g, unknown, or other
  misc_feature (682)..(682): n is a, c, t, g, unknown, or other
tccccgcggtggcggccgctctagaactagtggatcccccgggctgcaggaattcgcacgagaccattacctagaacatcctaatcgaaaaaggagacttggcttgtactgcatcgcaaaccgcaatcgcacgcggcacttgccccccgcgatcataacctcaccgcccgccaccagctgcagccacaagcgcagcgctcgacagcctcaccagccgccatcactcgcggcagtacccggccgctgggactgcaagagtggggagtgagacgctgctgctgttgccgagcgcgaggagacactactactcactcaagagtcaagactcaacagcagcaggggcgaccgagctctgcgtgcgtggggagaaccgannaaggcanccagaggagggagggagggagcgcgtggaccaggctaggcgcagcagcatgggcgccgggatcagggtcctggcggcgctcttggcggcgctcgcggcagccaccgccggcgtgacggcgcagctgcggcaggactactacgcggcggtgtgcccggacctggagagcatcgtgcgcgccgcggtgtccaagaaggtgcaggcgcagccccgtcgccgtgggcgccaccatccgcctcttcttccacgactgcttcgtcgagggctgcgaacgcgtcggnggatcctggtgtccacggngaacaacccgggcggagaaggaccacccgagcaactc

SEQ ID NO: 16478 - DNA, 688 bp, Zea mays
  misc_feature: Ceres CLONE 1380491-F
  misc_feature: Encodes the peptide sequence at SEQ ID NO. 16479
  misc_feature (495)..(495): n is a, c, t, g, unknown, or other
  misc_feature (521)..(521): n is a, c, t, g, unknown, or other
  misc_feature (522)..(522): n is a, c, t, g, unknown, or other
  misc_feature (639)..(639): n is a, c, t, g, unknown, or other
  misc_feature (648)..(648): n is a, c, t, g, unknown, or other
aagctggagctccccgcggtggcggccgctctagaactagtggatcccccgggctgcaggaattcgcacgagaccattacctagaacatcctaatcaaaaaagtcgaagggtcgactatggttacgacgatcggcagtccatagcagcggtgtgcgcaacttcgacccggttttcttcccatatatctgccacatccttctccggttaccctccatcggtggcaatttccggcatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcggcttgattcaagtggatcaatcgacagtaccatcaaggaaacttttgggagttttgacgaggtcctagagcctggatgccacttcttgccatggtgcatagggaagcaaattgcntgggtatctggtcactgcgtgtgcgnncagcttggatgtccgctgcgaaacaaagacaaaggataatgtcttccgtcaatggttgtggcatctggtgcaatatcgtgccccttggccgataaggcatctgatggcattttacanggcttagtnaacaccagggagcaatcccagtcatattggtttttgatgt

SEQ ID NO: 16479 - protein, 38 aa, Zea mays
  misc_feature: Ceres CLONE 1380491-F
  misc_feature (22)..(22): Xaa is any aa, unknown, or other
MVVASGAISCPLADKASDGILXGLVNTREQSQSYWFLM

SEQ ID NO: 16480 - DNA, 690 bp, Zea mays
  misc_feature: Ceres CLONE 1380494-F
  misc_feature: Encodes the peptide sequence at SEQ ID NO. 16481
  misc_feature (432)..(432): n is a, c, t, g, unknown, or other
aagctggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggtttgctgtgtttggctgcaggaancctgagagaatcccgttgggggttccggttggtgctggaatatgttgttgagtcttactggtgttttcactgaccaggagaaggctgcagctcactttgaagggtgttgcccaagaaggttgtcatctctgctcctagcaaggatgcccccatggtttgtccgctggtgtcaaccgagaaggagtacaaagtctgacattaacattgtctccaatgctagttgaacaaccaactgccttgctcctcttgctaaaggcc

SEQ ID NO: 16481 - protein, 83 aa, Zea mays
  misc_feature: Ceres CLONE 1380494-F
  misc_feature (4)..(77): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMFKYDTVHGQWKHHEVKVKDSKTLLFGEKEVCCVWLQE

SEQ ID NO: 16482 - DNA, 718 bp, Zea mays
  misc_feature: Ceres CLONE 1380499-F
  misc_feature: Encodes the peptide sequence at SEQ ID NO. 16483
tggagctccccgcggtggcggccgctctagaactagtggatcccccgggctgcaggaattcgcacgagaccattacctagaacatcctaatcgaaaaacacgaactcgagacctcgcccgcccaaatacaaaagcctcagatctcagagaccagcgccgccacttcgttcgtgtcaaatatataagagaggaaatgttggctagggagggcgtgctcctggggatgggcaaccccctcctcgacatctccgccgttgtcgatgacgccttcctgccaaagtatgacatcatgctgaacaatgccattctcgctgaggagaagcactcgcctatgtatgatgagttggctagcaacagcaatgctgaatatattgctggaggagccacccagaactctatcagggttggccaatggatgcttcaaactcctggtgcaacaagttacatgggatgcattggcaaggactagattggtgaggagatgaataaaaatgctcaagctgcaggagttactgctcattactatgaggatgagactgctcctactgggacatgtgatgtatgtgttgctgatggcaaaaggtcattgattgcaaatctgtcggtggcaaactgttacaaacttgagcatctctcgacaccagagaaatgggcactagtatgagaaggcacaatacatctacattgctggatttttcgctactcgagtcacctgatt

SEQ ID NO: 16483 - protein, 91 aa, Zea mays
  misc_feature: Ceres CLONE 1380499-F
  misc_feature: SWISSPROT Homolog: EC 2.7.1.20 Adenosine kinase
MLAREGVLLGMGNPLLDISAVVDDAFLPKYDIMLNNAILAEEKHSPMYDELASNSNAEYIAGGATQNSIRVGQWMLQTPGATSYMGCIGKD

SEQ ID NO: 16484 - DNA, 707 bp, Zea mays
  misc_feature: Ceres CLONE 1380501-F
  misc_feature: Encodes the peptide sequence at SEQ ID NO. 16485
  misc_feature (389)..(389): n is a, c, t, g, unknown, or other
  misc_feature (439)..(439): n is a, c, t, g, unknown, or other
  misc_feature (514)..(514): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatacagtagcaacaatagagcaacaatggcggccaagatattttccatccttatgctccttgctctttctgcatgtgttgctaacgcgaccatttttcctcaatactcacaagctcctatagctgcccttcttcccccataccttccatcaatgaccgcttcagtatgtgaaaacccagcccttcaaccctacaggctccaacaagcaatcgcaacaagcaacttacctttatcacccctgttctttcnacaatcgccagccctaatcttggtgcagtcattggtacaaaacatcaggncacaacagctgcagcaactcgtgctaccagtgatcagcccagtagctctggcaaacctttcttcctactctcagnaacaacattttctccattcaaccaatgggctaccctgaaccttgctgtttatttgcaggaacaaaactataccatttagcccggttgttcgtgcctacctcaaaaagaaaaatttcttccattaaccaatttcccgaggaaccccctggtttttccgagaacaaaaaaaaaaactttgggccgttgttaaaaa

SEQ ID NO: 16485 - protein, 128 aa, Zea mays
  misc_feature: Ceres CLONE 1380501-F
  misc_feature (75)..(75): Xaa is any aa, unknown, or other
  misc_feature (92)..(92): Xaa is any aa, unknown, or other
  misc_feature (117)..(117): Xaa is any aa, unknown, or other
MAAKIFSILMLLALSACVANATIFPQYSQAPIAALLPPYLPSMTASVCENPALQPYRLQQAIATSNLPLSPLFFXQSPALILVQSLVQNIRXQQLQQLVLPVISPVALANLSSYSQXQHFLHSTNGLP

SEQ ID NO: 16486 - DNA, 708 bp, Zea mays
  misc_feature: Ceres CLONE 1380502-F
  misc_feature: SWISSPROT Homolog: EC 4.1.2.13 Fructose-bisphosphate aldolase
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (227)..(227): n is a, c, t, g, unknown, or other
  misc_feature (228)..(228): n is a, c, t, g, unknown, or other
  misc_feature (233)..(233): n is a, c, t, g, unknown, or other
  misc_feature (234)..(234): n is a, c, t, g, unknown, or other
  misc_feature (241)..(241): n is a, c, t, g, unknown, or other
  misc_feature (243)..(243): n is a, c, t, g, unknown, or other
  misc_feature (247)..(247): n is a, c, t, g, unknown, or other
aagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagaggggtctgcggcgnnntannttgtnncccccgncnaggntatccttgctgctgatgagtccactggcaccattggcaagcgcctttccagcatcaatgtcgagaacgttgaggagaaccggcgtgccctccgtgagctcctattctgctgccctggtgctctcagtacatcagcggtgtgatcctccttcgagagaccctggaccagaagacccaggatggccagccttttggttgatgtcctcagggaggagggcgcctccctggcatcaaggttgaaaaggcaccctttgaggttggttgccctgataaggaaaccccccccaagggccttgacgactttggaaagggtttggcccaggaataacaagggaggggcccctttttgccaaggggcgcccttgttccaaaaatgggccccaaagggcccatccacgtttggccctcaacccgaaaacctcagggggtgggtttcctatatccaacttttcgccgggaaaa

SEQ ID NO: 16487 - DNA, 731 bp, Zea mays
  misc_feature: Ceres CLONE 1380504-F
  misc_feature (529)..(529): n is a, c, t, g, unknown, or other
  misc_feature (556)..(556): n is a, c, t, g, unknown, or other
  misc_feature (562)..(562): n is a, c, t, g, unknown, or other
  misc_feature (575)..(575): n is a, c, t, g, unknown, or other
  misc_feature (576)..(576): n is a, c, t, g, unknown, or other
  misc_feature (589)..(589): n is a, c, t, g, unknown, or other
  misc_feature (601)..(601): n is a, c, t, g, unknown, or other
  misc_feature (609)..(609): n is a, c, t, g, unknown, or other
  misc_feature (612)..(612): n is a, c, t, g, unknown, or other
  misc_feature (614)..(614): n is a, c, t, g, unknown, or other
  misc_feature (623)..(623): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (634)..(634): n is a, c, t, g, unknown, or other
  misc_feature (638)..(638): n is a, c, t, g, unknown, or other
  misc_feature (644)..(644): n is a, c, t, g, unknown, or other
  misc_feature (645)..(645): n is a, c, t, g, unknown, or other
  misc_feature (652)..(652): n is a, c, t, g, unknown, or other
  misc_feature (653)..(653): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (667)..(667): n is a, c, t, g, unknown, or other
  misc_feature (677)..(677): n is a, c, t, g, unknown, or other
  misc_feature (729)..(729): n is a, c, t, g, unknown, or other
tggagctccccgcggtggcggccgctctagaactagtggatcccccgggctggaggaattcgcacgagaccattacctaaaacatcctaatcgaaaaatcaaccatattattgagaccaagaagcaagatataaagtggaatccaggagcaacaatagtagtaacaatggctgtgccaagatattttccctccgtatgctccttgctctttctagctgccgctgtataagcaagccttctcgctcgatggtctctcgccgcgatcgttttcccttcgccaccctggtctgagccgccgtcggtagcagaggaggagtaggtggccagtcagtcagccaattgtccgctcgtccactccgttcgaggtctcctactcttcaccacccacccatccatccatccatccatcggcgagcgcgagagcacactgttgcattgctgatcgctccggctccgctgccgacgaggacgaggaagaacgacggagagacgcagacaggctgcggtgcgccctagagagagccgcggngcgatcgcgcgcgggcccacgggccgncgccgnccgcgggcgcccnncgccgccgcgacnacgcacgtcccnccccgaancgntnccgcccttncgcnnnggcgnacgnccacgnnacccctnncgacatccgnnnancgagaatcgntttaacgttattcagaccgaatcgctatactagactcataacacgctcccgncg

SEQ ID NO: 16488 - DNA, 644 bp, Zea mays
  misc_feature: Ceres CLONE 1380509-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (168)..(168): n is a, c, t, g, unknown, or other
  misc_feature (421)..(421): n is a, c, t, g, unknown, or other
  misc_feature (422)..(422): n is a, c, t, g, unknown, or other
  misc_feature (450)..(450): n is a, c, t, g, unknown, or other
  misc_feature (498)..(498): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnncccccccnnnnnnnnnnnnnnnnnnnnnnnnnnnnnnnnnnnaannnnnncccaaagctggggactccaccggcggtgggcggccgctctanaactagtggatccccccgggctgcaggaattcgcacgagaccattacctagaacatcctaatcgaaaacactttgtttgcaaagctcctcctcgatccatcgatcactgcaccggccggcggcaccgcgctcgaggggctagccaacgagacggcagcaatggcggaccgtgaccgcagcggcatctacggcggcgcccacgccacctacgggcagcagcagcagcagggaaggaggcgggcggcccgatggnntgagcagggtgaaagggcatggctcccnacgaacaagggggcccgacggggcggtccccagggcgcctgaaacggngggtggaacgcttggttccccccgctgggcccggcctggcctggctgggggggctgttcccgggggtttgggcgcttgacggccttcccggggggggggggccttggcccgggccccaccccccgggggggccccgggagcctccc

SEQ ID NO: 16489 - DNA, 784 bp, Zea mays
  misc_feature: Ceres CLONE 1380513-F
  misc_feature: Encodes the peptide sequence at SEQ ID NO. 16490
ccacccccttactttatattacttcgttacaaaccaccccctcaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggagaagaaggacgacgcggtggtgcagccgcagaccttcccgcccttcgaccgcctcgaaggcggcgcgtccccggcgttcggcggcctccccggaggcagcattcctggaagcagcattccccgggttcagcatgccccggaagcggcagcaagcctacccgggttcagattgcccgacagcggcagcatgcccctcctcggcggcggctccccgggcttcaccggcttcggcgggatgcccggatgccccaacggccggctccgtccccgagcacgccaacaagccctgaaacgccaacaagcgtggatactaaagcggcgcctatgttaactggaaaaacggccgccgactccatggaatgcgtggttcc

SEQ ID NO: 16490 - protein, 143 aa, Zea mays
  misc_feature: Ceres CLONE 1380513-F
MARSSKMMVAAALLALALAVSIAEARNIKTTTTEKKDDAVVQPQTFPPFDRLEGGASPAFGGLPGGSIPGSSIPRVQHAPEAAASLPGFRLPDSGSMPLLGGGSPGFTGFGGMPGCPNGRLRPRARQQALKRQQAWILKRRLC

SEQ ID NO: 16491 - DNA, 739 bp, Zea mays
  misc_feature: Ceres CLONE 1380514-F
  misc_feature (656)..(656): n is a, c, t, g, unknown, or other
  misc_feature (700)..(700): n is a, c, t, g, unknown, or other
aaagctggagctccccgcggtggcggccgctctagaactagtggatcccccgggctgcaggaattcgcacgagaccattacctagaacatcctaatcgaaaaattctgccttacgctgccgacaacccttcctcggtcgctgtggagccttctgtcctctggttacttccgagcttcagagcctgccgtggttgttcgacagacgatgcagcttgcggtctcttcgctgcacagcaccacctggccggaggcaatgtttaggtcccgatggctgctcacgccgaggacgctgaccaggctggccggctcctgcgacgtgcagacgccctgaacgaggatgaccactgctcctccgtgggagaccgactcctccggccgtcttaagacgtagccggtgcgatccgagaatgacactcgcagaacgaggggacagacgccgctgctgacgcgacggactcatacctgacggaagcacatccggatgtcgtctctgcgcaaaaataaacgtagctctaagaagtatatacagagggcgccgcgccggcagaagagacttatgatgctgctgacccggctcaccttggtgagacgaacatacgcgcctagagcacagaagtgccgactgagccggctaacgcatgatgagtagacgaagncgactgctgggtgctgccactcctgaggtcacagcgacctaacntagataggcggcgtgcactgctcactgagacggacgttg

SEQ ID NO: 16492 - DNA, 679 bp, Zea mays
  misc_feature: Ceres CLONE 1380521-F
  misc_feature: Encodes the peptide sequence at SEQ ID NO. 16493
  misc_feature (585)..(585): n is a, c, t, g, unknown, or other
tggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggcggggcaggacgccaccgacgccttcgccgcctaccacccgccctcggcgcgcccgctcctccgccgcttcttcgttggccgcctctccgactacgccgtctcccccgcgtccgccgactaccgccgcctcctcgcgcaggtatcctccgcgggcctcttcgaacgcgtcggacccacccccaagggccagcntacgtcctgatgggcgtcctcttctacgccgagctctacctcgtcctcgcctgcgccagcgactggagcaccttccttcagagggggtcacatg

SEQ ID NO: 16493 - protein, 132 aa, Zea mays
  misc_feature: Ceres CLONE 1380521-F
  misc_feature (22)..(95): Pfam Name: Cyt-b5 Pfam Description: Cytochrome b5-like Heme/Steroid binding domain
  misc_feature: SWISSPROT Homolog: EC 1.7.1.1 Nitrate reductase (NADH)
  misc_feature (130)..(130): Xaa is any aa, unknown, or other
MPPSVDAMPAPGDAAGGGDVRMISSKELRSHASADDLWISISGDVYDVTPWLPHHPGGDLPLLTLAGQDATDAFAAYHPPSARPLLRRFFVGRLSDYAVSPASADYRRLLAQVSSAGLFERVGPTPKGQXTS

SEQ ID NO: 16494 - DNA, 690 bp, Zea mays
  misc_feature: Ceres CLONE 1380527-F
  misc_feature: Translation starting site: 280
  misc_feature (678)..(678): n is a, c, t, g, unknown, or other
  misc_feature (690)..(690): n is a, c, t, g, unknown, or other
tggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgctactgatcaaggcaaccaatattcaccgtcggcaatgtccgacctgatccctgggctgccggatgaagtggccagggtagtgcctcgtccgggtgggcttcgaccagctgccgatggtgcgccgcatctcgcgccagtggaagtcggaggtggagtcgccggactaccaccgccagcgccgagcggaggagctggcgcacccgttgctcgcgctgatccagtcgcaatcgacagcgccggcgaatgaggacgaagacgccatccccgcggacaaggagtcgacggcggtcaactacggagcgagtcgtgctgctgtaagcgaccgagcgacggtggacgtcgctgacagacacgactgcggaaatcaagaagctgactatgtacatcgaggcgaacaccgctatcgcagctcctagcgaggctcagtttcaccgtcacggggaatgcatcctcgtcaaaacctcgtatgaggaactgctcccattggtgttccccacaatattaccgttggntagagcggatgn

SEQ ID NO: 16495 - DNA, 629 bp, Zea mays
  misc_feature: Ceres CLONE 1380528-F
  misc_feature: Encodes the peptide sequence at SEQ ID NO. 16496
  misc_feature (565)..(565): n is a, c, t, g, unknown, or other
  misc_feature (566)..(566): n is a, c, t, g, unknown, or other
tccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggatcatagagagtggttggagagggtgtgactgacgtagctccgggcgaccatgtccttccctgtgtcactggggagtggaaggagtgtgcccactggcagtcggcagagagcaacatgtgtgatctgctcaggatcacaccgaccgcgnnggtgatggatgccgatggaaaatccccgtttttcaatcaatggggagcctatcaacccttttg

SEQ ID NO: 16496 - protein, 74 aa, Zea mays
  misc_feature: Ceres CLONE 1380528-F
  misc_feature: SWISSPROT Homolog: EC 1.1.1.1 Alcohol dehydrogenase
MATAGKVIKCKAAVAWEAGKPLSIEEVEVAPPQAMEVRVKILFTSLCHTDVYFWEAKGQTPVFPRIFGHEAGGS

SEQ ID NO: 16497 - DNA, 703 bp, Zea mays
  misc_feature: Ceres CLONE 1380531-F
  misc_feature: Encodes the peptide sequence at SEQ ID NO. 16498
tggagctccccgcggtggcggccgctctagaactagtggatcccccgggctgcaggaattcgcacgagaccattacctagaacatcctaatcgaaaaaaatccatatttgtcccagcgaaggcacacagccgccgccatttcttcatcctcccatctcctgatctccatctccatcttcttcgcagcgccggcgatccatcttccgctgcctcccttcctcgcgctcgggctctcagtgacggcatcagcggtttcccctcccgcctctcgccagtcgcatcacgcccccgcctccggtccaccgcacaccggccggtgaccctacattacttgctaatctttcttgagggcagatggccgtttcttttgcaaatgtcaacgccgaggcagggctgaaaaagcttgatgagtaccttctcactcgcagctacatcactggctaccaagcttccaaggatgacctggctgtctactcttcatttttggctgatccctcatccaagtatatcaatgtagcaaggtggtttaatcacattgatgcactcctgaggctgagtggagttaccgcagagggcctaggtgttaaggttgagccatcagcggttccttcagcttcaattcttgatgttgctgatggacaggccccagctgctgacgaggatgacgatgatgatgttgacctttttggcgagagactgaaga

SEQ ID NO: 16498 - protein, 116 aa, Zea mays
  misc_feature: Ceres CLONE 1380531-F
  misc_feature: SWISSPROT Homolog: EC 6.1.1.16 Cysteine--tRNA ligase
MAVSFANVNAEAGLKKLDEYLLTRSYITGYQASKDDLAVYSSFLADPSSKYINVARWFNHIDALLRLSGVTAEGLGVKVEPSAVPSASILDVADGQAPAADEDDDDDVDLFGERLK

SEQ ID NO: 16499 - DNA, 715 bp, Zea mays
  misc_feature: Ceres CLONE 1380532-F
  misc_feature: Encodes the peptide sequence at SEQ ID NO. 16500
  misc_feature (643)..(643): n is a, c, t, g, unknown, or other
  misc_feature (644)..(644): n is a, c, t, g, unknown, or other
  misc_feature (672)..(672): n is a, c, t, g, unknown, or other
tggagctccccgcggtggcggccgctctagaactagtggatcccccgggctgcaggaattcgcacgagaccattacctagaacatcctaatcgaaaaaccaaaggtatcttgcaatcacaacgaacaaaagctctcgatctcaccgacaccgaggaagaagagatcaatggcgtccgagcagggagtcgtgatcgcgtgccacagcaaggctgagtttgacgcccacatgaccaaggcccaggaagccggcaagctggtggtcatcgacttcactgccgcctggtgcggtccatgccgcgccatcgccccactgttcgtcgaacacgccaagaagttcactcaggtcgtcttcctgaaggtggacgtggacgaagtgaaggaagtcaccgcggcctacgaggtcgaggcgatgccgaccttccacttcgtcaagaacggcaagacggtcgcgaccatcgtgggtgccaggaaggacgagctcctggccctgatcgagaagcatgccgcgcctgcgcctgcgactgcgtctgcctaaatgagatcagatcagtcgtcgccgtcaataagggccagcacgtatggctgtaaatggtgtcgttatcagttctgggcttttgtcgttggtgggcgattgtaactagnnaaaaaatggtttgtttctatccgagccnggaggcgatacttaaccaaaaaaaaaaaaaaaaaaaaaaaaaa

SEQ ID NO: 16500 - protein, 122 aa, Zea mays
  misc_feature: Ceres CLONE 1380532-F
  misc_feature (8)..(112): Pfam Name: Thioredoxin Pfam Description: Thioredoxin
  misc_feature: SWISSPROT Homolog: EC 3.5.1.52 Peptide-N(4)-(N-acetyl-beta-glucosaminyl)asparagine amidase
MASEQGVVIACHSKAEFDAHMTKAQEAGKLVVIDFTAAWCGPCRAIAPLFVEHAKKFTQVVFLKVDVDEVKEVTAAYEVEAMPTFHFVKNGKTVATIVGARKDELLALIEKHAAPAPATASA

SEQ ID NO: 16501 - DNA, 674 bp, Zea mays
  misc_feature: Ceres CLONE 1380533-F
  misc_feature: Translation starting site: 181
aagctggagctccccgcggtggcggccgctctataactagtggatcccccgggctgcaggaattcgcacgagaccattacctagaacatcctaatcgaaaaacagctagctagcatacagacgaataatctcttcttcacctcactaacaccagctagcaactctttctctcctgcaataatggccgctcgctcctcctcctcccagacgcagctggtcgcggcggcggcgggcctggcagcggcgctgctgctgctggcggcgggggccggtcacggcgccggaggcggagagctgcggtgaggtgacgtcgtcagaggcgccgtgcctcgaatacgcgatggacagagcggggtcgccctccgcggtgggatgcaacggagagcgctcgctctacagccgcgcgtcactcgacggaggaacggcaggtcacctgcagctggctacagagaatgacgggacgactcgggaggtggcgtcttcatgatgcaaccaggcaacatccccgccatgagtgcgtcatagaggaggaagccaattatacgctttgcaaggtgcaaactaatcaggtgggcaaagaaggccatacccttacctccacccatacgatggtcgcaccatccggtacccctgacccgtttcataagcccaacgatcaccatcaagcttcaatt

SEQ ID NO: 16502 - DNA, 834 bp, Zea mays
  misc_feature: Ceres CLONE 1380540-F
  misc_feature: Encodes the peptide sequence at SEQ ID NO. 16503
ggagctccccgcggtggcggccgctctagaactagtggatcccccgggctgcaggaattcgcacgagaccattacctagaacatcctaatcgaaaacccaacctcatcttctctccctttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtggagtcttctgacaccatcgacaacgtcaagggcaagatccaggacaaggagggcatccctccggaccagaaggggttcatttttgctggcaagcagttcgaggacgggggcacgctggccgactaccacatttcagaaagagagcaccctccccttgggggttggcgtccaggggcgggaatggagatcttccgggaaaattctgaacggcaaagactatcaccccttggagggccaaggccttcttgataccattggaaaatggccaaggcccaaaatcccaggaacaaggggtgcctttccctcccggaaccaggcagggggtttacattttttgccgggcaaaccaagcttcgagggacagggcgcccc

SEQ ID NO: 16503 - protein, 175 aa, Zea mays
  misc_feature: Ceres CLONE 1380540-F
  misc_feature (6)..(74): Pfam Name: ubiquitin Pfam Description: Ubiquitin family
  misc_feature (82)..(144): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKGKIQDKEGIPPDQKGFIFAGKQFEDGGTLADYHISEREHPPLGGWRPGAGMEIFRENSERQRLSPLGGPRPS

SEQ ID NO: 16504 - DNA, 1038 bp, Zea mays
  misc_feature: Ceres CLONE 1380543-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (1038)..(1038): n is a, c, t, g, unknown, or other
nnnnncccccccccccccnnnnnatnnnntnnnnnnnnatgggtctcgtgtgtggggtggggctcaccgcggtggcggccgctctagaatagtggatcccccgggctgcaggaattcgcacgagaccattacctagaacatcctaatcgaaaaaactaggagagtggtggaggaggagacccaccgtcggctcgcccgtgtcccgattcccactcacgacatcaacctgtccccatccatctcgcccgcgacgtttgatggagtctctcctcgcctcgcgatccattaggtcttccttctccgccgtcgccagcaccaggggcgccgcttccaccaggccctcgcgcgtcgccaccctcgccagcgcccggggcccgctcccggggcgctccggggttgggcacacgggactcaatcctttaaggtggctggcacagggacgataatgctggaaacggaaaagggagctgggccccaatggggaagaatgggcttggtccattccaattgaacataagggggtttaggggcggggggaatttccgaatcccgggaagaacacttggccgggcccccaactggcccttcccttgtgaaaaggcgagattaaggaggggaggaaagctttggggaaacacccccccccctataaccattcccgtaaagaaggaaagaaattcctttttgtgggggaaacaaaggggggagaatatggaaacggtaacccgttggaaggggggcgatgtgggttaaaagaaaaggcccttcttttgggaggggggaggggaattctccggggggtgtggcaacaagaaaatggcccccctctcctttatagaggagaagcttttttatatggggggccttttttaaaaaggttgggccttaacacaagcgcggaaaaaggggcggggggccctggccatttgcatttgtggtgtgagggccaacaaaaaacacatcccccccccaaattgaagcgcgctggtggctttacggtggaaaaccttttatttccccgggggggggatggggccn

SEQ ID NO: 16505 - DNA, 806 bp, Zea mays
  misc_feature: Ceres CLONE 1380544-F
  misc_feature: Encodes the peptide sequence at SEQ ID NO. 16506
ggagctcaccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaagagttggtgcagatggatcaaaggctactggtgccttcatcttgacagcgagccataacccaggtggtcctaaggaggacttcgggatcaatacaacatggggaaatggtgggcctggctcctgaatctgttacccgacagattttctctaatacaacaacaatctctgaatacctcatctctgaagacct

SEQ ID NO: 16506 - protein, 147 aa, Zea mays
  misc_feature: Ceres CLONE 1380544-F
  misc_feature (16)..(148): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIRERVGADGSKATGAFILTASHNPGGPKEDFGINTTWGNGGPGS

SEQ ID NO: 16507 - DNA, 798 bp, Zea mays
  misc_feature: Ceres CLONE 1380545-F
  misc_feature: Encodes the peptide sequence at SEQ ID NO. 16508
  misc_feature (397)..(397): n is a, c, t, g, unknown, or other
ggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgcttactagagaagttgtgtggtgtccaagctacacacgggatgctactaactagctgcaggcaagggcgaggaatggccatcctttcatgtgctcgggcggactgtgttgtccgttacagagctctgcccgccaagctgntgctgtgcgccagctgctgcttccatacgggagtctcagtccgtggacggagaggtgcagtagcttgcctgacgccatgatcttcaccggttggccgagtgtccagaatatccgtggccagggcccgggccgatgggcatcctgcaaattgtcgggactccaacaataagccgggaaaagggcgggccttgtagcttgtcagggccggagtccacctccgggggccgaagattcctaagccggaccgcccctgaggcccccggccggggcttaaacgttggaaagttttccttaggccaaaagttgcaaattcccaaccttgtgcgggggaaaataaatctgggtttaccgaaggatgggcatcaagaagaccgttcacccaaagcactcctggcaggaag

SEQ ID NO: 16508 - protein, 59 aa, Zea mays
  misc_feature: Ceres CLONE 1380545-F
  misc_feature (34)..(34): Xaa is any aa, unknown, or other
MLLTSCRQGRGMAILSCARADCVVRYRALPAKLXLCASCCFHTGVSVRGRRGAVACLTP

SEQ ID NO: 16509 - DNA, 810 bp, Zea mays
  misc_feature: Ceres CLONE 1380546-F
  misc_feature: Encodes the peptide sequence at SEQ ID NO. 16510
  misc_feature (536)..(536): n is a, c, t, g, unknown, or other
  misc_feature (564)..(564): n is a, c, t, g, unknown, or other
ggagctccccgcggtggcggccgctctagaactagtggatcccccgggctgcaggaattcgcacgagaccattacctagaacatcctaatcgaaaaattgctctccaaccaaacctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtcccgggccggtcgggcaagtcgtgccgcctgcggtggtgcaaccagctgtcgccaagggtggcgcgccgccccttcacggccgacgaggacgcggncatcgcccgcgcccacgccccgctcggnaaccgctgggccgccatcgcgcgcctgctccccggccgaaccgacaacgccgtcaagaaccactggactgctccctcaagcgcaagctcggcgccgcgccgccgggcccgggttcgggcggtttccgctgaagactccgccgccgccgccgagaccgaggcgcgcccgggcaaaaaaagatgatgattgacatctcgcgcaaggccctccggggggggggggggggggggggggccccaaacaaag

SEQ ID NO: 16510 - protein, 143 aa, Zea mays
  misc_feature: Ceres CLONE 1380546-F
  misc_feature (12)..(58): Pfam Name: Myb_DNA-binding Pfam Description: Myb-like DNA-binding domain
  misc_feature (64)..(109): Pfam Name: Myb_DNA-binding Pfam Description: Myb-like DNA-binding domain
  misc_feature (74)..(74): Xaa is any aa, unknown, or other
MGAEAAERDRIRGPWSPEEDEALRRLVERHGARNWTAIGRGVPGRSGKSCRLRWCNQLSPRVARRPFTADEDAXIARAHAPLGNRWAAIARLLPGRTDNAVKNHWTAPSSASSAPRRRARVRAVSAEDSAAAAETEARPGKKR

SEQ ID NO: 16511 - DNA, 837 bp, Zea mays
  misc_feature: Ceres CLONE 1380547-F
  misc_feature: Encodes the peptide sequence at SEQ ID NO. 16512
  misc_feature (257)..(257): n is a, c, t, g, unknown, or other
  misc_feature (277)..(277): n is a, c, t, g, unknown, or other
  misc_feature (286)..(286): n is a, c, t, g, unknown, or other
  misc_feature (300)..(300): n is a, c, t, g, unknown, or other
  misc_feature (301)..(301): n is a, c, t, g, unknown, or other
  misc_feature (391)..(391): n is a, c, t, g, unknown, or other
  misc_feature (402)..(402): n is a, c, t, g, unknown, or other
  misc_feature (446)..(446): n is a, c, t, g, unknown, or other
  misc_feature (458)..(458): n is a, c, t, g, unknown, or other
  misc_feature (469)..(469): n is a, c, t, g, unknown, or other
  misc_feature (493)..(493): n is a, c, t, g, unknown, or other
  misc_feature (494)..(494): n is a, c, t, g, unknown, or other
  misc_feature (520)..(520): n is a, c, t, g, unknown, or other
  misc_feature (549)..(549): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (758)..(758): n is a, c, t, g, unknown, or other
  misc_feature (759)..(759): n is a, c, t, g, unknown, or other
  misc_feature (760)..(760): n is a, c, t, g, unknown, or other
  misc_feature (761)..(761): n is a, c, t, g, unknown, or other
  misc_feature (762)..(762): n is a, c, t, g, unknown, or other
  misc_feature (763)..(763): n is a, c, t, g, unknown, or other
  misc_feature (764)..(764): n is a, c, t, g, unknown, or other
  misc_feature (765)..(765): n is a, c, t, g, unknown, or other
  misc_feature (766)..(766): n is a, c, t, g, unknown, or other
  misc_feature (767)..(767): n is a, c, t, g, unknown, or other
  misc_feature (768)..(768): n is a, c, t, g, unknown, or other
  misc_feature (769)..(769): n is a, c, t, g, unknown, or other
  misc_feature (770)..(770): n is a, c, t, g, unknown, or other
  misc_feature (771)..(771): n is a, c, t, g, unknown, or other
  misc_feature (772)..(772): n is a, c, t, g, unknown, or other
  misc_feature (773)..(773): n is a, c, t, g, unknown, or other
  misc_feature (774)..(774): n is a, c, t, g, unknown, or other
  misc_feature (775)..(775): n is a, c, t, g, unknown, or other
  misc_feature (776)..(776): n is a, c, t, g, unknown, or other
  misc_feature (777)..(777): n is a, c, t, g, unknown, or other
  misc_feature (778)..(778): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (785)..(785): n is a, c, t, g, unknown, or other
  misc_feature (786)..(786): n is a, c, t, g, unknown, or other
  misc_feature (787)..(787): n is a, c, t, g, unknown, or other
  misc_feature (788)..(788): n is a, c, t, g, unknown, or other
  misc_feature (789)..(789): n is a, c, t, g, unknown, or other
  misc_feature (790)..(790): n is a, c, t, g, unknown, or other
  misc_feature (791)..(791): n is a, c, t, g, unknown, or other
  misc_feature (792)..(792): n is a, c, t, g, unknown, or other
  misc_feature (793)..(793): n is a, c, t, g, unknown, or other
  misc_feature (794)..(794): n is a, c, t, g, unknown, or other
  misc_feature (795)..(795): n is a, c, t, g, unknown, or other
  misc_feature (796)..(796): n is a, c, t, g, unknown, or other
  misc_feature (797)..(797): n is a, c, t, g, unknown, or other
  misc_feature (798)..(798): n is a, c, t, g, unknown, or other
  misc_feature (799)..(799): n is a, c, t, g, unknown, or other
  misc_feature (800)..(800): n is a, c, t, g, unknown, or other
  misc_feature (801)..(801): n is a, c, t, g, unknown, or other
  misc_feature (802)..(802): n is a, c, t, g, unknown, or other
  misc_feature (803)..(803): n is a, c, t, g, unknown, or other
  misc_feature (804)..(804): n is a, c, t, g, unknown, or other
  misc_feature (805)..(805): n is a, c, t, g, unknown, or other
  misc_feature (806)..(806): n is a, c, t, g, unknown, or other
  misc_feature (807)..(807): n is a, c, t, g, unknown, or other
  misc_feature (808)..(808): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (814)..(814): n is a, c, t, g, unknown, or other
  misc_feature (815)..(815): n is a, c, t, g, unknown, or other
  misc_feature (816)..(816): n is a, c, t, g, unknown, or other
  misc_feature (817)..(817): n is a, c, t, g, unknown, or other
  misc_feature (818)..(818): n is a, c, t, g, unknown, or other
  misc_feature (819)..(819): n is a, c, t, g, unknown, or other
  misc_feature (820)..(820): n is a, c, t, g, unknown, or other
  misc_feature (821)..(821): n is a, c, t, g, unknown, or other
  misc_feature (822)..(822): n is a, c, t, g, unknown, or other
  misc_feature (823)..(823): n is a, c, t, g, unknown, or other
  misc_feature (824)..(824): n is a, c, t, g, unknown, or other
  misc_feature (825)..(825): n is a, c, t, g, unknown, or other
  misc_feature (826)..(826): n is a, c, t, g, unknown, or other
  misc_feature (827)..(827): n is a, c, t, g, unknown, or other
  misc_feature (828)..(828): n is a, c, t, g, unknown, or other
  misc_feature (829)..(829): n is a, c, t, g, unknown, or other
  misc_feature (830)..(830): n is a, c, t, g, unknown, or other
  misc_feature (831)..(831): n is a, c, t, g, unknown, or other
  misc_feature (832)..(832): n is a, c, t, g, unknown, or other
  misc_feature (833)..(833): n is a, c, t, g, unknown, or other
  misc_feature (834)..(834): n is a, c, t, g, unknown, or other
  misc_feature (835)..(835): n is a, c, t, g, unknown, or other
  misc_feature (836)..(836): n is a, c, t, g, unknown, or other
  misc_feature (837)..(837): n is a, c, t, g, unknown, or other
gctctagaactagtggatcccccgggctgcaggaattcgcacgagaccattacctagaacatcctaatcgaaaaaggagatacagcgagcgagcgaccaaagccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatnctcgggggagatcatgcgcnttgcaccanccagaagcaccacnngccacctacgtcgccaactacaacaaggggcgctggagcagctttgacactggccgtctccaaggggcgacgccctcccgctgtcgtccnagctgcagggncgccatcaaagttcaacggggcggcggtcatggtgaaccatttncatctttctggnagaaacctcangccccattagcggaaggtggcggnngagcccgcctcatggggaaacttggnctgggccatcgatggagggatttttgggntcgttttgaggccacttgtaaaagaagaatgaatgcaagaggggctgcttacagggccgggaagggttggggtaacttgatagagcaaagttttcgtgacacgtacagatctcgggcagggcactggccctgtggatggctgacgaccggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16512 - protein, 124 aa, Zea mays
  misc_feature: Ceres CLONE 1380547-F
  misc_feature: SWISSPROT Homolog: EC 1.15.1.1 Superoxide dismutase
  misc_feature (51)..(51): Xaa is any aa, unknown, or other
  misc_feature (58)..(58): Xaa is any aa, unknown, or other
  misc_feature (61)..(61): Xaa is any aa, unknown, or other
  misc_feature (66)..(66): Xaa is any aa, unknown, or other
  misc_feature (96)..(96): Xaa is any aa, unknown, or other
  misc_feature (100)..(100): Xaa is any aa, unknown, or other
  misc_feature (114)..(114): Xaa is any aa, unknown, or other
  misc_feature (122)..(122): Xaa is any aa, unknown, or other
MALRTLASKKVLSFPFGGAGRPLAAAASARGVTTVTLPDLSYDFGALEPAXLGGDHAXCTXQKHHXPPTSPTTTRGAGAALTLAVSKGRRPPAVVXAAGXPSKFNGAAVMVNHXHLSGRNLXPH

SEQ ID NO: 16513 - DNA, 778 bp, Zea mays
  misc_feature: Ceres CLONE 1380548-F
  misc_feature (519)..(519): n is a, c, t, g, unknown, or other
  misc_feature (538)..(538): n is a, c, t, g, unknown, or other
gctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcggcgccagcctgcaggaagccagcccctattcgagacaaggtcgatctttgctgccttggcgagcttcagccgaatcaaggtcgagcatggcggcaggccagtaaatagagcaacacaaaacccttcaaattaatggagacctctgcagcaaccccggacccggccgcaacaccaggngggcacttcccatcgcatncgccctcgtgttcgctgaggggttgggaaggccaacgggcgcaccgcaactgcgcaaatcagtgggtcccatctgaccccgcccaaggaaagcagggcttggccccccttttgctgaaacgccgggcccacccctccggggttcggacaggtccaccttctcctgaggaaaatggcgaccaggtgggtgtttttgggggggtgctacaggggaatatgcccggggaaccccggaaaaggg

SEQ ID NO: 16514 - DNA, 796 bp, Zea mays
  misc_feature: Ceres CLONE 1380552-F
  misc_feature (483)..(483): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgtctggcggacgacgacacatgtggaagggtattgtgagtgcatcatgatgagcgttcctcctgctcgccggcgtgctgctggtcgtagcagccacggtcggggcggaggacggagtgctcaaacgggaccgcaaggaggacctgcgctgtgcaagcaggcgtgcgagtggcagtacggaaaggacacccgcgaaagagggaatgttagagcgagtgccgcgagcggcaccagctagctgactcggacgtagacggcgacagcgttgtggacgcctacgtctcccgctccggnaaggagcgagtgccgttgccagtgcatgcgccgacacaaggccagcctttgggaaaccccagagtgcatgaaggggtgcccgcccccgcgaactgcccgtcaacatggaaacagaatacggttcgcggtaccaaaaacaccgttaatgtcccggaaaaggtgcaaacgcccccaaccccgggaaactggtggaaaaaagcaagccttccttgaagacctgaaaaaaccccggaaccgggaaaaaagaagggggaaaatccggggcccccttcccgccaagggggttggaaaaaacccggggaaccccttttcg

SEQ ID NO: 16515 - DNA, 721 bp, Zea mays
  misc_feature: Ceres CLONE 1380555-F
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (22)..(22): n is a, c, t, g, unknown, or other
  misc_feature (57)..(57): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (140)..(140): n is a, c, t, g, unknown, or other
  misc_feature (152)..(152): n is a, c, t, g, unknown, or other
  misc_feature (156)..(156): n is a, c, t, g, unknown, or other
  misc_feature (157)..(157): n is a, c, t, g, unknown, or other
  misc_feature (183)..(183): n is a, c, t, g, unknown, or other
  misc_feature (391)..(391): n is a, c, t, g, unknown, or other
  misc_feature (625)..(625): n is a, c, t, g, unknown, or other
ttttttttnnnnnnnnnngganggagaaaagagaaagagaggaaaaaggtaccgatnttggggggtggccccactccccaaaaagtacatgcccacatgcgtctccccgtcnnncccccaatttttttccaaaagctggnggactccaccgncggnntggcggcccgctctaaaactagtggnatccccccgggctgcaggaaattcgcacgagaccattacctagaacatcctaatcgaaaaacatattattgagaccaactagcaacatagaaagacaatagtgtaccaacaatggcagccaaaaattttgcctccttatgctcttggttttctgcagtgctgctacggcgacattttcccgcatgctcgcagctctatagctcccttnctccccgtactctcacaaggggggtcctccggaatgggaaaacccaattcttcaaccctaaggggatccaaagggggaaatcgcaagggggggaaactttaccccttaaacccccccctgggtcccccccaaaaaaaaatatttagccccccataaaaaaaaagggtccccttttgggggggatttattgggggcaaaaaaaaaaccggggggacaaaaaaaatttcccaacanttttttgggggggagaaaaaaaaaaccggggggggccacccccccccacaaaaaaaaaaggaggttttttctttctttttataaacacaacaaggg

SEQ ID NO: 16516 - DNA, 752 bp, Zea mays
  misc_feature: Ceres CLONE 1380563-F
  misc_feature: Encodes the peptide sequence at SEQ ID NO. 16517
  misc_feature (577)..(577): n is a, c, t, g, unknown, or other
  misc_feature (604)..(604): n is a, c, t, g, unknown, or other
  misc_feature (636)..(636): n is a, c, t, g, unknown, or other
  misc_feature (645)..(645): n is a, c, t, g, unknown, or other
tccccgcggtggcggccgctctagaactagtggatcccccgggctgcaggaattcgcacgagaccattacctagaacatcctaatcgaaaagcgtttgttctcctgttcatcacccgtgcgtgctctctctctctctctctctctctctcgtgcggcaactgcgaggccgccgacgcccgacggcagggtgcccaggccttcttcggtcccatcgcgaggccatagttgcatcattcgcctgagacgactgcccagcaccaggactgatctcctcactaggggcgtagaggtgaagagaagaacttgacaatgagcagcataggcacaggttacgatctgtctgtcaccaccttctccccagatggtcgcgtcttccaggtcgaatatgctaccaaggccgtcgacaacagcgggactgttgttgggatcaagtgcaaagatggcattgtcctgggtgttgagaagctggtaacctcaaagatgatgctggaagggtcaaaccggaggatccattcagtgcaccggcactctgacttggctgttgctggtttagcagcagatggcaggcaaattggnttcaggacgaagtcagaagctgccagntatgaaaaggtctatggagaacccattcctgntaaggaaantgcctgatcgcgtggcaaagtatgttcatctttgcacgctgtactggtggctccagccttttgggctgcggcggtaattcttggaggttaatgataagaatggggcc

SEQ ID NO: 16517 - protein, 113 aa, Zea mays
  misc_feature: Ceres CLONE 1380563-F
  misc_feature: SWISSPROT Homolog: EC 3.4.25.1 Proteasome endopeptidase complex
  misc_feature (98)..(98): Xaa is any aa, unknown, or other
  misc_feature (109)..(109): Xaa is any aa, unknown, or other
  misc_feature (112)..(112): Xaa is any aa, unknown, or other
MSSIGTGYDLSVTTFSPDGRVFQVEYATKAVDNSGTVVGIKCKDGIVLGVEKLVTSKMMLEGSNRRIHSVHRHSDLAVAGLAADGRQIGFRTKSEAAXYEKVYGEPIPXKEXA

SEQ ID NO: 16518 - DNA, 833 bp, Zea mays
  misc_feature: Ceres CLONE 1380567-F
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (235)..(235): n is a, c, t, g, unknown, or other
  misc_feature (236)..(236): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (248)..(248): n is a, c, t, g, unknown, or other
  misc_feature (249)..(249): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (257)..(257): n is a, c, t, g, unknown, or other
  misc_feature (259)..(259): n is a, c, t, g, unknown, or other
  misc_feature (260)..(260): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (283)..(283): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (292)..(292): n is a, c, t, g, unknown, or other
  misc_feature (294)..(294): n is a, c, t, g, unknown, or other
  misc_feature (295)..(295): n is a, c, t, g, unknown, or other
  misc_feature (301)..(301): n is a, c, t, g, unknown, or other
  misc_feature (304)..(304): n is a, c, t, g, unknown, or other
  misc_feature (311)..(311): n is a, c, t, g, unknown, or other
  misc_feature (312)..(312): n is a, c, t, g, unknown, or other
  misc_feature (315)..(315): n is a, c, t, g, unknown, or other
  misc_feature (323)..(323): n is a, c, t, g, unknown, or other
  misc_feature (332)..(332): n is a, c, t, g, unknown, or other
tggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgagggcaagcagagggggtcctgcggcgnnnnnnnnnnnnnngnntcnnnntnnnanngnnnnncngnntnnnnnnncgnnncnnnnnnatntnnnnnctncnntctatntgncgtctcnncancaaccgcncccttggcnataccccagtcgaccaccgcacctaggacccgtgcccacaggggcggatcctgcgactgtcggcagtcgccggaagccccccccctgttgccagagcgaagagtttcctgaggcaccagtggatcccggcgggggacaaccctacggttcgtccacgtggcctggtgcttgacgaaccattgctgtcttccaaatcacggcaggtaaagccgtgggcaccggaaacagaggggccgcacgcccgtggtcctggcagcccttcctgcatcacgaagcccacaggcgtcgctcccccggagctccttgcccccccgaggcaccgcaagaaaaaggacgaaaatgggtccgacgtggaactgaaaggtgccgagcccctgccccttgcaaagcccctgccccccctggaactacaacggaagaaactttggcccttgtaccaaatagcgaggggactccccttactaggtaccctagtccggctgtaatagccgttttaggggg

SEQ ID NO: 16519 - DNA, 788 bp, Zea mays
  misc_feature: Ceres CLONE 1380569-F
  misc_feature: Translation starting site: 190
  misc_feature: Pfam Name: Vicilin_N Pfam Description: Vicilin N terminal region
  misc_feature (775)..(775): n is a, c, t, g, unknown, or other
tggagctccccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacgccgccaccactacgatcgacctctcctccgacgagagccgccgccgcctcctcaataggttggtgtaccggagcaagcaggcagcagtgcgtccaggcttgcgagcgccggcgacagcagcgcggcggcagccgtgactccaacgtcgacgaggacgacagcgaccggcggtgccagatgaaatgccggcgccacagcgatcggcaggcgaggcagtggtgcgtgcagcgctgcgagcgtaagcaacaggaggaggacgccgccgccgacgacgacaacagcggccggtgccagaagagatgccagcaccacagcgatcggcaggcgaggcagtggtgcgtgcagcgctgcgagcgtaagcacagggagacgccgccgccgacgacgacgagaacagcgaccggtgccagaaagatgccagcagcacagcgactggatgaaaangctgcgttgcatg

SEQ ID NO: 16520 - DNA, 723 bp, Zea mays
  misc_feature: Ceres CLONE 1380571-F
  misc_feature: Encodes the peptide sequence at SEQ ID NO. 16521
ccccgcggtggcggccgctctataactagtggatcccccgggctgcaggaattcgcacgagaccattacctagaacatcctaatcgaaaaattcaggagggccaccgtacgcagcgagaccagccagcaggcggcgatgttcgcgacggcggtgcggtgggcggccaagaaggggaagcccaagatggcgccgatcgagctgacggcgccgccggagcaggcgcagtccatcacgcgcgccatcttcgacgccgtccgggagcacggcccgctcaccgtctccgacgtctgggaccacgtcaaggatgtcgggcttcgaggtctggcaagcaagaggcagatgaagatcatgctgcggtggatgagggagcgccagaagctaaagctcatctgcgaccacgacggcccgcacaagcagttcctctacaccacctggtttaccaaccccaggaacgcgccgcagaggcccaatccgaagcccaatgtcaaagcggataagctcccccaccttcccttccccttcgaagccactgtgacgaggatttgtttctgtgctctctgcacttgtttctgctgccccgacctaatgttcagcaccgaaacaaatgctagatttgttcaggcgaatttaggcttgttatggctatattgtcctatggaaacccctagttgctgcctatgcttatttgaaccttattacttggaatgcataccccaagggtg

SEQ ID NO: 16521 - protein, 195 aa, Zea mays
  misc_feature: Ceres CLONE 1380571-F
MFATAVRWAAKKGKPKMAPIELTAPPEQAQSITRAIFDAVREHGPLTVSDVWDHVKDVGLRGLASKRQMKIMLRWMRERQKLKLICDHDGPHKQFLYTTWFTNPRNAPQRPNPKPNVKADKLPHLPFPFEATVTRICFCALCTCFCCPDLMFSTETNARFVQANLGLLWLYCPMETPSCCLCLFEPYYLECIPQG

SEQ ID NO: 16522 - DNA, 952 bp, Zea mays
  misc_feature: Ceres CLONE 1380575-F
  misc_feature: Encodes the peptide sequence at SEQ ID NO. 16523
  misc_feature (1)..(1): n is a, c, t, g, unknown, or other
  misc_feature (9)..(9): n is a, c, t, g, unknown, or other
  misc_feature (35)..(35): n is a, c, t, g, unknown, or other
ncccccccncccccccccccccccccaattgtttnaacattcttcaaaagctggagctccaccgcggtggcggccgctctagactagtggatcccccgggctgcaggaattcgcacgagaccattacctagaacatcctaatcgaaaaatcaaatcgccaccgaaaattccccccaaaaaacaataagcaattgttcatcatcgtcatagtaatcacagcagaaccctagtgcggcgttcctccgacgactcacatcccacccactcgcccaccccatggcgtgcaggctctccaccagcgccgacgtcgcggtctcggtgcgggtctccgcaccagcggaggcggctgcgatccagccctcctccccgcgcttcttcttctcatcgctgggcgagaccaacccggcctccccgaatggagggatcgcccttggcgtcgatatctccgacgagtccgccttcgccggcaagggtgacgtggaacagctacctccgcccccggggacgccgtcgtggttctccccccggggccccacctccggatttcttaccgcggccggaggggggggttccctccccggggctcccggccgctggaggaaggcccggaagcttgctggaggaagggcgtgcgggccggcgggccggggggaccgagcccccttcggagaggaagggggtttgggagaagtcaagcgggcgagggagagaaataaccccggggccttgcaccctttaaccgggggcgggcaagaacccgccggggagagtcggcttgggcggaagggaccctgatcccccttttaagagatccaggggcgcgttaagggaccccggaaacggggaggggaaggccccttttgccctccgagggttaagcccccttggcccgtgcgcgcctaatgaacatggccgcaccccccgggtcttggggcccctccccgggagggca

SEQ ID NO: 16523 - protein, 172 aa, Zea mays
  misc_feature: Ceres CLONE 1380575-F
MACRLSTSADVAVSVRVSAPAEAAAIQPSSPRFFFSSLGETNPASPNGGIALGVDISDESAFAGKGDVEQLPPPPGTPSWFSPRGPTSGFLTAAGGGGSLPGAPGRWRKARKLAGGRACGPAGRGDRAPFGEEGGLGEVKRARERNNPGALHPLTGGGQEPAGESRLGRKGP

SEQ ID NO: 16524 - DNA, 717 bp, Zea mays
  misc_feature: Ceres CLONE 1380577-F
  misc_feature: Encodes the peptide sequence at SEQ ID NO. 16525
  misc_feature (641)..(641): n is a, c, t, g, unknown, or other
tggagctccccgcggtggcggccgctctagaactagtggatcccccgggctgcaggaattcgcacgagaccattacctagaacatcctaatcgaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgccaccggcaccaccgcctcctaagccattcaccagtgaggaccgcccggtcgagcatcgcgcccgcctgcgccgcgtgttccctgcggccgaggaggacgaagaggaggacagggtgcacgccatgatggtcgacggcgcgctccctccctcccgttcggacgcggacactgcgggcccgcccagaatgcatatcagtgccaatggtgaggtctccaaggccgcgcgtcctggagttgcgctcaacttcgagagctccgtgcgaactgacgagatgcaggtgtgcagcgtctttccggtacgacacggtggtcctgcaccagtgcancatacgtccgccgcgaattgagcattcgaaggacactgctcccgctcagacttgcaatcagcacgtgggaatcgat

SEQ ID NO: 16525 - protein, 176 aa, Zea mays
  misc_feature: Ceres CLONE 1380577-F
  misc_feature (170)..(170): Xaa is any aa, unknown, or other
MALARRLLRLTPYLGTLSLPPPNSHLLRNRTYISDMRRSAFVDRLLRSVRSEISFLDNSAPPPAPPPPKPFTSEDRPVEHRARLRRVFPAAEEDEEEDRVHAMMVDGALPPSRSDADTAGPPRMHISANGEVSKAARPGVALNFESSVRTDEMQVCSVFPVRHGGPAPVXHTSAAN

SEQ ID NO: 16526 - DNA, 762 bp, Zea mays
  misc_feature: Ceres CLONE 1380582-F
  misc_feature: Encodes the peptide sequence at SEQ ID NO. 16527
aagctggagctccccgcggtggcggccgctctagaactagtggatcccccgggctgcaggaattcgcacgagaccattacctagaacatcctaatcgaaaaattttaggagatcgcggtacgtccctccctatccagagatataggaccggagactctcctactgcatatccctagctctcgtcggctcgttcgctatatctcctccccgaaccagcccgagtcgaggagagcgcagctctatccggagctgggatgtcgcacgcgaaggatcagcagcagcaaccactacaggcggcagcgacagccaccggcaagtgcaagacggtcaagcccttcggtaacggcacgcgctctgggatgcttgtgaccctgcgccataccacgcgatcgacgtgggacaaggagaggataccaatatggatcgaggggcttcccgctggcaaggacccacggaacaatgttttgcaaatgaaggaggcgcgttctgccctacaagcatgtgtcctgccgggatggctgaggtaagcccaacgaaaacgactgatccaccttgaattcccatggggttattaaataaacaaagtagcctgaaaaacaaatgaagggggagcaattgggcgtctaattcaagagagctttttaatgcctatgaaatggtgggagtaaacttggtgtcttgatttttaagagaaccatggctgattcgggcacagtcattaaagatggttatgccccaatgctaccccttggaaaattggca

SEQ ID NO: 16527 - protein, 90 aa, Zea mays
  misc_feature: Ceres CLONE 1380582-F
MSHAKDQQQQPLQAAATATGKCKTVKPFGNGTRSGMLVTLRHTTRSTWDKERIPIWIEGLPAGKDPRNNVLQMKEARSALQACVLPGWLR

SEQ ID NO: 16528 - DNA, 737 bp, Zea mays
  misc_feature: Ceres CLONE 1380583-F
  misc_feature: Encodes the peptide sequence at SEQ ID NO. 16529
aagctggagctccccgcggtggcggccgctctagaactagtggatcccccgggctgcaggaattcgcacgagaccattacctagaacatcctaatcgaaaaacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatccctacgtccgccgccggtccagcccgtgatcgtcgtccagggcgtcatctactgcaagtcctgaagctcagggggtacaacagcgggatggacgcgtcccctctccccaatgcgacggcgagcctggggtgctaccgccacccggaaaagcagtacggggtggttaaccaaacaaaaacgggcccccaaaccgaaggggtacttcttggggagggtggccaaatggggaatttttcaaccgccccaaatttaggggtttttaacctccgctccctcttcaaaaggggttttggggcccggcccttttattccgggcaacccccagtggggggcttccccccctggggggaacacgggggccaa

SEQ ID NO: 16529 - protein, 75 aa, Zea mays
  misc_feature: Ceres CLONE 1380583-F
MASLKDHCAVVAVVVAICFVVLAAALPSHASTAVDEPAKYKPSRAPAPSPASASSLRPPPVQPVIVVQGVIYCKS

SEQ ID NO: 16530 - DNA, 746 bp, Zea mays
  misc_feature: Ceres CLONE 1380586-F
tggagctccccgcggtggcggccgctctagaactagtggatcccccgggctgcaggaattcgcacgagaccattacctagaacatcctaatcgaaaaatcgatcggcaatgcaagtttgtccattcgcattggtctgaatactgtatctactatcgcgagtgccactgtgccgcagctgcctgctcgccattactgcaagctgtgttcaatcaaagcttaattaggctccctctacatctgatccagctaagtagctagccagcactacagaagggcgtgacaagaatctcgagagagatagcaggggggctagctagctgagctcgtgcgacgaagaatggccggaattggaaggaacatgctgacgccgctgctggtgatcaccctcatcatgtacatcatcgacatcgacttcgcgagctggaccctgacccacttcatcgacgggggagaccaactaccccggcgagggcggcaacggcgcggacgttctacttcctggggttcaccatcctggcccggagtgttggggcgcgtcatccaaaatttgcggggagtgcacccacgtgcaccccctggccgccacctaaagcttgaacaaccaaacgcccccgttctccccttaattcaccttgagcccatcaaggggtgtttccccctttcgtgctgggcctcgccagggaaaattccctattcatgtggaaaacccgccggcttggaccgcctgcccccgtggattataaag

SEQ ID NO: 16531 - DNA, 680 bp, Zea mays
  misc_feature: Ceres CLONE 1380588-F
  misc_feature: Encodes the peptide sequence at SEQ ID NO. 16532
  misc_feature (337)..(337): n is a, c, t, g, unknown, or other
  misc_feature (338)..(338): n is a, c, t, g, unknown, or other
  misc_feature (409)..(409): n is a, c, t, g, unknown, or other
ggagctccccgcggtggcggccgctctagaactagtggatcccccgggctgcaggaattcgcacgagaccattacctagaacatcctaatcgaaaaaaaaaaaccctagaactccaaaaccttcagccccacgctatggccctcgcactgcgcctccgtcgggtcctcgcggcggcctccaccgcggcacccctgctccgcccgtccacctcggtcgcccggccttgcccgctcgttcccctcgcctccccggtcgcgccgctcccgctgccgccgtggcgattcctgcccggcggcggcgccgggttcaggtccacggcggcggcggctgcgcggnngcggaccgactatgggacggacgacagcaagatctcccccgacgagatcctcttcgagggctgcgactacnaccactggctcatcaccatggacttcccggacccaaagcgtcgcgcgaagagatgatcgagactacctccagactctcgccaaggtcgtcgggagttatgaggagggccagaaaaaggatgattgcttttagaccacgacttaaggtgggttttcgggctggaatgaccggaggaaagggcaaaaaaaatttccccggtttgcccgggaaaaaattttcattttgcccgggatcaatccaatatcccaaaaaaagggggggtccggggggg

SEQ ID NO: 16532 - protein, 109 aa, Zea mays
  misc_feature: Ceres CLONE 1380588-F
  misc_feature (68)..(68): Xaa is any aa, unknown, or other
  misc_feature (92)..(92): Xaa is any aa, unknown, or other
MALALRLRRVLAAASTAAPLLRPSTSVARPCPLVPLASPVAPLPLPPWRFLPGGGAGFRSTAAAAARXRTDYGTDDSKISPDEILFEGCDYXHWLITMDFPDPKRRAKR

SEQ ID NO: 16533 - DNA, 696 bp, Zea mays
  misc_feature: Ceres CLONE 1380595-F
  misc_feature: Encodes the peptide sequence at SEQ ID NO. 16534
  misc_feature (643)..(643): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
tggagctccccgcggtggcggccgctctagaactagtggatcccccgggctgcaggaattcgcacgagaccattacctagaacatcctaatcgaaaaaagtccggagcaagagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgccgccctctccgtcgtctcattcccgcacctgtccctcctcgcctcgtcccatccgctcccgcaggaagctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgttccccgcggagctcccgcggacgcggtggagccttcgcggtcggggggaaccccgaccccaaccaagggaaccgggaacgggaacccggggggggttaagggggcccaaaaattacgggccggccggggataagggggaacctacttcccggggccggggggggccggnttgaaaaatgggcctaaaaagggcggggnnnnnnnnnnnnnnnnnnnnnnnnn

SEQ ID NO: 16534 - protein, 139 aa, Zea mays
  misc_feature: Ceres CLONE 1380595-F
MASGAVPPQRVALLALAAALSVVSFPHLSLLASSHPLPQEAAAAAAGAAAGGEASEPHGTAADGAAVARRACTYTVQIKTSCAFPAELPRTRWSLRGRGEPRPQPREPGTGTRGGLRGPKNYGPAGDKGEPTSRGRGGP

SEQ ID NO: 16535 - DNA, 727 bp, Zea mays
  misc_feature: Ceres CLONE 1380602-F
  misc_feature: Translation starting site: 189
aaagctggagctccccgcggtggcggccgctctagaactagtggatcccccgggctgcaggaattcgcacgagaccattacctagaacatcctaatcgaaaaattcatcacccaccgcctccgccgccgatctctgcttactgtagtgtatttccggagagggttggttagagtagtagtgatccgcaatgtccactgaggaggctgttgtggctgaggtcccggtgaccgaggtgcctgcgaaggtcccggcggaccatgtggccgaggcgcccaaggtgaagaacgcgccctaggagaagaaggcgcctaaggacaagaagccgtccgcgtcgaagaatccggcggcgtaccctccctacgctgatgatgattgtataggcgatcgctgccctcaaggagatgaacgggtcgagctcggtcgccatcagcaagtacgacgaggggatgcacgtcggctagctccccaccaacttccgcaagcatctcaccgtgcagctgaagaagctcgctgccgccgtcaagctgacgaggctgaagaactccttcaagctgccggccaccgacgctcagcccaaggtcgtcaagaccaatgcacccaatgccgtagccaagcccaagccctcgtcgaaggcgatagccaagaccgctgctcagccccaaggcggagtcgcccaagcccagggccaagggcaaggtcatggccaaggccaagcctgtcgctcct

SEQ ID NO: 16536 - DNA, 716 bp, Zea mays
  misc_feature: Ceres CLONE 1380608-F
  misc_feature: Encodes the peptide sequence at SEQ ID NO. 16537
  misc_feature (527)..(527): n is a, c, t, g, unknown, or other
  misc_feature (632)..(632): n is a, c, t, g, unknown, or other
  misc_feature (697)..(697): n is a, c, t, g, unknown, or other
  misc_feature (716)..(716): n is a, c, t, g, unknown, or other
tggagctccccgcggtggcggccgctctagaactagtggatcccccgggctgcaggaattcgcacgagaccattacctagaacatcctaatcgaaaaaaactcaccctgcagccgccacctcatgaccctgcagcaccctcaggcctcaccgcctcagctgccaccctcaccctgcatccgagagagagagagaggagagttgccgccggagggaggaggtcgccgcggaggggaggggctcgccggtaggggacatcgccggcgcctggagagctcgtggaggggacagccaccgtcaccgccaggagacaagcgccgccgccgctaggaatcaggagacaagcgagcgcgatggtgagctccgcactgaggcgctgtctcccctgccatgcctctctctgtcatgccttccctccccatccgctgctggccgctgccggcgtcttccgtcgttcattccagtccggggatggtgagactatggacgaattcgaagaacggttgtttgggggcaaggacacagacnaaggatcactctacgagaagctcgatagggctgagaacactgcgacaggagcagttcaggatggatggatggttatgattcttttaatgatggcttaaatgatancattgctaatgcggcacgcaacatccaaatgtagggggacgaggacgtcgacggtgactgagagnatgactttgagtccaggcn

SEQ ID NO: 16537 - protein, 90 aa, Zea mays
  misc_feature: Ceres CLONE 1380608-F
  misc_feature (59)..(59): Xaa is any aa, unknown, or other
MVSSALRRCLPCHASLCHAFPPHPLLAAAGVFRRSFQSGDGETMDEFEERLFGGKDTDXGSLYEKLDRAENTATGAVQDGWMVMILLMMA

SEQ ID NO: 16538 - DNA, 742 bp, Zea mays
  misc_feature: Ceres CLONE 1380610-F
  misc_feature: Encodes the peptide sequence at SEQ ID NO. 16539
aaagctggagctccccgcggtggcggccgctctagaactagtggatcccccgggctgcaggaattcgcacgagaccatacccaaaacactcctaatcagaaaatcgcgaaagcgagcgcgaggcgagtcggccggcgaagggggcggatggcgcgcgggctgcgcggcgtccgcgacgacctatccgagctggggcgccacctgctcgacatcgcctgcttcctgcacccgctcctcaacccggcccacaccgactccccgccacccacccccacgggccgccgccgcccgcgccgctccccgtccccgcaccccgccgcgccgccgtcaccgtcgctcctcgcgggcatcctctccgacctcgccgagatcggcggctccttccgcggcggcttctcccgctcctcgccggagcccgaccaccccgcccccgacgcgctcgagtcacagcaggacgcctcgtccccgtccccgcgtccgcctcctcctgctgctgccgaccagatcgcatatgatgtcgtgagagcattgcgtgccctcgccgcgcggcccgaggcgtggatcgacttccccgtgctcgccctagatgaggggtctgcaatttctggtatcacagagatcatatggaatccattgaaaaacttgtcccagatttaccatctctagcgggcatgctctgtcctcttacatggatgatgactattctggaagatctactttagttgcttgagtcaacataaag

SEQ ID NO: 16539 - protein, 172 aa, Zea mays
  misc_feature: Ceres CLONE 1380610-F
MARGLRGVRDDLSELGRHLLDIACFLHPLLNPAHTDSPPPTPTGRRRPRRSPSPHPAAPPSPSLLAGILSDLAEIGGSFRGGFSRSSPEPDHPAPDALESQQDASSPSPRPPPPAAADQIAYDVVRALRALAARPEAWIDFPVLALDEGSAISGITEIIWNPLKNLSQIYHL

SEQ ID NO: 16540 - DNA, 740 bp, Zea mays
  misc_feature: Ceres CLONE 1380612-F
  misc_feature (669)..(669): n is a, c, t, g, unknown, or other
  misc_feature (740)..(740): n is a, c, t, g, unknown, or other
aagctggagctccccgcggtggcggccgctctagaactagtggatcccccgggctgcaggaattcgcacgagaccattacctagaacatcctaatcgaaaaaccaccactgggtcttcagaccattagctttatctactccagagcgcataagaacccgatcgacaccatgagggtgttgctcgttgccctcgctctcctggctctcgctgcgagcgccacctccacgcatacaagcggcggctgcggctgccagccaccgccggcggttcatctaccgccgccggtgcatctgccacctccggttcacctgccacctccggagcatctcccaccgccggtccacctgccgccgccggtccacctgccaccgccggtccatgtgccgacgccggttcatctgccgccgccaccatgccactaccctactcaaccgccccggcctcaggctcatccccagccacacccatgcccgtgccaacagccgcatccaagcccgtgccagctgcatgtaacctgcggcgatgacagcaccccgatcctgggccagagcgtctagttcctgaggcatcagtgcagcccgacggctacgccctactgctcgactcagtgccagtcggtgcggcagcagtgttgccagcagctcaggcaggtggatgcgcagcaccgntaccagacgatcttcggcttggtccctccagacatactgcagcagcagccgtgaagcgacaggtcgctcgn

SEQ ID NO: 16541 - DNA, 672 bp, Zea mays
  misc_feature: Ceres CLONE 1380617-F
  misc_feature (270)..(270): n is a, c, t, g, unknown, or other
  misc_feature (271)..(271): n is a, c, t, g, unknown, or other
  misc_feature (646)..(646): n is a, c, t, g, unknown, or other
  misc_feature (668)..(668): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcacaatggcggacgtgacgcagcgcatctaggcggcgccacgccactacggacacagcagcagcatggaggagcgnncgcccgatggtgagcagtgaaggcatgctcacgacaagggtcgacggcgtcaaggcgctgacgtggtgacgctgtcccgctgaacggctgctgctgtgctgtcaggcctgccctgcacgcctccgcgtggggctggcccgggacaccccggggttcctggtttcaggcccgggttcggccccgccggcttggtcaatgggaaggccggaatggggttccccccacccgggggggctggggccccggggaactttcccccctccccggggggcccccaaaaaaggggggggggaggggggtgtttttaaggggccccccccggagaatatattggggggaggggaaccccccccccccccccggtagggggggggngcccgcccccccgcgctcagcnaaag

SEQ ID NO: 16542 - DNA, 698 bp, Zea mays
  misc_feature: Ceres CLONE 1380619-F
  misc_feature (341)..(341): n is a, c, t, g, unknown, or other
  misc_feature (380)..(380): n is a, c, t, g, unknown, or other
tggagctccccgcggtggcggccgctctagaactagtggatcccccgggctgcaggaattcgcacgagaccattacctagaacatcctaatcgaaaaacaccacacgccagccagccatcgtcacactggtgagctctgcactctgcttagctccgagcttcagtgccttcgttgtttggtccacgcagtccacacacacacaccagtacgtccagctgcactgcaccaatggccgccgtcgaggtccaggtcccgactgccgctcccgtcgagtaggttgcccagctggccgccgcctccgccgtcgagatcccgaacgaggagaccgctgctccgccgntgaagaccgaagtcatactccctaaggaggcggtgccgncccgagcccgaaactgaatcccagggagtccaggtcgaggctgaagccaaggcccaagccgtaacttaagctgacccgaacgaggcaaacccaaggccgtttggccggcaaaaaaaagggaggccaagaaaacaaaaacggaggccccctttcccgcaaaaaaaaacgaagtttgtcgttgccccggtcaagggtttctaacccaaaaaaacccccccaaaacaaaaaagggggcgcttgtgggggcgttaacggggggaaggagagagggccccccccttgttttttcccccccccccgggggccccccacccaaga

SEQ ID NO: 16543 - DNA, 634 bp, Zea mays
  misc_feature: Ceres CLONE 1380621-F
  misc_feature: Encodes the peptide sequence at SEQ ID NO. 16544
  misc_feature (277)..(277): n is a, c, t, g, unknown, or other
ggagctccccgcggtggcggccgctctagaactagtggatcccccgggctgcaggaattcgcacgagaccattacctagaacatcctaatcgaaaaattcctcggagaggagaagccgccgtcgcagcaatcacagcagcccggagaacggccaggtccgacaagatgcagatctttgtgaagacgctgacagggaagaccatcaccctcgaggtcgagagcagcgacaccatcgacaatgtcaaggccaagatccaggacaaggaagggatcccgnccggaccagcagcggctggatcttttgccgggaaagcagctgggagggatgggccgcaacccctttggggactttaactccaaagggggctacctccactcggggtcaggtcccggggggatctttggcccccctgaggggtcccccccagtaaaccaggaaaaaagttttgcccaaagttttccccgtgcccccaagggtgtacctggcccaaaaaaaagggggccccccccccccgttggggccaaaaaaaaaaaaaaaaggggggggggggaaaaaattttataaaaaaaatttttttgtttggaaaccgtgtttttaacaaatttttttttttggtggtgaaccccccgtttt

SEQ ID NO: 16544 - protein, 62 aa, Zea mays
  misc_feature: Ceres CLONE 1380621-F
  misc_feature (38)..(38): Xaa is any aa, unknown, or other
MQIFVKTLTGKTITLEVESSDTIDNVKAKIQDKEGIPXGPAAAGSFAGKAAGRDGPQPLWGL

SEQ ID NO: 16545 - DNA, 838 bp, Zea mays
  misc_feature: Ceres CLONE 1380622-F
  misc_feature: Encodes the peptide sequence at SEQ ID NO. 16546
tggagctccccgcggtggcggccgctctagaactagtggatcccccgggctgcaggaattcgcacgagaccattacctagaacatcctaatccaaaaaggccctagcaagaaatccgtatcccgagtccggcgacggcagtatccgagctcgcactcgcgcacccgtccatcgcatcgcatctgtcctcccatcccctcagcgccaccgcaccgcagtcacacgcgcgccacccgcgatgacgccggcggcggtgatctccggctccagcagccacgtcgacgtctcctccgcccgcctcaggcagccgttcacgctcccctccgagcaccgattgcccaaatcgccggcgccgcctcgaccgtgaacccgccgcgagggtcgggggccgccccccgtgtctaagcccccgttgtggccccccgcccgcggcggaaaggaaggccaaaccagggctcctaaaagggatttccctttcaaaaacatttgaatttttgaccaagggataacacactgaatggaaaaatcccttaattccgcacccccatggaaagcttataggggatttggaataaaagtcctgggaaaaacaaaaagcctttcccaaaccgtttccaatggggaaaaacaaattggcggaattgactttttttggcacagcccatcaaaggggaggacccccggggttccctttctgaaaacgcggaattcctttcttcactggggagcggcaatgggaattttttttggggggccccagagaaatatcccgaatggcgccaaactttagaggagaaatcttcatgagggggacaaaaaacaactttcctaggctaaaa

SEQ ID NO: 16546 - protein, 42 aa, Zea mays
  misc_feature: Ceres CLONE 1380622-F
MTPAAVISGSSSHVDVSSARLRQPFTLPSEHRLPKSPAPPRP

SEQ ID NO: 16547 - DNA, 723 bp, Zea mays
  misc_feature: Ceres CLONE 1380623-F
  misc_feature: Translation starting site: 230
  misc_feature: SWISSPROT Homolog: EC 3.1.3.16 Phosphoprotein phosphatase
  misc_feature (350)..(350): n is a, c, t, g, unknown, or other
tggagctccccgcggtggcggccgctctagaactagtggatcccccgggctgcaggaattcgcacgagaccattacctagaacatcctaatcgaaaacccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccnggagtccctgctccgactgcagcagcgtcgccaccgccgacttcgagggcttcgccgacctcgcctccacgctcgtgctcgaagaactcgtctcccccgctccgcctccgcctccgcagttcgctccccgcctccgggcccaggggcgccaggagcggcttcgcgctcgactgcgtgccgcgctggggactccactccgtgtgcggccgacggcccgaaatggaggagccggcccgcgtgctcccaaccttctccacgtcccgttctggatgctcgccggcaacccgccctcgacggcctcgacgggaatcctcccgctccccgggaattcttcccgtttacgagggcacggggggcttcaggcccaaatacg

SEQ ID NO: 16548 - DNA, 691 bp, Zea mays
  misc_feature: Ceres CLONE 1380624-F
  misc_feature: Encodes the peptide sequence at SEQ ID NO. 16549
  misc_feature (691)..(691): n is a, c, t, g, unknown, or other
gctggagctccccgcggtggcggccgctctagaactagtggatcccccgggctgcaggaattcgcacgagaccattacctagaacatcctaatcgaaaaatatccgcatccgctgtatccgcctctcgagtctcgtccacccgacgtcctcctaggtccgctactcgacagccgacgtgggcaaaattatgatcggaatcaacggattcggaaggttcggccggatcgtgcacagggtccccctccagagcgaggatgtagagctcggcgacgtcaacgaccccttcatcaccacggactacatgccctacatgctcaggtaccacaccgtccgcggccactgtaaacattgcgacatcacactcttggactccaagacccttctcttcggtgacaagccgcccaccgtctttggcatcaggaaccctgaggaagtcccgtggctcgaggctggcgctgagtatgagttggatgccaccggcgtcttcactgaagacgacgacgctgctgacattctcatggatggtgccaaaaaggttgttatctctgcccctaggagacaggcacccatgtctgtagcctgagccgatgcagccaagtacccctcgaatgttaacattcgtctccatgtgtaactgcaccaggatctgcccttgccccccttgatcaaggctttcatgaattacttccn

SEQ ID NO: 16549 - protein, 131 aa, Zea mays
  misc_feature: Ceres CLONE 1380624-F
  misc_feature (2)..(129): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MIGINGFGRFGRIVHRVPLQSEDVELGDVNDPFITTDYMPYMLRYHTVRGHCKHCDITLLDSKTLLFGDKPPTVFGIRNPEEVPWLEAGAEYELDATGVFTEDDDAADILMDGAKKVVISAPRRQAPMSVA

SEQ ID NO: 16550 - DNA, 712 bp, Zea mays
  misc_feature: Ceres CLONE 1380632-F
  misc_feature: Encodes the peptide sequence at SEQ ID NO. 16551
tggagctccccgcggtggcggccgctctagaactagtggatcccccgggctgcaggaattcgcacgagaccattacctagaacatcctaatcgaaaactataattggctagctcccacatatgaactagtctctatcatcatccaatccagatcagcaaagcggcagtgcggagagaggatcgtcgaacagaacagcatgaagatggtcatcgttctcgacgtgtgcctggctctgtcagctgccagcgcctctgcaatgcagatgccctgcccctgcgcggcgctgcagggcttgtacggcgctggcgccggcctgaccacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcggtccgtcgcgcagcagctgcacatgatgatgcagcttgagcgtgccgctgccgccagcagcagcctgtacgagccagctctgatgcagcagcaacagcagctgctggcagcccagggtctcaaccccatgaccatgatgatggcgcagaacatgccggtcatgggtggactctaccagtgacagctgcccagctaccgcaccaacccctgtggcgtctgcgc

SEQ ID NO: 16551 - protein, 157 aa, Zea mays
  misc_feature: Ceres CLONE 1380632-F
MKMVIVLDVCLALSAASASAMQMPCPCAALQGLYGAGAGLTTMMGAGGLYPYAEYLRQPQCSPLAAAPYYAGCGQPSAMFQPLRQQCCQQQMRMMDVRSVAQQLHMMMQLERAAAASSSLYEPALMQQQQQLLAAQGLNPMTMMMAQNMPVMGGLYQ

SEQ ID NO: 16552 - DNA, 735 bp, Zea mays
  misc_feature: Ceres CLONE 1380633-F
  misc_feature: Encodes the peptide sequence at SEQ ID NO. 16553
  misc_feature (735)..(735): n is a, c, t, g, unknown, or other
gctggagctccccgcggtggcggccgctctagaactagtggatcccccgggctgcaggaattcgcacgagaccattacctagaacatcctaatcgaaaaatccatcgtcaatgcaagtttgtccattcgcataggtctgaatactgtagctactagcgcgagcgccactgtgccgcagctgcctgctcgccattactgcaagctgagtccgatccaaggctaattatgcttcctctagctccgctccaactaagtagctagccaccactacataagggcgtgcgaagaatcaggagagagatagctcccgggctagctagctgagctcgtgcgactaacagtgctcggaattgtcagaaacatgctggcgccgctcctggtgctcaacctcatcatgtacatcatcgtcatcggcttcgcgagctggaacctgaaccactgtctgctacgtcataccaactaccccgttcgagtacggcaacggcgcgacgttctacttcctggtgttccccatcctgaccggcgggattggcggcggcgtacaaacctggtgggcagtgaccaacgtgcgccgcctggttcccacaacagtcttggcccacaaacactgccgccgccggtaatggcctgggccatacccccgattcctccttcagggctggaactgcaaggagtatccccctcggccggaccccgcggctttgcgccctggaccgagcttgaagcgccttcctn

SEQ ID NO: 16553 - protein, 124 aa, Zea mays
  misc_feature: Ceres CLONE 1380633-F
MLAPLLVLNLIMYIIVIGFASWNLNHCLLRHTNYPVRVRQRRDVLLPGVPHPDRRDWRRRTNLVGSDQRAPPGSHNSLGPQTLPPPVMAWAIPPIPPSGLELQGVSPSAGPRGFAPWTELEAPS

SEQ ID NO: 16554 - DNA, 638 bp, Zea mays
  misc_feature: Ceres CLONE 1380635-F
  misc_feature (217)..(217): n is a, c, t, g, unknown, or other
  misc_feature (227)..(227): n is a, c, t, g, unknown, or other
  misc_feature (262)..(262): n is a, c, t, g, unknown, or other
  misc_feature (281)..(281): n is a, c, t, g, unknown, or other
  misc_feature (282)..(282): n is a, c, t, g, unknown, or other
acaagctggagctccaccgcggtggcggccgctctagaactagtggatcccccgggctgcaggaattcgcacgagaccattacctagaacatcctaatcgaaaaaaatcgcggttactgctccgaagtccgaaccttcatacacatcgtctcgtttccgatttccccaaattcaggccacaggcgctacaggacccaggcaccactcggtcggcggncaccgcgtcngcccgcctgctcgattggggtcgcgtgtgcgatangaagtattgtggtgtgttnngcacgtgatagcttgtactggggaacaaggtcaagatgggcggcttggacctaaccttgacttttgcttctggtcacatgggcaagccaagttaaaggaaatggccagagctcctttgtgcttgatgggaactcccatacggccagatcaatgggtcccacctgttgggctttggaaattttggaaaggggtaagggctatgggggggccccatataaaaaggggagtcgccaaaaaagttccttgggggaagggaatttttgtttgcggccccctggcccaggggaaaaaaaattccttttaaattggtaaaaaggggaggggggggctccccccccctggaggggggccaggtt

SEQ ID NO: 16555 - DNA, 475 bp, Zea mays
  misc_feature: Ceres CLONE 1380648-F
  misc_feature (239)..(239): n is a, c, t, g, unknown, or other
  misc_feature (274)..(274): n is a, c, t, g, unknown, or other
  misc_feature (332)..(332): n is a, c, t, g, unknown, or other
  misc_feature (360)..(360): n is a, c, t, g, unknown, or other
tccccgcggtggcggccgctctagaactagtggatcccccgggctgcaggaattcgcacgagaccattacctagaacatcctaatcgaaaagagccagcatcttctttttccgtcccctcctgcagccgccgcccgccgagacgccaagcgcgagcgggaggagaccatgtcacggtggcgcgccgccgcctacagcatctccgcagctgccgcgtcccgcaactctgcggcgggaggnccgggcggcccctctccaggggccttgcggagggntccttcgccggcctttggttcccttcccaaacccctccgagaaaaaatttggcaaagncccgttcccgccgccccggaacaaattnccccccggccctggggggtttccccccccccccccccgtggggcccaggccccccaaaaattaaacgaggggagtttttttttttttttatttacccggccccgggtgttttttt

SEQ ID NO: 16556 - DNA, 649 bp, Zea mays
  misc_feature: Ceres CLONE 1380650-F
  misc_feature: Encodes the peptide sequence at SEQ ID NO. 16557
aaagctggagctccccgcggtggcggccgctctataactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagagcggagaccatgaacatgtgctccaagtgccacaaggagatgataacgaaccatgatcaggccaagctggctgcctcctctatcgacagcatcgtgaacggcagcgacgccgtcatggagccggttgttgctggcaccaacacggtagtagctgttgcccaagttgagttgcaaacaatgaacgtgcagcagaccgctgatgttgccggacccagcgagggggtggcggcgatctccaaaggggggatggtagggccgaaccggtgcagcgcctggaggaagagggttggacttacgggatctcactgacggtgtgcgaacttgtactgcgcactccaccgctactccga

SEQ ID NO: 16557 - protein, 128 aa, Zea mays
  misc_feature: Ceres CLONE 1380650-F
  misc_feature (14)..(38): Pfam Name: zf-A20 Pfam Description: A20-like zinc finger
MEHKEAGCQAPEGPILCINNCGFFGRAETMNMCSKCHKEMITNHDQAKLAASSIDSIVNGSDAVMEPVVAGTNTVVAVAQVELQTMNVQQTADVAGPSEGVAAISKGGMVGPNRCSAWRKRVGLTGSH

SEQ ID NO: 16558 - DNA, 637 bp, Zea mays
  misc_feature: Ceres CLONE 1380654-F
  misc_feature: Translation starting site: 141
  misc_feature: Pfam Name: Ldh_1_N Pfam Description: lactate/malate dehydrogenase, NAD binding domain
  misc_feature: SWISSPROT Homolog: EC 1.1.1.37 Malate dehydrogenase
  misc_feature: SWISSPROT Homolog: EC 1.1.1.27 L-lactate dehydrogenase
  misc_feature (532)..(532): n is a, c, t, g, unknown, or other
aagctggagctccccgcggtggcggccgctctagaactagtggatcccccgggctgcaggaattcgcacgagaccattacctagaacatcctaatcgaaaaacccaccaatccacagcgacacccgaccccgccgtcgtgatgaggccggcgctgctcaagtccacggccgagctcctccgccgcagccgcggctacgcctcctcggccaacccggagcggaaggtggccatcctgggcgctgcgggcggcatcgggcagccgctctccctcctcatgaagctcaacccgctcgtctcctccctctccctctatgatatcgccgggacccccggcgtcgcggccgacgtctcccacatcaactcccccgccctggtgaaggggttcatgggggacgaccagcttcgggaggcgctcgagggcttcgacgtcgtcatcatccccggcggggtgggccagaaaggccgggatggctaaggaacgacttcttcacattcacggccggattggttaagggctctgcactggcatcngccagcactgcccaaacgctcttgttcatatgatcagcaaccctgttaactccactgtcccgattgggcggcggaggttttcaagaaggctggtacttatgagcg

SEQ ID NO: 16559 - DNA, 610 bp, Zea mays
  misc_feature: Ceres CLONE 1380658-F
  misc_feature: Encodes the peptide sequence at SEQ ID NO. 16560
  misc_feature (406)..(406): n is a, c, t, g, unknown, or other
ggagctccccgcggtggcggccgctctagaactagtggatcccccgggctgcaggaattcgcacgagaccattacctagaacatcctaatcgaaaaatcacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatcntaacaatacaaccatcgcaaacgcacagcaaccacagttcctaccagcactgagcccactagccctggtggaccctgtccgctacttggcacagcagctgcttgcatcccaaccacttgctctaagcaacggtagtgcaaaccagcaacaaacacactgggcacagttctggcagcgcttagtcacctagcatggtgaccctgc

SEQ ID NO: 16560 - protein, 143 aa, Zea mays
  misc_feature: Ceres CLONE 1380658-F
  misc_feature (1)..(144): Pfam Name: Zein Pfam Description: Zein seed storage protein
  misc_feature (81)..(81): Xaa is any aa, unknown, or other
MATKILSLLALLALFASATNASIIPQCSLAPSSIIPQFLPPVTSMAFEHPAVQAYRLQQAIAASVLQQPIAQLQQQSLAHXNNTTIANAQQPQFLPALSPLALVDPVRYLAQQLLASQPLALSNGSANQQQTHWAQFWQRLVT

SEQ ID NO: 16561 - DNA, 589 bp, Zea mays
  misc_feature: Ceres CLONE 1380670-F
  misc_feature: Encodes the peptide sequence at SEQ ID NO. 16562
  misc_feature (221)..(221): n is a, c, t, g, unknown, or other
tggagctccccgcggtggcggccgctctagaactagtggatcccccgggctgcaggaattcgcacgagaccattacctagaacatcctaatcgaaaaaatcaatcaaaaaaaaagttcgttttctttctcaaaccctttctagcgatgtcaggttaccctccgacgagccaaggctacagttacggctacggcggtggaaatcaacctccccctcctcagncaccttactcctccaccggaaacaatcctccgacgagccaagggcacggttacggctacggcggcggaaacaatccttcgtacggatcatcatctccttacgctgtgccctacagggcgggcaaagcccaaatctcggctggtccttctggtccaacggacgcttcttctcctcctcccgggggacttccaacccgcgcaaaggaaaggctttctgggggggggtaacgagattctcccggccgctggggctttaagtggtggtcctccccgtgtcgggaggatacagaactggttccgccgaattcgaaaaaaggggggttaaggggcttgggccggtccttaacggggataaggagctgctgctcc

SEQ ID NO: 16562 - protein, 100 aa, Zea mays
  misc_feature: Ceres CLONE 1380670-F
  misc_feature (26)..(26): Xaa is any aa, unknown, or other
MSGYPPTSQGYSYGYGGGNQPPPPQXPYSSTGNNPPTSQGHGYGYGGGNNPSYGSSSPYAVPYRAGKAQISAGPSGPTDASSPPPGGLPTRAKERLSGGG

SEQ ID NO: 16563 - DNA, 624 bp, Zea mays
  misc_feature: Ceres CLONE 1380671-F
  misc_feature: Encodes the peptide sequence at SEQ ID NO. 16564
  misc_feature (484)..(484): n is a, c, t, g, unknown, or other
  misc_feature (509)..(509): n is a, c, t, g, unknown, or other
tggagctccccgcggtggcggccgctctagaactagtggatcccccgggctgcaggaattcgcacgagaccattacctagaacatcctaatcgaaaacccaacctcatcttctctccctttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctccgagtggagtcttctgacaccatcgancacgtccagggccagatccaggacnagggagggcatccctccgggacagcagcggctcatttttgctggcaagcagctcgaggacgggcgcacgctggccgactacaacattcagaaggagagcaccctccacttggggg

SEQ ID NO: 16564 - protein, 146 aa, Zea mays
  misc_feature: Ceres CLONE 1380671-F
  misc_feature (6)..(74): Pfam Name: ubiquitin Pfam Description: Ubiquitin family
  misc_feature (100)..(100): Xaa is any aa, unknown, or other
  misc_feature (109)..(109): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLRVESSDTIXHVQGQIQDXGGHPSGTAAAHFCWQAARGRAHAGRLQHSEGEHPPLG

SEQ ID NO: 16565 - DNA, 612 bp, Zea mays
  misc_feature: Ceres CLONE 1380673-F
  misc_feature: Encodes the peptide sequence at SEQ ID NO. 16566
  misc_feature (327)..(327): n is a, c, t, g, unknown, or other
  misc_feature (446)..(446): n is a, c, t, g, unknown, or other
  misc_feature (473)..(473): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (545)..(545): n is a, c, t, g, unknown, or other
  misc_feature (546)..(546): n is a, c, t, g, unknown, or other
cgcggtggcggccgctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctggcggcggcggaagctgaagccgaggccaaggatgagaagaaaggtgacgaggcggagctcaccgccgatgacgcngggggtggggaccggctcgttcaaggaggaaagcaacctggtggaagacctgcccgaccccggagaagaaaggcgctcgacgagttcaagcagctgatcgctgctgccctcgccggccnggtgagttcaacctgcctcccccgccngccgccgccgaaggccaaggaaacannnaggtggaggaagccaaggcccaggtgggctgggattgcccgggnnttggaggaggcaaggacggagggggccgccgggcccaaggaaggcccagggctgagaaccttgggg

SEQ ID NO: 16566 - protein, 38 aa, Zea mays
  misc_feature: Ceres CLONE 1380673-F
MAEETQPEAAAAAAPAAAEVVVTEAAPAEAEVPGGGGS

SEQ ID NO: 16567 - DNA, 672 bp, Zea mays
  misc_feature: Ceres CLONE 1380674-F
  misc_feature: Encodes the peptide sequence at SEQ ID NO. 16568
  misc_feature (398)..(398): n is a, c, t, g, unknown, or other
  misc_feature (399)..(399): n is a, c, t, g, unknown, or other
  misc_feature (482)..(482): n is a, c, t, g, unknown, or other
  misc_feature (488)..(488): n is a, c, t, g, unknown, or other
  misc_feature (510)..(510): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggatgcnnagagcgagtgccgcgagcggcaccagcaagctgacgcggggcgaggaacggcgaccagcggcgtgggacgcctacgtctccgnctcggnaaaggagggggagagtgcccgncgcccagtgcctgcgcccgccacgagggccaagcccgtgggagaacccaggagggccaatgaaggcggtgcccgccgcccgccggactgggccgtcgacatgggagccaaaggaaggtaaccggggtccccgcgggggccaagacccgaaagacggcggggg

SEQ ID NO: 16568 - protein, 120 aa, Zea mays
  misc_feature: Ceres CLONE 1380674-F
  misc_feature (64)..(64): Xaa is any aa, unknown, or other
  misc_feature (101)..(101): Xaa is any aa, unknown, or other
MGKGSVGASWWAFLLLAGVLLVVAATAGAEDGVVERDRKEDLRWCKQACEWQYGKDTPRKRDAXSECRERHQQADAGRGTATSGVGRLRLRLGKGGGECPXPSACARHEGQARGRTQEGQ

SEQ ID NO: 16569 - DNA, 618 bp, Zea mays
  misc_feature: Ceres CLONE 1380676-F
  misc_feature: Encodes the peptide sequence at SEQ ID NO. 16570
  misc_feature (408)..(408): n is a, c, t, g, unknown, or other
  misc_feature (409)..(409): n is a, c, t, g, unknown, or other
  misc_feature (458)..(458): n is a, c, t, g, unknown, or other
  misc_feature (506)..(506): n is a, c, t, g, unknown, or other
  misc_feature (507)..(507): n is a, c, t, g, unknown, or other
  misc_feature (541)..(541): n is a, c, t, g, unknown, or other
  misc_feature (542)..(542): n is a, c, t, g, unknown, or other
  misc_feature (582)..(582): n is a, c, t, g, unknown, or other
  misc_feature (606)..(606): n is a, c, t, g, unknown, or other
tccccgcggtggcggccgctctagaactagtggatcccccgggctgcaggaattcgcacgagaccattacctagaacatcctaatcgaaaaagatctagggttctctcgtgctctgttctcatcttctgctcgctggtgtcccctccctctcacccatggcttcggcggcggcggcaactcaggtggggacttacttcctgcggaactactacaacctgctgcaacaaacccccgatgtcgtccaccagttctacagcgaagccagcaccatggtccgcgtcgacgacctcaccggcacgaccgcggctgccaacaacatgatggacatacactcactcatcatgtctttgaacttcacccaaattgagatcaagactgccaattttgtgaactcatggggcgatggnngtgctagttatggtctcctggtctagtgcagaccaaggagtacagccancaaagggaatttattcagaatggtcttctttgccctcaagaggaaggnntaactttgtcctcaacgattactttctacttcgnntgaccagaacatgtgcagcctgcggccagtgattgctcangaagactacgagagcaatttggancccaccacagtt

SEQ ID NO: 16570 - protein, 92 aa, Zea mays
  misc_feature: Ceres CLONE 1380676-F
  misc_feature (85)..(85): Xaa is any aa, unknown, or other
MASAAAATQVGTYFLRNYYNLLQQTPDVVHQFYSEASTMVRVDDLTGTTAAANNMMDIHSLIMSLNFTQIEIKTANFVNSWGDGXASYGLLV

SEQ ID NO: 16571 - DNA, 657 bp, Zea mays
  misc_feature: Ceres CLONE 1380682-F
  misc_feature: Encodes the peptide sequence at SEQ ID NO. 16572
  misc_feature (234)..(234): n is a, c, t, g, unknown, or other
tccccgcggtggcggccgctctataactagtggatcccccgggctgcaggaattcgcacgagaccattacctagaacatcctaatcaaaaaacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaaggnaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggccggttccgggtcatcaccctcggctcctgcgttagcctcttcgggatgtgcctgctgtggctgacgccgatccttccggagtacaagacaaccccggagtgcgcgccggtgcggaccgatacgctgcggcgcgccgcctctgccacctgcccgctcctctttacgacgaacccaaccatgccgctggtgttgtcctctaccccccccgtccggctgcg

SEQ ID NO: 16572 - protein, 159 aa, Zea mays
  misc_feature: Ceres CLONE 1380682-F
  misc_feature (19)..(19): Xaa is any aa, unknown, or other
MEMSAMEEALPKAMERRKXGLRTIPFIILNEIFEKVATFGLSANMILYLTERYLMTNAFATVVLYFWHAFSNFLPILGAVLADARLGRFRVITLGSCVSLFGMCLLWLTPILPEYKTTPECAPVRTDTLRRAASATCPLLFTTNPTMPLVLSSTPPVRL

SEQ ID NO: 16573 - DNA, 680 bp, Zea mays
  misc_feature: Ceres CLONE 1380687-F
  misc_feature: Encodes the peptide sequence at SEQ ID NO. 16574
  misc_feature (457)..(457): n is a, c, t, g, unknown, or other
  misc_feature (534)..(534): n is a, c, t, g, unknown, or other
  misc_feature (535)..(535): n is a, c, t, g, unknown, or other
  misc_feature (545)..(545): n is a, c, t, g, unknown, or other
  misc_feature (560)..(560): n is a, c, t, g, unknown, or other
  misc_feature (567)..(567): n is a, c, t, g, unknown, or other
  misc_feature (604)..(604): n is a, c, t, g, unknown, or other
  misc_feature (627)..(627): n is a, c, t, g, unknown, or other
  misc_feature (654)..(654): n is a, c, t, g, unknown, or other
  misc_feature (655)..(655): n is a, c, t, g, unknown, or other
aagctggagctccccgcggtggcggccgctctagaactagtggatcccccgggctgcaggaattcgcacgagaccattacctagaacatcctaatcgaaaaatactccactccagtccccgcgctgcatccttccgcttcctctcgctccctctgctctctcgcgggcgcagtctcgcagatcccgatcgcgcaaggagccagcgtagagggtgatcgacgatggcgggcagcacgcgcgcagcgcacaaggcgttcctgctctgcaactacacgctgctgggtgcagcatcggcgtgcatcttcctcacgctctcgctccgcctcgccccgtccgcgtgcggcctgctcctcgtcttcctccacgcgctcaccgctgtcttcgccgccgcggactgctcgggctccttcaccgacggacggggccggggccggtcgcgcgcacgccggcacacagncgggggccgtgctcaccgccatcttccagggcgaccgccgcgctgctcgccttcacccggaccgccgacttcctagnncgagtggcgnacctacctaccgggnaagaggnaaacgggcgaggtcatttctcaatgctcatcggcgtngctcgggcaccggacatcttcgntgtgctcgaagaggggccgcgctatgnnggctcgcaattcgcgtccgggcttt

SEQ ID NO: 16574 - protein, 30 aa, Zea mays
  misc_feature: Ceres CLONE 1380687-F
  misc_feature (13)..(13): Xaa is any aa, unknown, or other
  misc_feature (22)..(22): Xaa is any aa, unknown, or other
MLIGVARAPDIFXVLEEGPRYXGSQFASGL

SEQ ID NO: 16575 - DNA, 665 bp, Zea mays
  misc_feature: Ceres CLONE 1380702-F
aaagctggagctccccgcggtggcggccgctctagaactagtggatcccccgggctgcaggaattcgcacgagaccattacctagaacatcctaatcgaaaagaaaggtagatattttttcccgtctcgctcaatgattcaccccatcgcagccatcgatcagaaaatttacggctcataattctcgtctgcttatccgctcccttctctccctcaacttcagcaagttccccgcaaaaccgcagccggaggtcgccggtcgccaccaccaatggggccacccgccatggcgttccaagccctcaccctcacgccactccccttctcactccacagctcgagccgccgcgtccgcgtgcttgccgttgcggccgaccagactcctccgcccgcccccccttcggagccggcgaacagccctagccgcctccttcgcgagctcgcgcagcggaagaaggccgtatcccctaagaagaagcatccgccgcgtcgcttcatcctgaagccacctctcgatgacaggctttaaaacccggggggtccctcgaggcccgggagttggccgctcaaggggctcccgctgctctcttcctgcctcccctccgcgccgttctccaccgccgagggaacctgggaatgaacgagacctcgtaagggggacagag

SEQ ID NO: 16576 - DNA, 640 bp, Zea mays
  misc_feature: Ceres CLONE 1380704-F
  misc_feature: Encodes the peptide sequence at SEQ ID NO. 16577
  misc_feature (622)..(622): n is a, c, t, g, unknown, or other
  misc_feature (626)..(626): n is a, c, t, g, unknown, or other
ggagctccccgcggtggcggccgctctagaactagtggatcccccgggctgcaggaattcgcacgagaccattacctagaacatcctaatcgaaaagtttctagttctagggtttaaagagctcgccgagcccgtcgtgcgccggcccagcaagagcccactactttccgccgtcgccatcgccggcgccgacctctccgtctccgcgcgcggcaatggcattctccttcgcttcgccgccagcttcgaaccccttccagacgccggctgcgtcgaatcccttccagacgccagctgcgtccaatccctttcagacgccggcggcgccgaatccgtttcagacaccgactccggccacctcacaggcgccgtccctatcgccctcgccgttccagttcagcttccagccgcagccgcagcagcagccacagcagcagcaggtggcgccggcggtgcaacctcagcagccgcagccacagcatcagaagctgatgctgtacacgacggatatgaaacccgctgggacaacaccaagtgggaggagctgcacgccgagtcgcagaaggctttgctccagatcgaggacaagatacgggactacagagacgagtggtgagagggntggnatcagtgcagtcgc

SEQ ID NO: 16577 - protein, 49 aa, Zea mays
  misc_feature: Ceres CLONE 1380704-F
  misc_feature (44)..(44): Xaa is any aa, unknown, or other
MLYTTDMKPAGTTPSGRSCTPSRRRLCSRSRTRYGTTETSGERXGISAV

SEQ ID NO: 16578 - DNA, 660 bp, Zea mays
  misc_feature: Ceres CLONE 1380705-F
  misc_feature: Encodes the peptide sequence at SEQ ID NO. 16579
  misc_feature (602)..(602): n is a, c, t, g, unknown, or other
  misc_feature (608)..(608): n is a, c, t, g, unknown, or other
  misc_feature (652)..(652): n is a, c, t, g, unknown, or other
aagctggagctccccgcggtggcggccgctctagaactagtggatcccccgggctgcaggaattcgcacgagaccattacctagaacatcctaatcgaaaagcacaaatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggttttcggcggttaggtcgcccctctcccggtggcgaattacgtggtggcggtggcggtccgtgttgtgttcttggtctagttaagtctgtgtggtcttaattcggggtgttttcttggggggggggttgtactgcnatcgtnctagtttcctagtcccatgtgctgtaataatctcgctgctgaancccaatgg

SEQ ID NO: 16579 - protein, 132 aa, Zea mays
  misc_feature: Ceres CLONE 1380705-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFRRLGRPSPGGELRGGGGGPCCVLGLVKSVWS

SEQ ID NO: 16580 - DNA, 662 bp, Zea mays
  misc_feature: Ceres CLONE 1380710-F
  misc_feature: Translation starting site: 167
  misc_feature (380)..(380): n is a, c, t, g, unknown, or other
  misc_feature (532)..(532): n is a, c, t, g, unknown, or other
  misc_feature (541)..(541): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (550)..(550): n is a, c, t, g, unknown, or other
  misc_feature (569)..(569): n is a, c, t, g, unknown, or other
  misc_feature (571)..(571): n is a, c, t, g, unknown, or other
  misc_feature (581)..(581): n is a, c, t, g, unknown, or other
  misc_feature (601)..(601): n is a, c, t, g, unknown, or other
  misc_feature (605)..(605): n is a, c, t, g, unknown, or other
  misc_feature (617)..(617): n is a, c, t, g, unknown, or other
aagctggagctccccgcggtggcggccgctctagaactagtggatcccccgggctgcaggaattcgcacgagaccattacctagaacatcctaatcaaaaagttagtagttcaccagagttcacacaaaaatcacaagcaagcagtcgcgtgtgtagctcgcaacaatggcgacgaaccccggcctcttcaccgagtggccgtggaagaagctcggcaacttcagtacctgctgctggcgccgtgggtggcgcacggcggctaccaagcgggaccaaaggggtggagggcggccgacctgggggtacgtggccatcctcccgtcgctgctcctccgggcgctgaccaaccaggcgtggatcaccgcgtcccgcctgcagnagcgcgcgcggccggcggcaggtcgtggaccgcggcatcgagttcgagcaggtggaccgcgagcgcaactgggacgaccagatcctgctcagcggcatcctcctgtacctgggctcccctacccttgccggggggccagcacctgccgctgnggcgcgcgnacgnnnccncgctcttcgccctgctgcncnccggccccgncgagctcggccactactggntgcnccgcgcgctgcnccacccctttctctactcccgctaccactcccaccaccacgcctc

SEQ ID NO: 16581 - DNA, 666 bp, Zea mays
  misc_feature: Ceres CLONE 1380713-F
  misc_feature: Encodes the peptide sequence at SEQ ID NO. 16582
  misc_feature (258)..(258): n is a, c, t, g, unknown, or other
  misc_feature (301)..(301): n is a, c, t, g, unknown, or other
  misc_feature (317)..(317): n is a, c, t, g, unknown, or other
  misc_feature (320)..(320): n is a, c, t, g, unknown, or other
  misc_feature (321)..(321): n is a, c, t, g, unknown, or other
  misc_feature (325)..(325): n is a, c, t, g, unknown, or other
  misc_feature (604)..(604): n is a, c, t, g, unknown, or other
tggagctccccgcggtggcggccgctctagaactagtggatcccccgggctgcaggaattcgcacgagaccattacctagaacatcctaatcgaaaaacttctcgttctcgccgatccagtgccactacactacaatactgctgcgcgctagcggtagcgctcgcgctcccactcgcaccacagcacgccaccgctgctgccggctcctccccgcgctcgcattgcgatttgcgacctagcgcgagggtaccgggggntggtgcgcggtgctccgtgatccgggaagcgccgcgagatggncgggggcggaaggcgncgnngccncgccgaagcacgacgacttcacgccgcaccccgtcaaggaccagctccctggggtctcctactgcatcaccagccctcccccgtggactgaagccgatcttcttggggtccaacattatctggtcatgcttggcaccactgtgatcataccaactgcacttgctccacacatgccaggaaaccatgaggacaaagcagtggttatccaagactttgctggttcgtagtaagctataaacacccctcatgcaaagaatcttcggctccgtgctgtcaggngctgtcctggcggtgtattatctttttgggccggccagccggccgaatagtactcgttgaca

SEQ ID NO: 16582 - protein, 33 aa, Zea mays
  misc_feature: Ceres CLONE 1380713-F
MLGTTVIIPTALAPHMPGNHEDKAVVIQDFAGS

SEQ ID NO: 16583 - DNA, 500 bp, Zea mays
  misc_feature: Ceres CLONE 1380719-F
  misc_feature (199)..(199): n is a, c, t, g, unknown, or other
ccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgntcaatcaaagcttaattaggctccctctacatctgatccagctaagtagctagccagcactacggaaggggcgtggcaaggaatcaggaaaagagatagccaggggggcctaacttaaacttaaaacccccccgccaccaaaaaaagggcccggaatttgcaagaacatttgtggcccccccctcccggggggccccccccccctagggaaactctccccacctccggtttccgggggttggaaccctgaaccccctttcttcacggggggaaccacacataccccccgggggggccggga

SEQ ID NO: 16584 - DNA, 580 bp, Zea mays
  misc_feature: Ceres CLONE 1380729-F
  misc_feature: Encodes the peptide sequence at SEQ ID NO. 16585
aaagctggagctccccgcggtggcggccgctctagaactagtggatcccccgggctgcaggaattcgcacgagaccattacctagaacatcctaatcgaaaagcctctgtatccgagcatactagcggatcctggcccgatccctcttcccacctacctccgcttctctccaagtgaggaaccccaagccctcgccatggcgtcgcggatcctggcccgatccaagtcccttcacctcgtcgccgccctcacccctgccgctgccaaagcagcaacgcctatcgccggagcccgcgcgctctcgtccctgccccgctacccgtctgccccgtcgccccatgggctcggcaaggttctggggatatggaaccaaccatctcacctcaggggggcccccaaggggttttacccccgcgggggggtttttccccccttaaacccagggggtccccgggggaaaaacccaaatttttgaaaaaaaaaggggggggggggaaaaaaaccctgggaaccccaaaaattggggggggccccccccccaaaggggggggggtcccccccaaaaaaaaaatattttata

SEQ ID NO: 16585 - protein, 92 aa, Zea mays
  misc_feature: Ceres CLONE 1380729-F
MASRILARSKSLHLVAALTPAAAKAATPIAGARALSSLPRYPSAPSPHGLGKVLGIWNQPSHLRGAPKGFYPRGGVFPPLNPGGPRGKNPNF

SEQ ID NO: 16586 - DNA, 592 bp, Zea mays
  misc_feature: Ceres CLONE 1380730-F
  misc_feature (95)..(95): n is a, c, t, g, unknown, or other
  misc_feature (109)..(109): n is a, c, t, g, unknown, or other
  misc_feature (110)..(110): n is a, c, t, g, unknown, or other
  misc_feature (120)..(120): n is a, c, t, g, unknown, or other
  misc_feature (121)..(121): n is a, c, t, g, unknown, or other
  misc_feature (286)..(286): n is a, c, t, g, unknown, or other
aagctggagctccccgcggtggcggccgctctagaactagtggatcccccgggctgcaggaattcgcacgagaccattacctagaacatcctaantcgaaaaataaatnnaacacacaannagttgtccgatcaaagcttgcgcgtttacaatgtctggacgatcaaggcacttcacaatgtccacccttctcgctacgagcttcttctttgtactcctatgcagctcgctacaagtacgtggcgtggaactacacgtttcgtgaaaagaaacgcggcggcttggncgcccccaagggggggcggaaaaaaaaaaaaattttcttttcggggggggggttgccccccggggccccctgtccccccccttgttgaagggctccccggggttgggtgggggggggggccccccccaaaaaaaaaacccccctggggaaagggccccccttccggaaaccatgttgggaaaacccccccgggggcccccccaaaattttttttttttgaaaaaaacatcctactaccaccccccccccccgggttctctggcccccccaaataaggagagaaatctcaccgcgggccccatacag

SEQ ID NO: 16587 - DNA, 648 bp, Zea mays
  misc_feature: Ceres CLONE 1380731-F
  misc_feature: Encodes the peptide sequence at SEQ ID NO. 16588
tggagctccccgcggtggcggccgctctagaactagtggatcccccgggctgcaggaattcgcacgagaccattacctagaacatcctaatcgaaaaaccctcccccatttttcccttggttggccgtcccctctcctcccatggcagccgcccaccatttcttcctcctccatagatctccccctcccccatgcagcaaggatcgagaagaggaggagcaagatggattgaagaggaagagaggatcaaggagatgttctacccccccatctattgcagattttcttggggaaactctaggtacttgattcatgttgggaatgaggggagtagcagcacgtccaccttcactctcataataacgctgcccaggcacaaccatgatttaattagaaacttcttgtcaaaggatgtttgtctttaactagtcatgcacactagttaattcaattcatgtcgttatggttatcttctcattgctagccgattattaatggctattatgttttcttatcatgatatctgcttatactctgttgcttccacgtttatgcaaattttcaaaggagatgctgtcaaaattttatatatgaatgttagttgtgtagtttagtagcatttcaggatgtttgtggatcctggggtgt

SEQ ID NO: 16588 - protein, 55 aa, Zea mays
  misc_feature: Ceres CLONE 1380731-F
MAAAHHFFLLHRSPPPPCSKDREEEEQDGLKRKRGSRRCSTPPSIADFLGETLGT

SEQ ID NO: 16589 - DNA, 653 bp, Zea mays
  misc_feature: Ceres CLONE 1380737-F
  misc_feature: Encodes the peptide sequence at SEQ ID NO. 16590
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (372)..(372): n is a, c, t, g, unknown, or other
  misc_feature (527)..(527): n is a, c, t, g, unknown, or other
gctctagaactagtggatcccccgggctgcaggaattcgcacgagaccattacctagaacatcctaatcgaaaaaacacaacaatctctctcccctcactccctctctgcagcgcgcagctttcaaagcgttgggagagatggcagaggagacgcaaccagaggccgcagccgccgccgcgcccgccgcggccgaggtagtcgtgaccgaagctgcgccggcggaggcggaggtgcctgcggcggcggaagctgaagccgaggccaaggatgagaagaaaggtgacgaggcggagctcaccgccgannngacgcgggggtggggaccggctcgttcaaggaggaaagcaacctggtggaagacctgcccgancccggagaagaaggcgctcgacgagttcaagcagctgatcgctgctgccctcgcccgccggtgagttcaatctgcctcccccgccgccgccgccgaaggccaaggaaacaaaggtggaggaagccaaggcccaggtggctgcggatgccccgggntgaggaggtcaagacggaggtgccgccgggccgaggagggcaaggctgagacactggctgaggaagccaagccttccgagcccgagccgcaggagaagaccggcgtggtcactgaggaggagactg

SEQ ID NO: 16590 - protein, 98 aa, Zea mays
  misc_feature: Ceres CLONE 1380737-F
  misc_feature (56)..(56): Xaa is any aa, unknown, or other
  misc_feature (57)..(57): Xaa is any aa, unknown, or other
  misc_feature (78)..(78): Xaa is any aa, unknown, or other
MAEETQPEAAAAAAPAAAEVVVTEAAPAEAEVPAAAEAEAEAKDEKKGDEAELTAXXTRGWGPARSRRKATWWKTCPXPEKKALDEFKQLIAAALARR

SEQ ID NO: 16591 - DNA, 604 bp, Zea mays
  misc_feature: Ceres CLONE 1380741-F
  misc_feature (148)..(148): n is a, c, t, g, unknown, or other
  misc_feature (171)..(171): n is a, c, t, g, unknown, or other
ggagctccccgcggtggcggccgctctagaatagtggatcccccgggctgcaggaattcgcacgagaccattacctagaacatcctaatcgaaaattaattaacaaagagaagacttcttccttcctcgtcgtctccagcccattccnaattcttgatcccatcgccccancatccacaactcccttaatctttccaactcctcgtcgtcccagtcaccacttcaagcgcaatggccaacggttaagggggacaacccaatacaaaggattcggttcatcccggaagggaatttcttaagccccctggggagttaacgggaaaaaaagggtttggggttcccggggaaaattcaaaacccgggagccccaccccgcccggaaaatcccggggccccaactttttttttttttaaagacatggcctccccgcttttttttggggggggaagggggggggccccccccacaaaaaaaaaaaaacttcccttgttttctggggggaaaaaaaaagagaaaaaaccccccccccaaaaaaaaaggggggggggttccccccccccccccaaaaaaaaattttttttttttttttttttttcccagaaa

SEQ ID NO: 16592 - DNA, 635 bp, Zea mays
  misc_feature: Ceres CLONE 1380742-F
  misc_feature: Encodes the peptide sequence at SEQ ID NO. 16593
  misc_feature (480)..(480): n is a, c, t, g, unknown, or other
  misc_feature (511)..(511): n is a, c, t, g, unknown, or other
  misc_feature (559)..(559): n is a, c, t, g, unknown, or other
ggagctccccgcggtggcggccgctctagaactagtggatcccccgggctgcaggaattcgcacgagaccattacctagaacatcctaatcgaaaactttctcgagcctgacccttacgccttcgctcgcgccgccgccgccgccgccgctacgccccgcacctcgcttcatttcgtgtcgccaagatgacgaagcgcactaagaaggcaggaattgttggcaaatatggaaccaggtatggtgctagcttgcgtaagcaaatcaagaagatggaggtatctcagcattccaagtacttttgcgagttctgtgggaagtttgctgtgaagaggaaagcagttggaatttgggggtgcaaggactgtgggaaggtgaaggctggtggtgcttacaccatgaacactgctagtgcggtcaccgtcaggagcacgatccgccgcctgagggagcagactgaagcatgatatagctctttatanttattggggtttcctgtagttgctcttgtcnagcatggttgtggggggccttatctagtggaaatgtggaatcctgggnacctggctgttttgccgagacatgctccctaaatatttgggttatgctcaaggaacccctcaaggttgtgttaaaa

SEQ ID NO: 16593 - protein, 92 aa, Zea mays; identical to SEQ ID NO: 7812
  misc_feature: Ceres CLONE 1380742-F
  misc_feature (2)..(91): Pfam Name: Ribosomal_L37ae Pfam Description: Ribosomal L37ae protein family

SEQ ID NO: 16594 - DNA, 742 bp, Zea mays
  misc_feature: Ceres CLONE 1380743-F
  misc_feature: Encodes the peptide sequence at SEQ ID NO. 16595
ctctagaactagtggatcccccgggctgcaggaattcgcacgagaccattacctagaacatcctaatcgaaaaaccaccaccactggacgccaccctagtaattagcacatcgactccagattggagaactcgacaccatgaaggcgctgatcgttgcccttgctctcctggagctcgctgcgagcgccgcctacagaacaagcggcgtctgtggctgccagacagcaccgtttcatctaccgcctccgttctatatgccggctccgatctatctggccgacgcagcagcagccctcaggcatggaaataccccaatcctaccaccgcatttaagcccgatgccaggatatcggagcctgaactgccacaagagtccagaggcccgctcctgggccaactgcctcgaggtttcctgaggctccagtggaatcccgggggggaacccccctaagcggtcgcccccagggcccgacgtggcagccacatggagtcccccccaataaagcgaggggaaaccctcttgacaccgatactcagggaaaaataacggggggggacccaggaagcccctttccatccaaaaacaatcgcagagggccaccttctccacgcatgttggggggcggcccccaaggaaggtccaaccaccctgaacagataccatgtggagaacctctcgagctgtgcaaaacaacaaggactccccccgccctgtaaaaaaacaacctcggcgccagggat

SEQ ID NO: 16595 - protein, 92 aa, Zea mays
  misc_feature: Ceres CLONE 1380743-F
MKALIVALALLELAASAAYRTSGVCGCQTAPFHLPPPFYMPAPIYLADAAAALRHGNTPILPPHLSPMPGYRSLNCHKSPEARSWANCLEVS

SEQ ID NO: 16596 - DNA, 587 bp, Zea mays
  misc_feature: Ceres CLONE 1380752-F
  misc_feature: Encodes the peptide sequence at SEQ ID NO. 16597
cgcggtggcggccgctctataactagtggatcccccgggctgcaggaattcgcacgagaccattacctagaacatcctaatcaaaaatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctgggagagtacctctcctccacccgcgccgaggtcggcgactttgcgacggaggcggacgaccagttcatgatgcgcgagttcaaggtgcggcggtgcgcgcgcgcgcgtagccacgactggaaggcgtgtccctacgaacacccgttggaggctgcgcgtcactacgacccccgacgcaaggcctgcctcaagcacccgggtccggtcctccccctccagccaacaaagaattcgggcccacctttcaacttgtgtgaacgaaaaaatat

SEQ ID NO: 16597 - protein, 125 aa, Zea mays
  misc_feature: Ceres CLONE 1380752-F
MVSRENLHLVLDPASLGAPWADPSAAEIPPQLLAALGEYLSSTRAEVGDFATEADDQFMMREFKVRRCARARSHDWKACPYEHPLEAARHYDPRRKACLKHPGPVLPLQPTKNSGPPFNLCERKN

SEQ ID NO: 16598 - DNA, 698 bp, Zea mays
  misc_feature: Ceres CLONE 1380759-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (37)..(37): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (265)..(265): n is a, c, t, g, unknown, or other
  misc_feature (291)..(291): n is a, c, t, g, unknown, or other
nnnnnnnnccccccccnnncccccccccccccccccntagaaatgtgggtttnnnnccaaagctggagctccccgcggtggcggccgctctagaatagtggatcccccgggctgcaggaattcgcacgagaccattacctagaacatcctaatcgaaaaacaagcgctagaactaggaacccctcccaaaggatctcaagaagacaaggacaccgtcgagtcgccgccagtcgctcgatggggtgcgggcagtcaaagatcgatncaggaggaggcggtgtttcgatgccngggagcggaagcctgctgatgggctgacgcccgtgaccttcacgggaagggccttttggccgccgcccacacagctggggagaaaagactcggggcccccctccgcaaaaagagccccgggcgtgggatggccgctacgcccgcagattcgcgcgccaacacaggcgcggaacatggcgcccttactcagccctcccggtgcgggggggcgggggagggggtttgtcaaggtccggccgttttagccgggtccccggcctcgctgcccgtccccccccgttgcccccggtgcggtgccagtgctacctcggtcccccgccgcgaggcaacccgcgccgcggtcgcgccccgcggcgcggcgcgcaaccgcccgccccaagcgcgcccccccaacgcgacacccgggg

SEQ ID NO: 16599 - DNA, 876 bp, Zea mays
  misc_feature: Ceres CLONE 1380761-F
  misc_feature: Encodes the peptide sequence at SEQ ID NO. 16600
  misc_feature (284)..(284): n is a, c, t, g, unknown, or other
ctcccttcctctttctccccagcgtccatccgcccaccgatacaaactggagctccccgcggtgggggccgctctagaatagtggatcccccgggctgcaggaattcgcacgagaccattacctagaacatcctaatcgaaaattgtgggtcctcacttccgcgccgccacccccttcaggtaaggaagaggaggagggcaggatggcgcaccgtaatttcgagcacccgaggcacggctccctcggcttccttcccaggaagcgctcctcccgccaccgcggncagggggagtcattccccagggatgacccccagaagccttgccatctcactggcttccttgggtaacaggctggcaatggatcacattgtcccctgagggtcgagaaggcagggacccaactcccttaaaacggacactggcgaggagtggtacccccattggaatcccccccctcttggtcatgggtggggctcgtgggcattatgtgaaaaacttcccccggggggcctccgcgacactccaacctcgggtgtggggccccatattccttaaccgaaaaacgggagggaagaaaggctcctaaccaataaactgggtggcgagaagccaagaaagaagggcgttctccaccgaagccaaggcggcccgcaaaaattgaaaaaatgaattgccgggaaataaaagaggaatttccagtttggcaacttcttggaaaaatatgaaagaaaaacacggctctctcgtgtaatccgcgggccctttgggtccctatccccagaattatggtatacataccgagcgcttttgcaaataccataagaaaagccggcccccccggatggtggggaattcccaggccccaacgggggg

SEQ ID NO: 16600 - protein, 48 aa, Zea mays
  misc_feature: Ceres CLONE 1380761-F
MAHRNFEHPRHGSLGFLPRKRSSRHRGQGESFPRDDPQKPCHLTGFLG

SEQ ID NO: 16601 - DNA, 733 bp, Zea mays
  misc_feature: Ceres CLONE 1380766-F
  misc_feature: Encodes the peptide sequence at SEQ ID NO. 16602
  misc_feature (609)..(609): n is a, c, t, g, unknown, or other
  misc_feature (624)..(624): n is a, c, t, g, unknown, or other
  misc_feature (626)..(626): n is a, c, t, g, unknown, or other
  misc_feature (627)..(627): n is a, c, t, g, unknown, or other
  misc_feature (733)..(733): n is a, c, t, g, unknown, or other
tggagctccccgcggtggcggccgctctagaactagtggatcccccgggctgcaggaattcgcacgagaccattacctagaacatcctaatcgaaaaccgcagttcccacccaccaaaccaaactctcctccacaaccacaacctcccccgccgcccctcctcttctcggcttctcccctgccttgttcggccccaaaacggcaagagccgacgccagcaaaccctcgggttcgggagggaaggaaggcacgagcagtgcggctgcctacccgcagctaaccccaaacagcaacgtcgtagccgacgagagcctccgccacctacccaccaactcccgcccgtcgtcgcctccgcttgggttctcgtcgagcaggtggtgggcacctaccgcatccagccacagagagagagtgagccactgagccagggcggcaagggggagatgaagaagctgtaccagggcggcaaggggcggcgggtgcacccggcgccggctgacgcatcggcagccgtggcgctgccggccgccgtgctggccctggcgtccgcgctgacggccgaggagcaggaggtgctggcctacctcctgtcctgcggcggcgggcggnaccaccacgaaaacngnncgcgccgggggggcccaccgccggagatgggctgcccctgcttccggtggtacaagagactcctgggcgcgctgggaacgcgtcgcccaaccggcacctcatccan

SEQ ID NO: 16602 - protein, 96 aa, Zea mays
  misc_feature: Ceres CLONE 1380766-F
  misc_feature (56)..(56): Xaa is any aa, unknown, or other
  misc_feature (61)..(61): Xaa is any aa, unknown, or other
  misc_feature (62)..(62): Xaa is any aa, unknown, or other
MKKLYQGGKGRRVHPAPADASAAVALPAAVLALASALTAEEQEVLAYLLSCGGGRXHHENXXRRGGPPPEMGCPCFRWYKRLLGALGTRRPTGTSS

SEQ ID NO: 16603 - DNA, 627 bp, Zea mays
  misc_feature: Ceres CLONE 1380767-F
  misc_feature: Encodes the peptide sequence at SEQ ID NO. 16604
cgcggtggcggccgctctagaactagtggatcccccgggctgcaggaattcgcacgagaccattacctagaacatcctaatcgaaaaatccgtacgaactcttttatctgagagaccgaggcgcccgcggttctgctttccttccttgccccgttcacgagagaattttctggagtcttctactccaggatggttccgatggcgctgcaatggatgatcctgtcgtgcgtgttggcgatggaagctgcggtggctgcgctggtcacgctcccggtgccccgcgctgtgcggggacagatcggcgcgctcacgtccttgttcctgcagtccctgtccagtgtgatacccttcgccgccttccagatcctcgatctctactggaacaacgatcacagactgatgtgcacctcggagatttgcaccgccgaagagcgcattcgcttcgagaaatctatgtttaaagctcagagaaatgtcattctttgtgtttcagcatgtctcctttattggtgcatttatcgtattgtgaaattgaacaaggatattaaggctttggaagagaccgagaagcgcctcaaggaagagtagatctattgtgttgttagggtggctgttgtctgctcctgg

SEQ ID NO: 16604 - protein, 129 aa, Zea mays
  misc_feature: Ceres CLONE 1380767-F
MALQWMILSCVLAMEAAVAALVTLPVPRAVRGQIGALTSLFLQSLSSVIPFAAFQILDLYWNNDHRLMCTSEICTAEERIRFEKSMFKAQRNVILCVSACLLYWCIYRIVKLNKDIKALEETEKRLKEE

SEQ ID NO: 16605 - DNA, 880 bp, Zea mays
  misc_feature: Ceres CLONE 1380770-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (31)..(31): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (65)..(65): n is a, c, t, g, unknown, or other
  misc_feature (66)..(66): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (100)..(100): n is a, c, t, g, unknown, or other
  misc_feature (108)..(108): n is a, c, t, g, unknown, or other
  misc_feature (126)..(126): n is a, c, t, g, unknown, or other
  misc_feature (174)..(174): n is a, c, t, g, unknown, or other
  misc_feature (525)..(525): n is a, c, t, g, unknown, or other
  misc_feature (649)..(649): n is a, c, t, g, unknown, or other
  misc_feature (754)..(754): n is a, c, t, g, unknown, or other
  misc_feature (770)..(770): n is a, c, t, g, unknown, or other
  misc_feature (822)..(822): n is a, c, t, g, unknown, or other
gagagggcgggnnnnncagaggaggtgaggnaagnntggggggnnnnccgggggggggagggggnntttggggggggggggccannnnnngcaggctggngctccccncggtggcggccgctctanaagagtggtcccccgggctgcaggaattcgcacgagaccattacctanaacatcctaatcgaaaaattagttcagcacagcacatcttcctcgcagcgccggcgctccatcttccgctccctcccccaccttcgatcggcacgcaggctcggcgtcgtcgtcaggggttcctcctcccggctctcgccagtagcctcgcggccctcggcgactggggaccctgcccttgaaggggttggcaagaagaatcgggcttagggaaggggaaaaaaaaacccccaaagtccttttaaaaagccccctaaccccggggaaggggaggaggcccaccttttgagggcaattttcacttttctggggggcggggggggggggtataaaaacaacccccaaccccgntggtgggaacaatttttttttggggtttggaaaacaggaggcttggaaaaatgtttttttttataattttcttttttggcccagaggggggggttgaaaaaaagctccctccccccccccgggngggggggggggataaaatatacgaaaaaaacccacccccgctggtggggggttttttttttttttctctccccccccccaactttgctcgagaaaaaagagtgtntgtttttgtaggaggngtgggggttctcttccttcttgtgtgggggaggaaaaaacccccgccggagnttggaagaatccttggccgcgcgcgggggggaggtgtcgtttccccgcggtgcaacca

SEQ ID NO: 16606 - DNA, 656 bp, Zea mays
  misc_feature: Ceres CLONE 1380773-F
  misc_feature (358)..(358): n is a, c, t, g, unknown, or other
  misc_feature (372)..(372): n is a, c, t, g, unknown, or other
  misc_feature (373)..(373): n is a, c, t, g, unknown, or other
  misc_feature (612)..(612): n is a, c, t, g, unknown, or other
gctctagaactagtggatcccccgggctgcaggaattcgcacgagaccattacctagaacatcctaatcgaaaagattttcttcacccgtccacctcgtcttgcgctcctctgtctcggcgacgactgtgctaccgccgccgccgccgcaagacttcgtcgggcactttgccggcgacgatttcccaccagcccaacaggatcagaggaggtgatggcgaggagtgacagctgcctggcgcgcgtgggtgccggaattgctatccggtggcgcggtcggcggagccgtcggtaaccttcgtccctaaacccctaaacactaggcttgcagcatcaatccgtccgtgcgagccgttcanccccgtcggtgttnntttttttttggttggaagtagattaagtgtgcgatttcaggaatcttctcgagctagctagtagctacatccctgggtttgtgtggttagctagcggcagatgtaataactaggtggcttttgttaagagttactagtgcttaggtagcatcatctgggaggtggaagatatcgatgcttcgagtttggagtttgtttgcccccaattgcttgtgctctaagggctgttgctgattcgntctggcggggtttggttaacttcctgctggggcttaaaaattgg

SEQ ID NO: 16607 - DNA, 744 bp, Zea mays
  misc_feature: Ceres CLONE 1380774-F
  misc_feature: Encodes the peptide sequence at SEQ ID NO. 16608
  misc_feature (711)..(711): n is a, c, t, g, unknown, or other
ggagctccccgcggtggcggccgctctagaactagtggatcccccgggctgcaggaattcgcacgagaccattacctagaacatcctaatcgaaaaaagctcaccagagcagagaaactcgcacgcactcactctcttccccccctcctgcccactctccaaagcggcgcaagcatctagcaaagctgcgcagcgcagccagcaagcttggtctggagagacagatatagccagccagagagcagcagacgaggcatggcgacgtccgtggcttgcgccttcttcttcgacgcggagccgctgggcgagcccgggcggcacgcgctggacgcctgcgcgctctgcgccaagccgctgagccgcaacagcgacatcttcatgtacaagggcgacaccccgttctgcagcgaggactgccgctacgagcagatgcaccacgacgcggcgtacgcaaggcaggcggccagcagccggcggaagcagcagcagtcgcagtcgcagcggagcagaggggcctcgtccgtgggcgccaaggcggacgtgtccgtggccagctagtcagtagtaaaagcaagcacagcgacgccgagaaagggaggagagcaggaggagaagaagaaggccgtgctggttgaagcagcgttcagctgcaagacgcttgggggggggggggggggggttttcccgttccgttcctgggctggcccgggncggggccgctgccccccacaaacgaggttccgt

SEQ ID NO: 16608 - protein, 100 aa, Zea mays
  misc_feature: Ceres CLONE 1380774-F
  misc_feature (14)..(66): Pfam Name: DUF581 Pfam Description: Protein of unknown function (DUF581)
MATSVACAFFFDAEPLGEPGRHALDACALCAKPLSRNSDIFMYKGDTPFCSEDCRYEQMHHDAAYARQAASSRRKQQQSQSQRSRGASSVGAKADVSVAS

SEQ ID NO: 16609 - DNA, 631 bp, Zea mays
  misc_feature: Ceres CLONE 1380782-F
  misc_feature: Encodes the peptide sequence at SEQ ID NO. 16610
tggagctccccgcggtggcggccgctctagaactagtggatcccccgggctgcgggaattcgcacgagaccattacctagaacatcctaatcgaaaaaatggcgcgtgcggccactagatttttcctgacgcggtggctggtcccacttcccctcctctcccccaggtggcggcagcggcggcggggtagcatttgtgctacgagggcttttgcaatggcggcttcggggttcggcggcggcgaggcgttccggctctcggccgcgccgggggccggcttactggaagctggcacaagggggaacttcacccctttgggggcccggggaaagtgggggcccccccggggcgcccttctttttaatggtttaaaagcaaattttagggggggggggggtaaggggttataaaaaggggggggacaaaatttggggagtgtgggggaaattccgagggaaaaacgggaggggtgttcctatagagagaaaaaaaaacccccccccttttgaaccccccccccccccggggggggaaaaaccgggggggccccttttttatttttggtgggacacccccccgggggggggggggggtttaaaaaagggcgcggccaaaaaaaaaatgggggtgg

SEQ ID NO: 16610 - protein, 103 aa, Zea mays
  misc_feature: Ceres CLONE 1380782-F
MARAATRFFLTRWLVPLPLLSPRWRQRRRGSICATRAFAMAASGFGGGEAFRLSAAPGAGLLEAGTRGNFTPLGARGKWGPPRGALLFNGLKANFRGGGGKGL

SEQ ID NO: 16611 - DNA, 649 bp, Zea mays
  misc_feature: Ceres CLONE 1380783-F
  misc_feature: Encodes the peptide sequence at SEQ ID NO. 16612
  misc_feature (562)..(562): n is a, c, t, g, unknown, or other
  misc_feature (594)..(594): n is a, c, t, g, unknown, or other
  misc_feature (624)..(624): n is a, c, t, g, unknown, or other
gctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcaagaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtattgnttccgctggtgttgtgaggggagcagccgtgnatatctcacccctgagggaggtgaaccagncatctacctcctcacactggtgcca

SEQ ID NO: 16612 - protein, 152 aa, Zea mays
  misc_feature: Ceres CLONE 1380783-F
  misc_feature (44)..(150): Pfam Name: Ribosomal_S7 Pfam Description: Ribosomal protein S7p/S5e
  misc_feature (124)..(124): Xaa is any aa, unknown, or other
  misc_feature (135)..(135): Xaa is any aa, unknown, or other
  misc_feature (145)..(145): Xaa is any aa, unknown, or other
MAEVEQEQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIXSAGVVRGAAVXISPLREVNQXSTSSHWC

SEQ ID NO: 16613 - DNA, 633 bp, Zea mays
  misc_feature: Ceres CLONE 1380785-F
  misc_feature: Encodes the peptide sequence at SEQ ID NO. 16614
tccccgcggtggcggccgctctagaactagtggatcccccgggctgcaggaattcgcacgagaccattacctagaacatcctaatcaaaaatagacagcctcccattcatcagattcagatcagatcgtagcagccaaggattccgcgctccgggggtgccatgaagctgaagctcctctctccctgccttctcctcctcgccttctttgccaccgcggcgtacgcggcgtcggcgtcggcgtcgcgcgcggcggccgtcgtcaggggcgcgggcgccccgtcgcagtcggagttggagtcggacccggagaaccagtgcgtgtacacggtggtacgtgcggacggggtccatctcgaagggcggcacggactcgaccatcggcgtgacgctgctgggccccgacggcacgggcatccggatccgggacctgggcggggtggggcggcctcatgggcgccggccacgactactacgagcgcggcaacctggacatcttcagcggccggggcccctgcatgagccaggcgccctgcgccatgaacctcacctccgacggtaccggcgcgcaccacgggtgggactgcaactacctcgaggccacggtcgagcgggccctatctcgtgggggcgg

SEQ ID NO: 16614 - protein, 60 aa, Zea mays
  misc_feature: Ceres CLONE 1380785-F
MGAGHDYYERGNLDIFSGRGPCMSQAPCAMNLTSDGTGAHHGWDCNYLEATVERALSRGG

SEQ ID NO: 16615 - DNA, 581 bp, Zea mays
  misc_feature: Ceres CLONE 1380791-F
  misc_feature: Encodes the peptide sequence at SEQ ID NO. 16616
  misc_feature (239)..(239): n is a, c, t, g, unknown, or other
aaagctggagctccccgcggtggcggccgctctatcactagtggatcccccgggctgcaggaattcgcacgagaccattacctagaacatcctaatcggaaaatcacggcggcggtggcggagcgtaaggcgaaggagtagcagcagcaggcggcgccgagtagcggctccccatctcgagcttgccaccatggctagaggattgagaacatttgaagaggctcatgcccccagcatgnatgcctgacagcttggcgagcttttgttcccagccatcttctggacctcacagtctagggggggggtgccattgatccccatatcaggaaagggtcaagatgttcttaaatccccagaggcatttccttccttaggaaacccctttgatttttttttgggggagggcaggaaaaaaaaaaaccaacccgggggggttaagggaggggtttttcccccccccaaaaccaaggaaaaaagagggggggtggaaaaaaaaaaggggccgcttcccctttcccccaccggggggggggggggtgaattacaaattttttgaagagggagctctttttttttttgaa

SEQ ID NO: 16616 - protein, 46 aa, Zea mays
  misc_feature: Ceres CLONE 1380791-F
KAGAPRGGGRSITSGSPGLQEFARDHYLEHPNRKITAAVAERKAKE

SEQ ID NO: 16617 - DNA, 573 bp, Zea mays
  misc_feature: Ceres CLONE 1380795-F
  misc_feature: Encodes the peptide sequence at SEQ ID NO. 16618
  misc_feature (524)..(524): n is a, c, t, g, unknown, or other
aaagctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttggtttcggcggctttggacagccagggaacataatgtccggtttctttggtggcgcagatccctttgatgaccctttcttcacaaaccccttgggtggcatgatgcaaccctagttctcaccccctttcagcggcatgatgcaacctagcttcatgaacccctttggtagcatgatgcaacctagcttgcttggaatcagnatgtttgcaagccaatggcaatctcatggaagggcacttttgaaaccca

SEQ ID NO: 16618 - protein, 56 aa, Zea mays
  misc_feature: Ceres CLONE 1380795-F
MQGGRGGRQGLFGFGDPFVGFGGFGQPGNIMSGFFGGADPFDDPFFTNPLGGMMQP

SEQ ID NO: 16619 - DNA, 656 bp, Zea mays
  misc_feature: Ceres CLONE 1380796-F
  misc_feature: Translation starting site: 333
aaagctggagctccccgcggtggcggccgctctataactagtggatcccccgggctgcaggaattcgcacgagaccattacctagaacatcctatcgaaaaagccacgcgcccacgcgccccaagttcacgccggacctgctcctctccgacggcggcatcggcttcgtgctccgctacttccccaaggcgttcaagccccgcgcccgcccaggccacgaggtggacgaccgacctcgccaacctcatcaagctctacgcggactggcactcccgcctgatcccctactactccttcgaacagttcgtgcgcaaagtcgagaaatcgggacgatggtgggcctctctgaaggggagaaacacttcatccgcggcggcattgcacaagaccttcgcactgatggacgtaggcggctgcagttccggtccctctccgtccaaaccggagtcattccacaggcgaatggctcagcgcgtgttaggttgggggccactgaaataatcgctagtgtcaaggctgaattaggaaaccaagcattcttcaccctgacaaaggaaagttgccatttttgtcgactgtagtccaacgctgaggctctgtttgagggtagaggctctgaagaaatgtctgctgagctctctgtttccctgcaagaa

SEQ ID NO: 16620 - DNA, 635 bp, Zea mays
  misc_feature: Ceres CLONE 1380805-F
  misc_feature: Encodes the peptide sequence at SEQ ID NO. 16621
  misc_feature (400)..(400): n is a, c, t, g, unknown, or other
gctcattactagtggatcccccgggctgcaggaattcgcacgagaccattacctagaacatcctaatcgaaaaaattcccgattcaccattcctcagtattgtagtacgaggggaaaaacgagatatgggaatcaacagtatcgaggtgaacacgaaatggtggtcgccgtcgcgttgcttgcgtgggcgacaccctccgcggggcgtccccatccaacatacaaggagattagcatggaagcgctggcagacctgcaggacccgagtgtctcaaggccgaagcgccatctccatctacatcccctaccacttctccgggctccactcccgccgctatggcctcctctccgttcatctccggagcttcaagtcccatgggcaacttccgctcgtctctgngaaatacttcgtttccaccgccgctcagcggcgtggggggagcttccacatccccgcccaccccccacccctgctcctgtgacagaaggcggaggccttcgcaaggccctccccagtaaccgcatattgaggcccctttccccatttcaccccccggcccttttcgatgccttatccaggctaagggcactggtgacgggcccaagcgaaaaatttaagaaaacgcctccagagg

SEQ ID NO: 16621 - protein, 118 aa, Zea mays
  misc_feature: Ceres CLONE 1380805-F
  misc_feature (92)..(92): Xaa is any aa, unknown, or other
MGINSIEVNTKWWSPSRCLRGRHPPRGVPIQHTRRLAWKRWQTCRTRVSQGRSAISIYIPYHFSGLHSRRYGLLSVHLRSFKSHGQLPLVSXKYFVSTAAQRRGGSFHIPAHPPPLLL

SEQ ID NO: 16622 - DNA, 652 bp, Zea mays
  misc_feature: Ceres CLONE 1380808-F
  misc_feature: Encodes the peptide sequence at SEQ ID NO. 16623
  misc_feature (533)..(533): n is a, c, t, g, unknown, or other
  misc_feature (536)..(536): n is a, c, t, g, unknown, or other
aaagctggagctccccgcggtggcggccgctctagaactagtggatcccccgggctgcaggaattcgcacgagaccattacctagaacatcctaatcgaaaaagctagctagctctccatgaatcgtatcgatcggaagagaagaagcccattccctgcccctgcctgccttggatacctactccctctccctccctcctcacatcacacagacagcagacaccactggccggccggcctgttcgttcattctctctcgctcgctcgctcgcccgcccgcccgcccgccagcctttcattccatctattaaacgcctataaatacagtacaggctcacacgtccatggaaggaatgtccatcttccttcactaccaccacacggctgctggctgctactaggcaggccttcccacacgcccgccgtagctctctcgcttgtgtggtcatccccggcctcgccttctctcattctgtcgtctgctgcccctgcctgccagtgccacccccccccggccgtgcggattatattcnggnccaacccaagcaaatggagaaggcgaggaggcggccacgggagtggtggcgcgaggagtatgcagaggagctcccgaagaagcaaaagcgaagggcacttgccaagtcaaaaagta

SEQ ID NO: 16623 - protein, 34 aa, Zea mays
  misc_feature: Ceres CLONE 1380808-F
MEKARRRPREWWREEYAEELPKKQKRRALAKSKS

SEQ ID NO: 16624 - DNA, 611 bp, Zea mays
  misc_feature: Ceres CLONE 1380809-F
  misc_feature: Encodes the peptide sequence at SEQ ID NO. 16625
tggagctccccgcggtggcggccgctctagaactagtggatcccccgggctgcaggaattcgcacgagaccattacctagaacatcctaatcgaaaagcactcgcttccttcgacgactcatcgccgatcacaccaggctagctagcccacccacagtcgtagggccaggaccgatcggaggagctcggtttttcgaccaggaccgccgccgccacacccgaagaagccgacgatgcagacgacgacgtcctcggcggcggcgtcgccgcgcccgcgcgcgcgggcgccgcagtccgtggtggccgagctggagggcgcgctgctccggagcgcggacacgtttccgtacttcatgctcgtggcgttcgaggcgtgcgggctgccgcgcttcgcgctgctgctggcgctgtggccgctgctgcgtctgctggaggtggcgaatcggcgcgatctggcgctgcgcgccgccgcgttcgtggacaccgcggtcgtgccgcccgccgaggtgcatgcagtgtcgcgggccgagatgcccaaggtatgaccgacgacgctcaccccgccgcgtggtcggccttggatgagtgcgaggggacgcgcgtcaacgtcc

SEQ ID NO: 16625 - protein, 103 aa, Zea mays
  misc_feature: Ceres CLONE 1380809-F
  misc_feature: SWISSPROT Homolog: EC 2.3.1.15 Glycerol-3-phosphate O-acyltransferase
MQTTTSSAAASPRPRARAPQSVVAELEGALLRSADTFPYFMLVAFEACGLPRFALLLALWPLLRLLEVANRRDLALRAAAFVDTAVVPPAEVHAVSRAEMPKV

SEQ ID NO: 16626 - DNA, 755 bp, Zea mays
  misc_feature: Ceres CLONE 1380810-F
cgcggtggcggccgctctagaactagtggatcccccgggctgcaggaattcgcacgagaccattacctagaacatcctaatcgaaaaaatctgaagcaaaatgtaccgggaatgttgaagagcgggactcttaagcagtagtgagatgccggcggtggtggtcgccggcgttggcggttgtggagccgcggtccgtgcagctcctgctcctgggcgtcgctctcgtcgcagcttctttctacgccggcctctcttcgggtcctccgcgccccctgccctcgtactggcccctttgtaccccccgattgccccctttctcccccggccctcggttctctccctttcctcccccccccatcccccccgggggggcccctcccccctcccgtcgccccctccccagcccccgcgccgttccccgtcgcgccgccctcgggcgccacgctcgctcccggtcccccccgtcgggctcccgccccccccgcagtcccacgccgctggcagaagccggcgccccccccccgcctcacccccctcctcccggtccgcgcgttgccgctctccaccccccttcttctcgtccctgttctcgctgcggacgcggcaccccgcgcggccgcccgctcgccccgccctctcgttccaccccttttgcgctcctgcgctctcccgcgcgccggggaccggctcacatcggggttgccgcccgccgccgcggtcttgtctttcccctatcttgccgctccgtttgtcgt

SEQ ID NO: 16627 - DNA, 641 bp, Zea mays
  misc_feature: Ceres CLONE 1380812-F
  misc_feature: Encodes the peptide sequence at SEQ ID NO. 16628
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaagcaaaactagcggcgcagtgacaaaagcccacagcttcttccccctcctccttctccgtcatccgtttcgctctctgccgccgccaccgcacaagaagctagctcctgcctgtaccaccccggcatggcgatgctatcccgcgcagcctcctccgcggcccggcgcccgctgctgccgccgcctaggcttctggcggtgagggcgatggcgtcgtcgctcttcggccacgtcgagcaggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcatcaagatgattgaagagtcactgaagctggcgtacggagaagattctgacttcatcaaagataagaggatagcagcggtgcaggcgctttcaggcactggtgcctgccgn

SEQ ID NO: 16628 - protein, 138 aa, Zea mays
  misc_feature: Ceres CLONE 1380812-F
  misc_feature: SWISSPROT Homolog: EC 2.6.1.1 Aspartate transaminase
MAMLSRAASSAARRPLLPPPRLLAVRAMASSLFGHVEQAPKDPILGVTEAFLADPSSDKVNVGVGAYRDDNGQPVVLSCVREAERRIAGNLNMEYLPMGGSIKMIEESLKLAYGEDSDFIKDKRIAAVQALSGTGACR

SEQ ID NO: 16629 - DNA, 644 bp, Zea mays
  misc_feature: Ceres CLONE 1380822-F
  misc_feature: Encodes the peptide sequence at SEQ ID NO. 16630
  misc_feature (550)..(550): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacgtgtgatcaaccaagtagctctggcaaacctttctccctactctcagcaacaacaatttcttccattcaaccaactgtctancattgaacccgtggctgcttaattttggccagcaacaaactaattataccctttccgccccgctttaaagtccaggggccccaaacctccaaaa

SEQ ID NO: 16630 - protein, 133 aa, Zea mays
  misc_feature: Ceres CLONE 1380822-F
  misc_feature (127)..(127): Xaa is any aa, unknown, or other
MATKIFSLLMLLALSACVANATIFPQCSQAPIASLLPPYLPSMIASVCENPALQPYRLQQAIAASNIPLSPLFQQSPALSLVQSLVQTIRAQQLQQLVLRVINQVALANLSPYSQQQQFLPFNQLSXIEPVAA

SEQ ID NO: 16631 - DNA, 883 bp, Zea mays
  misc_feature: Ceres CLONE 1380824-F
  misc_feature: Encodes the peptide sequence at SEQ ID NO. 16632
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (883)..(883): n is a, c, t, g, unknown, or other
ttccctccccnnnnnnnnnnnncgctcnnnnacccnnctngcccccccggccccctgccagctccaccgcggtggcggccgctctagaactagtggatcccccgggctgcaggaattcgcacgagaccattacctagaacatcctaatcgaaaaataaataacacacaaagttgtccgatcaaagcttgcgcgtttacaatgtctggacgatcaaggcacttcacaatgtccacccttctcgctacgagcttcttctttgtactcctatgcagctcgctacaagtacgtggcgtgaactacacgttcgtgaaggacgcggcgctggcgcccagcgtgtcctactacgactacctcatcgtgggcggtgacaccgcccgggtggcactatgtaccgcccctgattgccacacgcccttccccgcatctacctgggggtacgcacgccccccacctccccatctgcccaccaccccccccaccgccgtcacgggggccataccacaccgcgccgccacaacctcagtacaactttattataaacgatctcttcggcgccggtccctgttcctacatgctctctccgatgccgtcgcccacctgccttctccccctcctcccgctcttctactggccctccttatctttcgcctgcctttcccctgactcgcttcacccccgccgctcgggccccccgtccactacccatcattcttaccgaccgagtagaggttacttgcggagaatagatctacagatctgtacgcactcctttgtctcgcatctctctcccccatccccccactgcgccatggtgtgacgctccacgcctgtcacccgcacccccgctcctactctaatcaatattcctccctgctccccccn

SEQ ID NO: 16632 - protein, 154 aa, Zea mays
  misc_feature: Ceres CLONE 1380824-F
MSGRSRHFTMSTLLATSFFFVLLCSSLQVRGVNYTFVKDAALAPSVSYYDYLIVGGDTARVALCTAPDCHTPFPASTWGYARPPPPHLPTTPPTAVTGAIPHRAATTSVQLYYKRSLRRRSLFLHALSDAVAHLPSPPPPALLLALLIFRLPFP

SEQ ID NO: 16633 - DNA, 802 bp, Zea mays
  misc_feature: Ceres CLONE 1380829-F
  misc_feature (1)..(1): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
ntttccccttnnnnnnnnnttgttgtggggtggtcatcgactaccctcgcaaaatggagctcaccgcggtggcggccgctctagaactagtggatcccccgggctgcaggaattcgcacgagaccattacctagaacatcctaatcgaaaaaccttcctccgttgcctcctcttccgcggccccgtcgatgggcttggctttaccagtggcgggttcccacacgggggctagacgccgccaccgctgaccccgtctacaccgaatcccccgcgcgatttaacccctcgcctcgctcgccgcctccgcttccatacaaccgcgcactccaaacgcgcacgcgctgttcgttcctcggccgctctgtccacccccgtccttctccggcctcaacagatctccgccgggcccgcgcgcaatccttaagtggggctgctccggggactgtcgaatctccctggccggcctggggcgaatgggcgacttgccccccgacccccgcagccggcctaccgacggccggcgtacgaaccgaatatccccgggagcccggacccaataacaaacgccccccccgaccggggccccccttctccgtgcttccgtgaaataacggcggggggggcgcgcgcgagagcgggcaagaaagtcctggggggagaggatgctgcgacccaacggcccgccgccacgcgacacccgaccccgcaccacgaccccggatttgtgtgctcgcccgccacccaccgcccccacacagccacccacacccgccaccccccctcccaactccacaagggcccg

SEQ ID NO: 16634 - DNA, 601 bp, Zea mays
  misc_feature: Ceres CLONE 1380832-F
  misc_feature: Encodes the peptide sequence at SEQ ID NO. 16635
  misc_feature (280)..(280): n is a, c, t, g, unknown, or other
  misc_feature (319)..(319): n is a, c, t, g, unknown, or other
aagctggagctccccgcggtggcggccgctctagaactagtggatcccccgggctgcaggaattcgcacgagaccattacctagaacatcctaatcgaaaaacacgaactcgagacctcgcccgcccaaatacaaaagcctcagatctcagtgaccagcgccgccgcttcgttcgtgtcgaatagagaagagaggaaatggcggcgagcgagggcgtgctcctggggatgggcaaccccctcctcgacatctccgccgttgtcgatgacgccttcctggncaagtatgacatcaagctgaacaatgccattctcgctgnagagaagcactcgcctatggatgatgaggtggcttagcacaggcatggtggatatattggtgggagaagccaccagaactctattcagggtgccccatggatgcctccaaccctgggggaaccagtttccttggggatgcatttgggaaggacaagtttggggaggaaattaaaaaaaatggtcaagctggaaggatttcctggtccttaccattaggaatagaattggtccccttggacatatggtttaatttgttttttggggccaaaaggccttttatt

SEQ ID NO: 16635 - protein, 52 aa, Zea mays
  misc_feature: Ceres CLONE 1380832-F
  misc_feature: SWISSPROT Homolog: EC 2.7.1.20 Adenosine kinase
  misc_feature (28)..(28): Xaa is any aa, unknown, or other
  misc_feature (41)..(41): Xaa is any aa, unknown, or other
MAASEGVLLGMGNPLLDISAVVDDAFLXKYDIKLNNAILAXEKHSPMDDEVA

SEQ ID NO: 16636 - DNA, 498 bp, Zea mays
  misc_feature: Ceres CLONE 1380852-F
  misc_feature: Encodes the peptide sequence at SEQ ID NO. 16637
  misc_feature (286)..(286): n is a, c, t, g, unknown, or other
  misc_feature (287)..(287): n is a, c, t, g, unknown, or other
aaagctggagctccccgcggtggcggccgctctagaactagtggatcccccgggctgcaggaattcgcacgagaccattacctagaacatcctaatcgaaaaatcgcaaatcctcgctcgggcaagaagagccaactgaaaagtattcatccaagaacaccaccccacccgctccaagcacaagtttcgtcttgaagagagccgccaccaccaatggcttgttacaacactgcatctttagcggcgactctgctggcgttcgcgctgacgtttcgggctgcctcgnncggaggagctcaccgcgctggtgcaggagccggccataaccatggaggaacccccagggggcggtcctgtcggcccctccccgtaatttattttgggaaggggaattttctcggccccaaagggggggggaatacccgaatttttttcggtctttagggggggggcccccggcggggggaaaccggaaaccccccggggccccatgggtta

SEQ ID NO: 16637 - protein, 76 aa, Zea mays
  misc_feature: Ceres CLONE 1380852-F
  misc_feature (25)..(25): Xaa is any aa, unknown, or other
MACYNTASLAATLLAFALTFRAASXGGAHRAGAGAGHNHGGTPRGRSCRPLPVIYFGKGNFLGPKGGGNTRIFFGL

SEQ ID NO: 16638 - DNA, 716 bp, Zea mays
  misc_feature: Ceres CLONE 1380855-F
  misc_feature (630)..(630): n is a, c, t, g, unknown, or other
  misc_feature (716)..(716): n is a, c, t, g, unknown, or other
tggagctccccgcggtggcggccgctctagaactagtggatcccccgggctgcaggaattcgcacgagaccattacctagaacatcctaatcgaaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctcctccaagtcagagctccctctggncgttcccatggtcgcccctctctcagcttcatcttcagctgctcggctcccaggtgcgcgcgttcttgtgttccacgccgcgcggn

SEQ ID NO: 16639 - DNA, 738 bp, Zea mays
  misc_feature: Ceres CLONE 1380857-F
  misc_feature: Encodes the peptide sequence at SEQ ID NO. 16640
  misc_feature (231)..(231): n is a, c, t, g, unknown, or other
  misc_feature (295)..(295): n is a, c, t, g, unknown, or other
  misc_feature (367)..(367): n is a, c, t, g, unknown, or other
  misc_feature (371)..(371): n is a, c, t, g, unknown, or other
  misc_feature (435)..(435): n is a, c, t, g, unknown, or other
aaactggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggntccctctacatctgatccagctaagtagctagccagcactacagaagggcgtggcgagaatcangagagagatagcaggggggctagctagctgagctcgtgcgacgaaaaatggccggaattggcaggaacatgntggngccgctcctggtgctcaacctcatcatgtacatcatcgtcatcggcttcgcgagctgggacctngaccacttcatcaacggggagaccaactacccccggcgtgggcgtcaacggggcgacgttctacttcctggtgttcgccatcctgcccgcccggtgggggcggcggccaaacatgtgggggtggaacaacatggggggcctgggggcccaaaaccttgggcacccaacaccccgggggggcgtcatcccccgggggcatcacaaggggtcgcccttctgggttggggtggccaggggaaaaaacaccccccgggaaacccaccgccttggggccccccccgggggttggaagcctcccccccc

SEQ ID NO: 16640 - protein, 132 aa, Zea mays
  misc_feature: Ceres CLONE 1380857-F
  misc_feature (9)..(9): Xaa is any aa, unknown, or other
  misc_feature (10)..(10): Xaa is any aa, unknown, or other
MAGIGRNMXXPLLVLNLIMYIIVIGFASWDLDHFINGETNYPRRGRQRGDVLLPGVRHPARPVGAAAKHVGVEQHGGPGGPKPWAPNTPGGRHPPGASQGVALLGWGGQGKKHPPGNPPPWGPPRGLEASPP

SEQ ID NO: 16641 - DNA, 694 bp, Zea mays
  misc_feature: Ceres CLONE 1380859-F
  misc_feature: Encodes the peptide sequence at SEQ ID NO. 16642
cgcggtggcggccgctctagaactagtggatcccccgggctgcaggaattcgcacgagaccattacctagaacatcctaatcgaaaaactacttatactctctcgcttatacccacatgcgcctactcgctctcccatccatacttgcagctatggaaaaagagaatttgcacatctgcagtgggcacattggccatggtcgacttctgagaaatcgaccaccactggtcacttgatctacaagcttggtggtattgacaagcgtgtcatcgagaggttcgagaaggaggctgctcgagatgaacaagaggtccttcaagaacacatgggctcttggacaaacttaaagctgaccgccagcgaggaatcaccattgacattgcctctctggaagttcgagaccaccaagtactactgcaccgtcattgacgcccctggacatcgtgatttcatcaagaacatgattactggtacctcccaggcgtgattgtgctgctcttatcattgactcaacaacggggtggcttgtgaggctgggatcctacaaaggatgggtcagaccccgagagcacgcttcttcttgctttccaccctggggtggcaaagcaaaatgaattatgctgctgtaaaccaagatgggatgccaacaacccccccaagtactccccagggggtagggttaccgattgaatct

SEQ ID NO: 16642 - protein, 53 aa, Zea mays
  misc_feature: Ceres CLONE 1380859-F
MGSWTNLKLTASEESPLTLPLWKFETTKYYCTVIDAPGHRDFIKNMITGTSQA

SEQ ID NO: 16643 - DNA, 690 bp, Zea mays
  misc_feature: Ceres CLONE 1380859-R
  misc_feature: SWISSPROT Homolog: EC 6.3.2.19 Ubiquitin--protein ligase
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (81)..(81): n is a, c, t, g, unknown, or other
ttttttgtgtgttnnnnnnnnaccaccccaacaatcaacttttttctttactccctctctggggtttgcaattgggtaccnggccccccctcgaggtcgacggtatcgataagcttttttttttttttttttactatcaatgtttctccttccgttatatatcaaaagttcgatgcacgaatggacaaattaatttagacatctaggtttcaggttcagaagggtctatgagagaccaatagcttgtcagcccattgcatatttctgagtccagctcctagcagtatattcactacttcacgcgatcagccttgtacaagtgagcaatctctgggaccaacggatcatcagggcttgggtccgtcacaagggaacaaactgagaggaggaccttagaaactgtcagtgcacggatccattgctccttcaagatatcaagacagatgctcccgttgctgttgatattcgggcggtaaaccttcaccttgaatgctaccctcggtggttagaatggccactcccgtggaaagtgaatagtgaccaaaaatacgccaccatcctatgggctttctgatggccccataagcgttcacccgccagcagaaaatatcttcgtgcgactaggacctgtgactgccagaagtagagaggcatcccttccgcacggcccttaaaactccctttgaggaa

SEQ ID NO: 16644 - DNA, 657 bp, Zea mays
  misc_feature: Ceres CLONE 1380861-F
  misc_feature: Encodes the peptide sequence at SEQ ID NO. 16645
  misc_feature (206)..(206): n is a, c, t, g, unknown, or other
gctctagaactagtggatcccccgggctgcaggaattcgcacgagaccattacctagaacatcctaatcgaaaaattatttatacacccccagtccctacccacttgttccttcttgcttctccatcgagttggattgggttcaaagttgggcttttggacagctgtggtgtgcacggcagctctgtgacttgtgaggaggaaggnaggaagaaagcggatccatggcgtcgaagcggatcctcaaggagctcaaggacctggagaaggatcctcccacctcttgcagcgcaggccctgttgccgaagatatgttctactggcaggcgacgaccacgcgggcatgagagagggcatacgctggaggcgtatttttggtcactattcactttccaccggactaccccattcaaaccaccgaaggttgcattccaagacgaagggtttaccacccgaatatcaacagcaacgggagccacctgtcttggatatcttgacggagcaatggacccctgcactgaacgttttctagggtccccctgtcaaatttggtccccgtcctgacggaccccagagcctgaagggatctgttggtgccacagaggattgctcaccttggtaccaccactggacgcgccgcgcgggacgaacctaacta

SEQ ID NO: 16645 - protein, 40 aa, Zea mays
  misc_feature: Ceres CLONE 1380861-F
  misc_feature: SWISSPROT Homolog: EC 6.3.2.19 Ubiquitin--protein ligase
MASKRILKELKDLEKDPPTSCSAGPVAEDMFYWQATTTRA

SEQ ID NO: 16646 - DNA, 651 bp, Zea mays
  misc_feature: Ceres CLONE 1380868-F
  misc_feature: Encodes the peptide sequence at SEQ ID NO. 16647
  misc_feature (526)..(526): n is a, c, t, g, unknown, or other
  misc_feature (527)..(527): n is a, c, t, g, unknown, or other
  misc_feature (651)..(651): n is a, c, t, g, unknown, or other
aaagctggagctccccgcggtggcggccgctctagaactagtggatcccccgggctgcaggaattcgcacgagaccattacctagaacatcctaatcgaaaaatccaactcacacacaggctcaccccaccaacagcaagcgaaaatctcccgatcccctctggtctccgcggcgaagatgtcggggcgcggcaagggcgggaagggcctgggcaagggcggcgcgaagcgccaccggaaggtgctccgcgataacatccaggggatcacgaagccggcgatccggcggctggcgcgcaggggcggcgtgaagcgcatctccgggctcatctacgaggagagccgcggcgtcctcaagatcttcctggagaacgtgatccgcgacgccgtcacttacaccgagcacgcgcgccgcaagaccgtcacagccatggacgtcgtctacgcgctcaagcgccagggccgcaccctctatggcttcggcggctaggctaggccggcggcgcctcgctgtcgtcgctgcggnntctattgtttttgcaattcgcaagttagtggctcggtggcgaaaatggctggttactgtggcatagatccagcatgggtgtgcgtgtctgaagaaatggcaatggtggactttgccgtttgcgn

SEQ ID NO: 16647 - protein, 103 aa, Zea mays
  misc_feature: Ceres CLONE 1380868-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEESRGVLKIFLENVIRDAVTYTEHARRKTVTAMDVVYALKRQGRTLYGFGG

SEQ ID NO: 16648 - DNA, 695 bp, Zea mays
  misc_feature: Ceres CLONE 1380873-F
  misc_feature (210)..(210): n is a, c, t, g, unknown, or other
  misc_feature (402)..(402): n is a, c, t, g, unknown, or other
  misc_feature (471)..(471): n is a, c, t, g, unknown, or other
  misc_feature (472)..(472): n is a, c, t, g, unknown, or other
  misc_feature (506)..(506): n is a, c, t, g, unknown, or other
  misc_feature (510)..(510): n is a, c, t, g, unknown, or other
  misc_feature (511)..(511): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (542)..(542): n is a, c, t, g, unknown, or other
  misc_feature (544)..(544): n is a, c, t, g, unknown, or other
  misc_feature (546)..(546): n is a, c, t, g, unknown, or other
  misc_feature (557)..(557): n is a, c, t, g, unknown, or other
  misc_feature (558)..(558): n is a, c, t, g, unknown, or other
  misc_feature (580)..(580): n is a, c, t, g, unknown, or other
  misc_feature (581)..(581): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
gctctagaactagtggatcccccgggctgcaggaattcgcacgagaccattacctagaacatcctaatcgaaaaatcacctataatattttgagcattcagaaacacaccaagcgaagcacattagcaacaacctaacaacaatggctaccaagatattatccctccttgcgcttcttgagatttttgggaggggactttcccaaccgtncgtccagtgaggtgactgccgcaaatttccttaaaaaaaaaaattaccagcggggacttcttgcccccccagcgcccagttgtgcaaggctataaatttccgccgccggtgggagaagcgccttttttaaccaccttcaaagaaaaacaattctccctgaaaaatctgccgcaaaaaaaaatacgcccccancaggggcggggtgtcctacccccactcgaccacctagaactggtggaccctggcgcctacttgcttctnnagttgctagaatcaaacccctttgcttggtgggncgtnnttgccaaccagccccaaaaatagnnnncaancncncccggcttttnnttaaggcaacaaagaatgaggnncccccccgcccctcccctcaaaaaannnccccccccccccccccccccccaaaaaaaaaaaaattttttttttaaaaaatattttttttttttcgcagaaaaaaaacgcccccc

SEQ ID NO: 16649 - DNA, 633 bp, Zea mays
  misc_feature: Ceres CLONE 1380875-F
  misc_feature: Encodes the peptide sequence at SEQ ID NO. 16650
  misc_feature (434)..(434): n is a, c, t, g, unknown, or other
  misc_feature (512)..(512): n is a, c, t, g, unknown, or other
  misc_feature (515)..(515): n is a, c, t, g, unknown, or other
  misc_feature (601)..(601): n is a, c, t, g, unknown, or other
aaagctggagctccccgcggtggcggccgctctagaactagtggatcccccgggctgcaggaattcgcacgagaccattacctagaacatcctaatcgaaaaaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacgatgtactcggaggcaagtgtaaccgtgggctctctgtggtcgacagctacnagctgctcaagggcgctgatgctctgggcgaggaagaaaacgtcctttgctgcaccctcggctggtgcattgaatggnctncagctttctttcctgtgctggatgatatcatggatgactctcacactcgtcgcggccaggcttgctggttcaaggtggctcagggntgcttaattgctggaatggacggatcatcctt

SEQ ID NO: 16650 - protein, 132 aa, Zea mays
  misc_feature: Ceres CLONE 1380875-F
  misc_feature: SWISSPROT Homolog: EC 2.5.1.67 Chrysanthemyl diphosphate synthase
  misc_feature (67)..(67): Xaa is any aa, unknown, or other
  misc_feature (93)..(93): Xaa is any aa, unknown, or other
  misc_feature (94)..(94): Xaa is any aa, unknown, or other
MAAGGNGAGGDTRAAFARIYKTLKEELLTDPAFEFTEESRQWIDRMVDYDVLGGKCNRGLSVVDSYXLLKGADALGEEENVLCCTLGWCIEWXXAFFPVLDDIMDDSHTRRGQACWFKVAQGCLIAGMDGSS

SEQ ID NO: 16651 - DNA, 742 bp, Zea mays
  misc_feature: Ceres CLONE 1380884-F
  misc_feature: Translation starting site: 190
  misc_feature: SWISSPROT Homolog: EC 1.2.1.12 Glyceraldehyde-3-phosphate dehydrogenase (phosphorylating)
  misc_feature: SWISSPROT Homolog: EC 1.2.1.13 Glyceraldehyde-3-phosphate dehydrogenase (NADP(+)) (phosphorylating)
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaacagatcacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggaggttgctgtgtttggctgcaggaacccctgaggagatcccatggggttcggttggcgctgaatatgttgttgagtctactggtgttttcactgaccaggagaaggctgcagctcacttgaagggtggtggccaagaagggtgtcatttctgctcctaggaaggatgcccccatggttcgtttgttggtggcaacgaagaaggagtacaagtctggacattcaacattggtctctaaatgctaggctgccacaaccaacttgccntttgctccgctttgctaaaggtcattcaatgaacaaagtttcgggaatttggttggaagggtctg

SEQ ID NO: 16652 - DNA, 900 bp, Zea mays
  misc_feature: Ceres CLONE 1380898-F
  misc_feature: Encodes the peptide sequence at SEQ ID NO. 16653
  misc_feature (42)..(42): n is a, c, t, g, unknown, or other
  misc_feature (729)..(729): n is a, c, t, g, unknown, or other
  misc_feature (778)..(778): n is a, c, t, g, unknown, or other
ccccccaccgctttctctaccctcctctttctcgtgggcggnttgacaaactggcgctccccgcggtggcgggcgcttttccataatggatcccccgggctgcgggttttcccacgagacccttacctagaacatcctaatcgaaaaatccactgcggactggactcgtgcgagagacttgaccaagcagcaccagcagggatggcgcctctgaatctgtacgggatgccgttgacccccaacgtggagcgcgtggtcaccgtgctcaacgaaaagggcctctacttcgagatcgaccccggcaacctctccaccggtgaccataagtagaccgacttgctcgcccccaatccttatgggcagatcccggttctcgtcgaccggcagacaaagtcgtcttatgagtctcagggccatcaccccgctacctcgactaggcaggtacgtcgtcggaggggctgcgtacctggctaccccctcgaacattggccgttgtgagaaaaagctgcgaaggggcggtcctccatagtggggacctctcgaatcaacttatctttccaccaaaaggctgtgatgccgcctgtgggggtgaacaatccccggctcgcgtgtgggccgctcctaccctgggtccagaagaaccctccctaacacgtgcaggggggatgtgggcaatcccccgcctgacaaagaagaatctcctcaaaggagggagtgaccacgggggancaaaggagcccaaccatcccccctcttccacatttcttccctcgcccgnagtgaatgcagcgtcgatgcggagtgtcccgcagaacgaacaaaggctttgcacaagcgggactatatcttccccgacggagcccctagacggtcgggtgttcttgaaaaagcccccccacc

SEQ ID NO: 16653 - protein, 42 aa, Zea mays
  misc_feature: Ceres CLONE 1380898-F
  misc_feature: SWISSPROT Homolog: EC 2.5.1.18 Glutathione transferase
MAPLNLYGMPLTPNVERVVTVLNEKGLYFEIDPGNLSTGDHK

SEQ ID NO: 16654 - DNA, 582 bp, Zea mays
  misc_feature: Ceres CLONE 1380899-F
  misc_feature: Encodes the peptide sequence at SEQ ID NO. 16655
  misc_feature (262)..(262): n is a, c, t, g, unknown, or other
  misc_feature (268)..(268): n is a, c, t, g, unknown, or other
  misc_feature (354)..(354): n is a, c, t, g, unknown, or other
  misc_feature (380)..(380): n is a, c, t, g, unknown, or other
  misc_feature (391)..(391): n is a, c, t, g, unknown, or other
  misc_feature (427)..(427): n is a, c, t, g, unknown, or other
aagctggagctccccgcggtggcggccgctctagaactagtggatcccccgggctgcaggaattcgcacgagaccattacctagaacatcctaatcgaaaaagttcgccaccatcgtgctccgtacacgctccgctccggccatggccgccgccgcggcctccttttcggccctgccgttccttctacttttgctgctggtgccgtcgctcgacggcgcctcccatgtgacgtacgaccaccgctccctcatcatctccggncggcgncgcctcgtcatctccaccctcatcccactaccccgcagcgtccccgagatgtggcccaagctggtggctgaagccaagggacgcgncgccgactgcatcgagacctacgtcnttctggacggncatgagatcgccccagccagactacttccaggacgnttgaccctggtgcggttccgggaggtccttaagaacctggttggtcttgatctgggcatcgggcctatgcccccgccagtgatatatgagcgtgcccccccctgtggtttccactatggcccgaaaaaggtttttcgaggaaaaaaacgagcatt

SEQ ID NO: 16655 - protein, 146 aa, Zea mays
  misc_feature: Ceres CLONE 1380899-F
  misc_feature: SWISSPROT Homolog: EC 3.2.1.23 Beta-galactosidase
  misc_feature (71)..(71): Xaa is any aa, unknown, or other
  misc_feature (80)..(80): Xaa is any aa, unknown, or other
MAAAAASFSALPFLLLLLLVPSLDGASHVTYDHRSLIISGRRRLVISTLIPLPRSVPEMWPKLVAEAKGRXADCIETYVXLDGHEIAPARLLPGRLTLVRFREVLKNLVGLDLGIGPMPPPVIYERAPPCGFHYGPKKVFRGKKRA

SEQ ID NO: 16656 - DNA, 626 bp, Zea mays
  misc_feature: Ceres CLONE 1380903-R
  misc_feature: Translation starting site: 305
  misc_feature: SWISSPROT Homolog: EC 3.4.23.12 Nepenthesin
  misc_feature (613)..(613): n is a, c, t, g, unknown, or other
ccgggccccccctcgaggtcgacggtatcgatattttttttttttttttttggaacgcgtcatgtgtcaacacgcttacgtttctctggttagccccttaattccaccaacgaaagaacttccaccgctactgctgtgtatggtatacgctctcctgcaagtttgtctttactgtcatcatgtacagtaactttgtatgtatctttgtacgtgcatatactactactagtagtgatcccaagtcgccgactgttaatcgatgagttagcaggagctgggtttgaagccgacggaggtgccgtcgatgcgcacctcgaacgagcgctgctgcacgttgccgaggatggccatgccaccgtcactgccgctgggtgcgaacgcgaggcacccaaacgacaggatcccgtcggcgcccagcatcacggtcgcgccgctgccgaaggtgagcgccacgttcgggagcgtcacggtgccgtacccggcgaagttgtagcaggtgtccaggatcccgttcgacggcgctgtagggtactcgtacgaggccatgccgctgcggaacgctgaccgcagcgccgcgtacgctggtcggggcaagcgggtgatgaccgtgccngtgtccacaccgt

SEQ ID NO: 16657 - DNA, 894 bp, Zea mays
  misc_feature: Ceres CLONE 1380903-R2
  misc_feature: SWISSPROT Homolog: EC 3.4.23.12 Nepenthesin
aaaaagtggggggcgcttacgtttctctggttagccccttaattccccaacgaaagaacttccaccgctactgctgtgtatggtatacgctctcctgcaagtttgtctttactgtcatcatgtacagtaactttgtatgtatctttgtacgtgcatatactactactagtagtgatcccaagtcgccgactgttaatcgatgagttagcaggagctgggtttgaagccgacggaggtgccgtcgatgcgcacctcgaacgagcgctgctgcacgttgccgaggatggccatgccaccgtcactgccgctgggtgcgaacgcgaggcacccaaacgacaggatcccgtcggcgcccagcatcacggtcgcgccgctgccgaaggtgagcgccacgttcgggagcgtcacggtgccgtacccggcgaagttgtagcaggtgtccaggatcccgttcgacggcgctgtagggtacccgtacgaggccatgccgctgcggaacgcggaccgcagcgccgcgtacgcggtcgggggcaggcgggtgatgaccgtgccggtgtccaccaccgtcccgcccgcgaacgccgacgcgggcacgctcaactgctgcccgccgacgctgatccccgtcagcatcacgacctagtaggtcggcccgttgggcgaccgcagcaactgcgtcctggagaaacccggggccaatgcccgaggggccggcccaggcccaacggtcagggaccccgcgggtggaaggcgttcttcagggaagccaataggaagaaaaccccggcggaggtggccgccggggttgtctcagggagggagggtcggctcccgggcggaaggctcatgaagcccctctgtacggcgtgtaaacattgctctttctctccgcat

SEQ ID NO: 16658 - DNA, 751 bp, Zea mays
  misc_feature: Ceres CLONE 1380904-F
tggagctcaccgcggtggcgcccgctctagaactagtgtatcccccgggctgcaggaattcgcacgagaccattacctagaacatcctaatcaaaaaatcgcttctgctcggcgccctcacaaacggcgacgcacaatcactgccgagcccgatatatcttctattacccattccgcccatcgattcaccttcacgccagactcgctctattccgaaggcgtcgcgcgagactgattgagaggagagcaggaagatgagggagagcatctccgtacacatcggtcaggacggcatacaagtcggaaacgcgtgctgagaactttactgcctcgagcacggaatccaggctgatggaccagcgcctggagataagaccgcgggacatcacgatgatgccttcagcatctcttcttcagccagactggtgctgagcaaccacgtttcccgtgaaatcctcggtgatcccaaatccccctgtgctcgaggaggggagcacctggcccccataacggcggatcttacccccttgaccccccaaaaattgccaggaaggagcccgctaaaaaattgcgcccctgggccactaccaaaatgggccccgagaattggtgaaccgggggcttggccccgaacccccattttggcagaaaactggcccgggtcttccagggcttcccggccctaaaagggcgggggcgctttcacctggggtctggtgcctaggcttaaacctccccttggggggggggg

SEQ ID NO: 16659 - DNA, 627 bp, Zea mays
  misc_feature: Ceres CLONE 1380911-F
  misc_feature: Encodes the peptide sequence at SEQ ID NO. 16660
  misc_feature (577)..(577): n is a, c, t, g, unknown, or other
  misc_feature (624)..(624): n is a, c, t, g, unknown, or other
tccccgcggtggcggccgctctagaactagtggatcccccgggctgcaggaattcgcacgagaccattacctagaacatcctaaaaaaaatcttatttcactgccagccctctgaaaaaaaaattaaaaaatgaggtcccagttccacccacctagagagccaaaagagccggcggtggccggcagccaaaacccacgttggattttgccgccgccgcctggagctaggggacaaggcaacgccggccggtgcaacatttatgcgtgtaccaggcagaccagcccggcagccacgcgtacacttctgccgcaaagctaaacgcgccactccgcggcaagctgctctgctgctcccaccagccaccgcaccgagtgccaatggcgactgcagcgagttcgacgccggcggcgcggcagcctactctggtctgcgcgtcactgaccgcgcgggtgccccgggagatggcagcggaggttgccgccgctgcggcgctcggtgccgacgtggcggagctccaggtcggctgcctcgacagcttcgagccatgcagggacctgcccgtgcttctcgcccagncccgctcgctccccgtcatcgtcactacagccccaaaattgggaggnagc

SEQ ID NO: 16660 - protein, 83 aa, Zea mays
  misc_feature: Ceres CLONE 1380911-F
  misc_feature (67)..(67): Xaa is any aa, unknown, or other
MATAASSTPAARQPTLVCASLTARVPREMAAEVAAAAALGADVAELQVGCLDSFEPCRDLPVLLAQXRSLPVIVTTAPKLGGS

SEQ ID NO: 16661 - DNA, 634 bp, Zea mays
  misc_feature: Ceres CLONE 1380912-F
  misc_feature (206)..(206): n is a, c, t, g, unknown, or other
  misc_feature (211)..(211): n is a, c, t, g, unknown, or other
  misc_feature (213)..(213): n is a, c, t, g, unknown, or other
  misc_feature (221)..(221): n is a, c, t, g, unknown, or other
  misc_feature (278)..(278): n is a, c, t, g, unknown, or other
tggagctccccgcggtggcggccgctctagaactagtggatcccccgggctgcaggaattcgcacgagaccattacctagaacatcctaatctaaaaatcgagctgagctgagcatcatggggtagtgtgtgtgtgaggcgatagagaagctagtgctcataaccaaccaccactcagtcctcctcctctaacctttcccttccgncgcgntnctactggntcctagagggagagagatctcgaactccaagggcgcatgctcccggtgctagctacnatgccgtgggcgtaactgcggcagcccctgatcgatcaatccatcgcttgtgcggaaggaacccgatccagtgggagtcacctaactaaatactccccgggccggcggccgtccctggaacctacccccccaaaagggggccttaaaaaaataacccggaaagctggtttccaaatggggagaatggcctcgtctggccccctggtttggaatcctcggaacggggaaaaagtaaaatggaaccccaaaaaaaacaagggggcccctccctccttctttggaaaaaaacggggcggggcgcgggggccaaaaaaaaagaggaaaccaacccccagaacctggaacggggagggaat

SEQ ID NO: 16662 - DNA, 737 bp, Zea mays
  misc_feature: Ceres CLONE 1380913-F
  misc_feature: Encodes the peptide sequence at SEQ ID NO. 16663
tggagctccccgcggtggcggccgctctagaactagtggatcccccgggctgcaggaattcgcacgagaccattacctagaacatcctaatcgaaaaaactactccgtcactttgtatgcaaagctcctcctcgatccatcgatcactgcaccggccggaggaaccgcgctcgcaggggctaaccaacgagacggcagcaatggcggaccgtgaccgcatcggcatctacggcggagcccacgccacctacgggcagcagcatcagcagggaggaggcgcgcgcccgatgggtgagcaagtgaagggcatgctccacgacaaggggccgacggcgtcgcaggcgctgacgggggcgacgctgttcccgctgggcgggctgctgctggagctgtcggtactggcgctgacggcctccgtggtggagctggccgtggacacgccggcgttcctgatcttcagccccgtggtggtcaccgtcgcgctgctcatcgagacgtgcgacatggggttcctcacgtcgggcgcgctggcactcgttgggctgacctcgctcacgtgcctccccaacactgcgcgggaggtgttccagcgcatcccggactacctgtaggaggcgcaacctcatgatggcggaggccgcgcagcacacgggccataagaccgcgtagggtagcccatgacatcccaggccaggccgcaaggagggcggacgtccggggaaggcgtacgtggtcgg

SEQ ID NO: 16663 - protein, 136 aa, Zea mays
  misc_feature: Ceres CLONE 1380913-F
  misc_feature (44)..(137): Pfam Name: Oleosin Pfam Description: Oleosin
MADRDRIGIYGGAHATYGQQHQQGGGARPMGEQVKGMLHDKGPTASQALTGATLFPLGGLLLELSVLALTASVVELAVDTPAFLIFSPVVVTVALLIETCDMGFLTSGALALVGLTSLTCLPNTAREVFQRIPDYL

SEQ ID NO: 16664 - DNA, 655 bp, Zea mays
  misc_feature: Ceres CLONE 1380923-F
  misc_feature: Encodes the peptide sequence at SEQ ID NO. 16665
  misc_feature (398)..(398): n is a, c, t, g, unknown, or other
  misc_feature (403)..(403): n is a, c, t, g, unknown, or other
  misc_feature (464)..(464): n is a, c, t, g, unknown, or other
  misc_feature (465)..(465): n is a, c, t, g, unknown, or other
  misc_feature (526)..(526): n is a, c, t, g, unknown, or other
tggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccatcgcaggcgtgctgcgacgcgctggcgggggcggacctcaagtgcctgtgcgnctacnagaactcgccgtggatgggcgtctacaacatcgacccccagcgcgccatggagcttccggnncagtgcgggctcgccacgccgcccgactgctagcagtgtgctagccaagccaggccagcangaaggccccggcattgctagctgtacgtgtctgtgtgtgctctgcagcaggtgcagggcagggcccttaacgacgtgtctctttctcctctcatcttggcacggacctatctagagtgtgtggtgtcga

SEQ ID NO: 16665 - protein, 115 aa, Zea mays
  misc_feature: Ceres CLONE 1380923-F
  misc_feature (41)..(115): Pfam Name: Tryp_alpha_amyl Pfam Description: Protease inhibitor/seed storage/LTP family
  misc_feature (83)..(83): Xaa is any aa, unknown, or other
  misc_feature (85)..(85): Xaa is any aa, unknown, or other
  misc_feature (105)..(105): Xaa is any aa, unknown, or other
MAATSSKSSSSSSSAQRAAAALLVAAAVAVSVLVVGAAAVCDMSNEQFMSCQPAAAKTTDPPAAPSQACCDALAGADLKCLCXYXNSPWMGVYNIDPQRAMELPXQCGLATPPDC

SEQ ID NO: 16666 - DNA, 705 bp, Zea mays
  misc_feature: Ceres CLONE 1380938-R
  misc_feature (568)..(568): n is a, c, t, g, unknown, or other
ccgattgggtaccgggccccccctcgaggtcgacggtatcgataagcttttttttttttttttttatttcccaaacaactgcataaatagacaatgcaacttatttaatcaaatgtgacattttgttcatttgcctcaattgtcttacatcaataactagagggggaaaagcattattattacatgagataatcatcgtctcattcctcaataactagtatggagccgttatatcaacttataatataccacctcatctaggatggcgtggttcttcaaaccaaacatcttccatgtattgagtattgaccaaaagtaaaaaacagactgctcaggagctattactagacccaagcatcattctgatggcatggagaaaggccttgaatctgaacaaccaattcttagtatgttccttggcaaagtttcatgggcatttccttcaaaaaaatatcttcagaaatatcaagtcatcatgtcagctggtacggatgtactaaatactctgtcctttgccttcaaagctctttctcccagtgctgcacaaggtaattgttgagaagcatancatctgtatgacgagtgccccaaatatccccaaccaagtcccattccccctaaatggacataaaggcaaaaccgagggccctggaattcctataagggaattggccccaagataaccaaagcctcaattttttgccc

SEQ ID NO: 16667 - DNA, 624 bp, Zea mays
  misc_feature: Ceres CLONE 1380942-F
  misc_feature: Encodes the peptide sequence at SEQ ID NO. 16668
tccccgcggtggcggccgctctagaactagtggatcccccgggctgcaggaattcgcacgagaccattacctagaacatcctaatcgaaaaatctcgtccacgaaacgtacggacttcgggcatcggccccaacgccagcggcaccgcaccaccacgcccgtcggcgacatgaatccgcccgcagcagccgcgtccaccggcgcaggaggccacgccgcggcgcctgcggcagcccgggagtacgtgcactacccgaggctctcgccagaggaggtggccccgcccccgcccccgccttatcacgccgccaccgccgcgccgtccgcctacggaggcaacccctacatctactcccccgccggcggcgccgccacctccccgaagaatacgatggactccgtgaaggacgtgctcggcaagatggggaagaggtttggcgaggcggcccgcaagaccgagaccatcaccggcaatttctggcagcactgtgagcttttcgatttcgttgccgtattttcacgaaatcgggttccgaagttgtttctgtgtgtttttcatcaaattgctaatcgtgttgtgcatttttcatgtacattttgttattgtatatgaaatttaggttg

SEQ ID NO: 16668 - protein, 147 aa, Zea mays
  misc_feature: Ceres CLONE 1380942-F
MNPPAAAASTGAGGHAAAPAAAREYVHYPRLSPEEVAPPPPPPYHAATAAPSAYGGNPYIYSPAGGAATSPKNTMDSVKDVLGKMGKRFGEAARKTETITGNFWQHCELFDFVAVFSRNRVPKLFLCVFHQIANRVVHFSCTFCYCI

SEQ ID NO: 16669 - DNA, 643 bp, Zea mays
  misc_feature: Ceres CLONE 1380947-F
  misc_feature: Translation starting site: 321
  misc_feature: Pfam Name: DUF640 Pfam Description: Protein of unknown function (DUF640)
  misc_feature (420)..(420): n is a, c, t, g, unknown, or other
  misc_feature (463)..(463): n is a, c, t, g, unknown, or other
  misc_feature (471)..(471): n is a, c, t, g, unknown, or other
  misc_feature (513)..(513): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
aagctggagctccccgcggtggcggccgctctagaactagtggatcccccgggctgcaggaattcgcacgagaccattacctagaacatcctaatcgaaaaatctatcgccacccgcgtcccgtcctcctccatctgtaaccactccccgtcgtctctttcgcggtctcgcctcctgcagcctctcgcccagaaagggaaaccgcatctgctcccgtctcccgcctcggcgccgccgcctagtcgacctgagcccagagaggggggggcgtcgaggccgtcgggcgctcagatctggggcgggagtggcaagcgaaggacatgcagatgcacgtcggaggaggcgcggccgacagcccggaggcgacgcggccgagccgctacaagtcgcagaaagcggcggactggcacacggttcggncagtacctgcgcaaccacccggccgcgctggagactggcgcgntgcaccgncgcgcacgtgctcgagttcctgcgctaactcggacagttcgnaaagacaaggtccacgccgggggggggtggccccttttttcggcacccgtgcccggccgggggccggggccggggcccgttnnncccaaggttttnnnnacacccccaaacccatctcatcgcctccccg

SEQ ID NO: 16670 - DNA, 631 bp, Zea mays
  misc_feature: Ceres CLONE 1380951-F
  misc_feature: Encodes the peptide sequence at SEQ ID NO. 16671
ctagaactagtggatcccccgggctgcaggaatttgcacgagaccattacctagaacatcctaatcgaaaactaatagttctagtgtcgtgccgggccggacggcagtttggccatctataactgtacaccatataacaccaatcactccgcagtgcagacgcagcgcatgcaggtagcaatggcgggggagacgaagaagggcctggtgctgctggacttctgggtgagcccgttcgggcagcgctgccgcatcgcgctgggcggagaagggcatcgcctacgagtactcggagcaggagctgctgggcggcgccaagagcgacatccctcctccgctccaacccggtgggacagaagatcccccgtgctcctccacgacggccggccccgtctgcgagtccctcgtcatcctcaggaaacctcgagggaggccttccccgggaggccccccccaggctggctccccgacgccgcctacgcggcgcgcgcaggcccggttttcgggggggcctaattccgacaggggcctaccaggcccgcccgggctctggtggaaggtcaggggggcgacctgcggggcgcgggcgctggggccgaaccggggtaaaggcgggtccagaaacgtctcc

SEQ ID NO: 16671 - protein, 111 aa, Zea mays
  misc_feature: Ceres CLONE 1380951-F
MAGETKKGLVLLDFWVSPFGQRCRIALGGEGHRLRVLGAGAAGRRQERHPSSAPTRWDRRSPVLLHDGRPRLRVPRHPQETSREAFPGRPPPGWLPDAAYAARAGPVFGGA

SEQ ID NO: 16672 - DNA, 643 bp, Zea mays
  misc_feature: Ceres CLONE 1380960-F
  misc_feature: Encodes the peptide sequence at SEQ ID NO. 16673
tccccgcggtggcggccgctctagaactagtggatcccccgggctgcaggaattcgcacgagaccattacctagaacatcctaatcgaaaaagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggccccgcggtgaggtgatcagcaccaggagggagcctgtggggaccaaaactggtttcatggggtgaggggggctacactccgagacagtcactcctattcccttatgaggtgcgcaccgatcttca

SEQ ID NO: 16673 - protein, 123 aa, Zea mays
  misc_feature: Ceres CLONE 1380960-F
  misc_feature (2)..(100): Pfam Name: Ribosomal_L21e Pfam Description: Ribosomal protein L21e
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKAPR

SEQ ID NO: 16674 - DNA, 664 bp, Zea mays
  misc_feature: Ceres CLONE 1380964-F
  misc_feature: Translation starting site: 222
  misc_feature: Pfam Name: Glyoxalase Pfam Description: Glyoxalase/Bleomycin resistance protein/Dioxygenase superfamily
  misc_feature: SWISSPROT Homolog: EC 4.4.1.5 Lactoylglutathione lyase
  misc_feature (352)..(352): n is a, c, t, g, unknown, or other
  misc_feature (378)..(378): n is a, c, t, g, unknown, or other
  misc_feature (379)..(379): n is a, c, t, g, unknown, or other
  misc_feature (388)..(388): n is a, c, t, g, unknown, or other
  misc_feature (427)..(427): n is a, c, t, g, unknown, or other
ggcggccgctctagaactagtggatcccccgggctgcaggaattcgcacgagaccattacctagaacatcctaatcgaaaacaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtggttggggatctggaccgcacaatcaagtactacacgnaatggctttgggatgaaactgctgannaaaaagggnatgttcctgatgagaagtacaccaatgccttcccttggnctttgggccagagaacccaaaccttgtgcagttgaattgacatacaacctatgggcgtggacaagtatgaccattgggaaccgggcttttgggcattttcgcaattggctatggatgatggggtacaaggtttagcttgagaatatcaaatccccggggggggtaaagaaccccccccgaaaccgggtccttggccaggggaggatccccctggtatttggccttcgcacagggttc

SEQ ID NO: 16675 - DNA, 730 bp, Zea mays
  misc_feature: Ceres CLONE 1380970-F
  misc_feature: Encodes the peptide sequence at SEQ ID NO. 16676
tccccgcggtggcggccgctctagaactagtggatcccccgggctgcaggaattcgcacgagaccattacctagaacatcctaatcgaaaaacaaaaaattagggagttttcttctcccgtccaccttgcgtgctcgcgcgcgagctctcgtggcgcagccactcctaggcgaccgccgccgcccctacgccacgtgctcgagtctagcctcgtcgattgcttccccagtttaattgatctacaagcttcagaacatgttcaagaatacatttcagtctgggttcctgtccattctttatagcctcgggaccaagccattgcagatatgggataaggaagttgtgaatgggcacattaaacgaccccaagatgaagatatccaatctaatgtacttgaaattgttggaacaaatgtacagtcaacttacatcacatgcccagctgatccttctgctactcttgggattaagcttccatttctgggtattattgtgaaaaatcttaagaaatacttcacgtttgagatccaggttctggatgacaagaaatggcccgaccgtcatttccgagcatcaaatttttcatctggccccaaggggtgaagcccatatatcttgcccgcaggccgttgacactccaacgatgggttgaaaacaacatcccagttggaccctttggttgatctgagaaaaaaaggggcgtcacggcccaaatttccgccgggggacc

SEQ ID NO: 16676 - protein, 115 aa, Zea mays
  misc_feature: Ceres CLONE 1380970-F
  misc_feature (1)..(116): Pfam Name: DUF667 Pfam Description: Protein of unknown function (DUF667)
MFKNTFQSGFLSILYSLGTKPLQIWDKEVVNGHIKRPQDEDIQSNVLEIVGTNVQSTYITCPADPSATLGIKLPFLGIIVKNLKKYFTFEIQVLDDKKWPDRHFRASNFSSGPKG

SEQ ID NO: 16677 - DNA, 534 bp, Zea mays
  misc_feature: Ceres CLONE 1380973-F
  misc_feature (393)..(393): n is a, c, t, g, unknown, or other
  misc_feature (419)..(419): n is a, c, t, g, unknown, or other
  misc_feature (451)..(451): n is a, c, t, g, unknown, or other
  misc_feature (464)..(464): n is a, c, t, g, unknown, or other
  misc_feature (465)..(465): n is a, c, t, g, unknown, or other
  misc_feature (495)..(495): n is a, c, t, g, unknown, or other
  misc_feature (519)..(519): n is a, c, t, g, unknown, or other
ggagctccccgcggtggcggccgctctagaactagtggatcccccgggctgcaggaattcgcacgagaccattacctagaacatcctaatcgaaaaattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccgggactgggcaattccttgccattgggcttccccaggcccagatcgttggaatnccccccgggggctggcaaggggtcanttcccaaggaaaaggggggggagagcccaaanaaaaaaaaaaaanncccccccccccccccccccaaaaaaaaaanagggccccaaaaaccttttggggncgcccccttttcctt

SEQ ID NO: 16678 - DNA, 733 bp, Zea mays
  misc_feature: Ceres CLONE 1380976-F
  misc_feature: Encodes the peptide sequence at SEQ ID NO. 16679
  misc_feature (450)..(450): n is a, c, t, g, unknown, or other
  misc_feature (546)..(546): n is a, c, t, g, unknown, or other
tggagctccccgcggtggcggccgctctagaactagtggatcccccgggctgcaggaattcgcacgagaccattacctagaacatcctaatcgaaaagccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaggnagggaggcgtcctccctggcatcaaggttgacaagggcaccattgagggtgttggcactgataaggagaccaccacccaggccatgacgaccttgncaagcgttgcgccaagtactacgaggcaggtggccgctttgccaagtgccgcgctgttctcaggatgggccctaagagccatcacggctttgcatcgacctgaacgttcagggtctggctcgctatgcatcatctgccaggaaaaatggcctggtggcaatttgtggagcccgaaaaccccttgtgg

SEQ ID NO: 16679 - protein, 188 aa, Zea mays
  misc_feature: Ceres CLONE 1380976-F
  misc_feature (11)..(188): Pfam Name: Glycolytic Pfam Description: Fructose-bisphosphate aldolase class-I
  misc_feature: SWISSPROT Homolog: EC 4.1.2.13 Fructose-bisphosphate aldolase
  misc_feature (95)..(95): Xaa is any aa, unknown, or other
  misc_feature (127)..(127): Xaa is any aa, unknown, or other
MSAYCGKYKDELIKNAAYIGTPGKGILAADESTGTIGKRLSSINVENVEENRRALRELLFCCPGALQYISGVILFEETLYQKTKDGKPFVDVLRXGGVLPGIKVDKGTIEGVGTDKETTTQAMTTLXSVAPSTTRQVAALPSAALFSGWALRAITALHRPERSGSGSLCIICQEKWPGGNLWSPKTPC

SEQ ID NO: 16680 - DNA, 716 bp, Zea mays
  misc_feature: Ceres CLONE 1380977-F
  misc_feature: Encodes the peptide sequence at SEQ ID NO. 16681
  misc_feature (669)..(669): n is a, c, t, g, unknown, or other
tccccgcggtggcggccgctctagaactagtggatcccccgggctgcaggaattcgcacgagaccattacctagaacatcctaatcgaaaaacaagcagcgaaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagagttccatgttgctgctcagaactgctgggtgaagaagggaggtgctttcactggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcaatgtgttggtgagacccttgagcagagggaggctgggcctaaccatggaatggttgttgctgcacaaacaaaagcaattggctgagaagatcaaggactggagncaaaccgtagttgttgccttattggaaccagttttggggctaatgga

SEQ ID NO: 16681 - protein, 129 aa, Zea mays
  misc_feature: Ceres CLONE 1380977-F
  misc_feature (5)..(128): Pfam Name: TIM Pfam Description: Triosephosphate isomerase
  misc_feature: SWISSPROT Homolog: EC 5.3.1.1 Triose-phosphate isomerase
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIAMCW

SEQ ID NO: 16682 - DNA, 720 bp, Zea mays
  misc_feature: Ceres CLONE 1380979-F
  misc_feature: Encodes the peptide sequence at SEQ ID NO. 16683
  misc_feature (492)..(492): n is a, c, t, g, unknown, or other
  misc_feature (541)..(541): n is a, c, t, g, unknown, or other
  misc_feature (554)..(554): n is a, c, t, g, unknown, or other
  misc_feature (560)..(560): n is a, c, t, g, unknown, or other
  misc_feature (563)..(563): n is a, c, t, g, unknown, or other
  misc_feature (598)..(598): n is a, c, t, g, unknown, or other
  misc_feature (676)..(676): n is a, c, t, g, unknown, or other
  misc_feature (687)..(687): n is a, c, t, g, unknown, or other
ggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgaggggggaaatcgggaaggaggaggtgagggagtatgagagcgacatgaggaagctggaggagctgctttctaagctgaacccctcggcggaggagttcgtgccgcagtcccgccgccgcgtggacggcggcgctccccgcctttcggncgacgcgcccgtgttcgtgtcgccggcgatcgactactacgcgcgccanccacagttcccgncgccgnagnttctgcagcagcacagccgatgcacgtgctgcagntttgtggtggcgcccgcggggttggcatgggtggcgccggggggatggactcagcagcgacggatccgccatgttcanccgatccacgnaaaaagaacgggtttcatcaggggaagagaagg

SEQ ID NO: 16683 - protein, 48 aa, Zea mays
  misc_feature: Ceres CLONE 1380979-F
MVAVAVDGLIRGADAVPAAEREAVRAAAAEAAAKGGEGGNREGGGEGV

SEQ ID NO: 16684 - DNA, 726 bp, Zea mays
  misc_feature: Ceres CLONE 1380984-F
  misc_feature: Encodes the peptide sequence at SEQ ID NO. 16685
  misc_feature (637)..(637): n is a, c, t, g, unknown, or other
  misc_feature (693)..(693): n is a, c, t, g, unknown, or other
  misc_feature (694)..(694): n is a, c, t, g, unknown, or other
ggagctccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctagctactggctactctcagcaacaacaacttcttccatttaaccnattggcgcactgacccccgctgcttattggcagcagcaaatactactaccatttanncagctagctgcagcaagccgtgcttccttctg

SEQ ID NO: 16685 - protein, 162 aa, Zea mays
  misc_feature: Ceres CLONE 1380984-F
  misc_feature (159)..(159): Xaa is any aa, unknown, or other
MATKIFSLLMLLALSACVANATIFPQCSQAPIASLLPPYLPSMIASVCENPALQPYRLQQAIAASNIPLSPLFQQSPALSLVQSLVQTIRAQQLQQLVLPVINQVALANLSPYSQQQQFLPFNQLSTLNRAAYLQQQLLPFSQLATGYSQQQQLLPFNXLAH

SEQ ID NO: 16686 - DNA, 714 bp, Zea mays
  misc_feature: Ceres CLONE 1380985-F
  misc_feature: Encodes the peptide sequence at SEQ ID NO. 16687
  misc_feature (398)..(398): n is a, c, t, g, unknown, or other
  misc_feature (415)..(415): n is a, c, t, g, unknown, or other
  misc_feature (421)..(421): n is a, c, t, g, unknown, or other
  misc_feature (422)..(422): n is a, c, t, g, unknown, or other
  misc_feature (446)..(446): n is a, c, t, g, unknown, or other
  misc_feature (486)..(486): n is a, c, t, g, unknown, or other
  misc_feature (498)..(498): n is a, c, t, g, unknown, or other
  misc_feature (507)..(507): n is a, c, t, g, unknown, or other
  misc_feature (543)..(543): n is a, c, t, g, unknown, or other
  misc_feature (566)..(566): n is a, c, t, g, unknown, or other
tggagctccccgcggtggcggccgctctagaactagtggatcccccgggctgcaggaattcgcacgagaccattacctagaacatcctaatcgaaaaaattcgccttcacctcgccgcttcctccttgaccgccaccgttgacgtcgtcttccggcgaggtagctcgccggaagacctcacctggacttttccgacgcaccctccacacactctttaaccctccggaatggccgcctgcttctagctcgtcgacgccccaatctccgcttgcttcctcgacagccccatccgcctcttctcgctctcgctacggctcctctgcctgttcgccatggcgatccgcatcaccgtctcctactccggctacgtggcgcagaacctcgccgcgtcgctcggncaccgcttctcctccgnctccgnnctcgggagccgcctcctccatgancgcgcctggcgcccccttctgcatcttcacctccacccgncagcccgagcangcaccgcgncagcggcagcgaccgccatgacgggaggcgactacnaccacccgaagccccaggcatcngccgcggagctcactccgtgctggtcaggggtggggggttatcgtccagtccccgccggcgttttttgccgggggttgccccggggctggcccaaggacggaacgacccctggaaccccgggttggggggttcctccagggttgggcg

SEQ ID NO: 16687 - protein, 63 aa, Zea mays
  misc_feature: Ceres CLONE 1380985-F
  misc_feature (7)..(7): Xaa is any aa, unknown, or other
MTGGDYXHPKPQASAAELTPCWSGVGGYRPVPAGVFCRGLPRGWPKDGTTPGTPGWGVPPGLG

SEQ ID NO: 16688 - DNA, 746 bp, Zea mays
  misc_feature: Ceres CLONE 1380987-F
  misc_feature: SWISSPROT Homolog: EC 4.1.1.33 Diphosphomevalonate decarboxylase
  misc_feature (499)..(499): n is a, c, t, g, unknown, or other
  misc_feature (539)..(539): n is a, c, t, g, unknown, or other
  misc_feature (606)..(606): n is a, c, t, g, unknown, or other
  misc_feature (607)..(607): n is a, c, t, g, unknown, or other
  misc_feature (667)..(667): n is a, c, t, g, unknown, or other
  misc_feature (668)..(668): n is a, c, t, g, unknown, or other
  misc_feature (684)..(684): n is a, c, t, g, unknown, or other
  misc_feature (726)..(726): n is a, c, t, g, unknown, or other
aaagctggagctccccgcggtggcggccgctctagaactagtggatcccccgggctgcaggaattcgcacgagaccattacctagaacatcctaatcgaaaaaatccatttacctgtccaccaaaccagtctgtagtgttttttccctccctaatgaacagaccacggaggtgacgaagcagcggtagagacaaattagcgagcagagaaggggtactggcgatgacacaccttgccattgagccacatgcggtcggaagggaatgaggggctgacggcgacagtggtggtggcgcagagatggtcggggtcgagcgttacgctgatgctgtcgttgatggggaggatgagcgcctcgtcccgcttcccccagtacttgatcaccgcaatggttggtcggcgtccgccccgttgccatgagcacccactgcccctccgccgccgccattggatctctcgcttcgcgctgctctatgcccgatattcctgggcaaagggnaagttagtaggcataatccctactactctataagcacggnggtgtaggcgtgcacaccgtgcgccatcgttctgccagcctcccgatgtcccctggccaggatcggnncacacttttgtcgccgcaatcatcggctacctgcccctcaacatcctccccctccgctcnncgtccaggatctcatnggcgccattgatgccgtcctcgctgcccccctcgagccttgnccccggcccgaggttggcgc

SEQ ID NO: 16689 - DNA, 731 bp, Zea mays
  misc_feature: Ceres CLONE 1380988-F
  misc_feature: Encodes the peptide sequence at SEQ ID NO. 16690
  misc_feature (471)..(471): n is a, c, t, g, unknown, or other
  misc_feature (480)..(480): n is a, c, t, g, unknown, or other
  misc_feature (513)..(513): n is a, c, t, g, unknown, or other
  misc_feature (525)..(525): n is a, c, t, g, unknown, or other
  misc_feature (582)..(582): n is a, c, t, g, unknown, or other
  misc_feature (590)..(590): n is a, c, t, g, unknown, or other
  misc_feature (608)..(608): n is a, c, t, g, unknown, or other
  misc_feature (661)..(661): n is a, c, t, g, unknown, or other
  misc_feature (666)..(666): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaactccctccctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattcgggtgaatgtaagtgagctgnctgtggagnagctgagtgtttctgagtacttggcattcaggnaacagctggtgnatggacaatccaacagcaactttgtgcttgagcttgattttgagcccttcatggctncctttccntcgtcttcatgtcgaggncatcgggaatggagtgcattcctttaccgacacctgtcgtccaaagtgtcagnacaangagagnttgtacccttgctgacttcctcaggctcatactacagggcacgacgatgatgctgatga

SEQ ID NO: 16690 - protein, 185 aa, Zea mays
  misc_feature: Ceres CLONE 1380988-F
  misc_feature: SWISSPROT Homolog: EC 2.4.1.13 Sucrose synthase
  misc_feature (103)..(103): Xaa is any aa, unknown, or other
  misc_feature (106)..(106): Xaa is any aa, unknown, or other
  misc_feature (117)..(117): Xaa is any aa, unknown, or other
  misc_feature (121)..(121): Xaa is any aa, unknown, or other
  misc_feature (140)..(140): Xaa is any aa, unknown, or other
  misc_feature (166)..(166): Xaa is any aa, unknown, or other
  misc_feature (168)..(168): Xaa is any aa, unknown, or other
  misc_feature (170)..(170): Xaa is any aa, unknown, or other
MAAKLTRLHSLRERLGATFSSHPNELIALFSRYVHQGKGMLQRHQLLAEFDALFDSDKEKYAPFEDILRAAQEAIVLPPWVALAIRPRPGVWDYIRVNVSELXVEXLSVSEYLAFRXQLVXGQSNSNFVLELDFEPFMAXFPSSSCRGHREWSAFLYRHLSSKVSXQXEXVPLLTSSGSYYRARR

SEQ ID NO: 16691 - DNA, 737 bp, Zea mays
  misc_feature: Ceres CLONE 1380989-F
  misc_feature: Encodes the peptide sequence at SEQ ID NO. 16692
  misc_feature (365)..(365): n is a, c, t, g, unknown, or other
  misc_feature (737)..(737): n is a, c, t, g, unknown, or other
tggagctccccgcggtggcggccgctctagaactagtggatcccccgggctgcaggaattcgcacgagaccattacctagaacatcataatcgaaaagcttcgaagtgttcgtgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtggngggtgttggtcgcaccgcgcaagctaagtcgcgccactccaatgggccagggccgctggcccgttaaatcagccaggtcccatcctggatttgctgaagaatgctgagagtaacgtggatgtgaaagggcttgggatgtggacaaacctctatgtttcacacatccaggtgaatcaagcccagaagcagaggcgccgcacctaccgtgctcacgggcgcatcaatccctacatgtcctcacctgccacatgggagctggatcttggcaaagaaaggagagcctgtggaagaaagaggctgacaacattgtccaccaagggaaacagggaagtatatccgccatgctgatcgaggccttttttgggcgaagan

SEQ ID NO: 16692 - protein, 73 aa, Zea mays
  misc_feature: Ceres CLONE 1380989-F
  misc_feature (17)..(74): Pfam Name: Ribosomal_L22 Pfam Description: Ribosomal protein L22p/L17e
MVKYSQEPGNPTKSAKAMGRDLRVHFKNTRETAFALRKLSLTKAKRYLEDVIAHKQAIPFRRYCGGCWSHRAS

SEQ ID NO: 16693 - DNA, 757 bp, Zea mays
  misc_feature: Ceres CLONE 1380991-F
  misc_feature: Encodes the peptide sequence at SEQ ID NO. 16694
  misc_feature (558)..(558): n is a, c, t, g, unknown, or other
  misc_feature (601)..(601): n is a, c, t, g, unknown, or other
  misc_feature (631)..(631): n is a, c, t, g, unknown, or other
  misc_feature (646)..(646): n is a, c, t, g, unknown, or other
  misc_feature (699)..(699): n is a, c, t, g, unknown, or other
  misc_feature (700)..(700): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgtctaacttcctggtgtcccctcctgccccggcggtgggtggggcgcgccgtccaaagctggccggncgtgcaccacgtgcgcgcctggcgccacgacagcctggccccnaccgcccgcgtcgtcgctcatcgcctgggncatcacggcgctcgnccttcgggctggcccttgcaaggagatccacatcggggaaacacgcggctggnngcctgcccccgtgctggaaggccttcgtcatcatcctcggcttcacgcaagctcctc

SEQ ID NO: 16694 - protein, 138 aa, Zea mays
  misc_feature: Ceres CLONE 1380991-F
  misc_feature (14)..(136): Pfam Name: AWPM-19 Pfam Description: AWPM-19-like family
  misc_feature (87)..(87): Xaa is any aa, unknown, or other
  misc_feature (97)..(97): Xaa is any aa, unknown, or other
  misc_feature (102)..(102): Xaa is any aa, unknown, or other
  misc_feature (120)..(120): Xaa is any aa, unknown, or other
MAGIGRNMVAPLLVLNLIMYIIVIGFASWNLNHFINGQTNYPGVAGNGATSNFLVSPPAPAVGGARRPKLAGRAPRARLAPRQPGPXRPRRRSSPGXSRRSXFGLALARRSTSGKHAAGXLPPCWKAFVIILGFTQAP

SEQ ID NO: 16695 - DNA, 715 bp, Zea mays
  misc_feature: Ceres CLONE 1380993-F
  misc_feature: Encodes the peptide sequence at SEQ ID NO. 16696
  misc_feature (182)..(182): n is a, c, t, g, unknown, or other
  misc_feature (183)..(183): n is a, c, t, g, unknown, or other
aaagctggagctccaccgcggtggcggccgctctagaactagtggatcccccgggctgcaggaattcgcacgagaccattacctagaacatcctaatcgaaaaatttatacccctccgtttcccacccttacctccccactccggcagtccccgtcccaccactacagccactggctgcccnnggccggccgcgtccctcttcctccgccaggcgccagccgcccgctctccagcaatggcgtctgcctcgcacgccccgacgccgctgctcaaggacgagctggacatcgtcatcccgacgatccgcaacctcgacttcctggagatgtggaggcccttcttccagccctaccacctcatcatcgtgcaggacggcgaccccagcaagaccatccgcgtccccgagggcttcgactacgagctctacaaccgcaacgacatcaaccgcatgctggggcccaaggcatcctgcatctcccttcagggactccgcctgccgctgcttcggctacatgggtctcccagaaaaaagtaattctacacccatcgaagatgaactggtttcgtttgcccaaggatcccatccggggaaggacatccatgggcttttgaaccagcacattcaaaaaacctcccgggagccctttccctccccttttttctttcaaaaaattctgggatggacccctttaccgggggtggggggcccgaatt

SEQ ID NO: 16696 - protein, 99 aa, Zea mays
  misc_feature: Ceres CLONE 1380993-F
MASASHAPTPLLKDELDIVIPTIRNLDFLEMWRPFFQPYHLIIVQDGDPSKTIRVPEGFDYELYNRNDINRMLGPKASCISLQGLRLPLLRLHGSPRKK

SEQ ID NO: 16697 - DNA, 771 bp, Zea mays
  misc_feature: Ceres CLONE 1380994-F
  misc_feature: Encodes the peptide sequence at SEQ ID NO. 16698
  misc_feature (436)..(436): n is a, c, t, g, unknown, or other
  misc_feature (437)..(437): n is a, c, t, g, unknown, or other
  misc_feature (509)..(509): n is a, c, t, g, unknown, or other
  misc_feature (527)..(527): n is a, c, t, g, unknown, or other
  misc_feature (555)..(555): n is a, c, t, g, unknown, or other
  misc_feature (611)..(611): n is a, c, t, g, unknown, or other
  misc_feature (612)..(612): n is a, c, t, g, unknown, or other
  misc_feature (702)..(702): n is a, c, t, g, unknown, or other
tggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcgnnctcgccgggggtgcccgtgtacgcgctcgcaacgcccgcccaaggagttccgtggcttgtgcgtccacaccncgtgggaagggcaagggnggcgaagagcgtgagtccaacgcccggncgctcgggctgctctggcttcccgggaaaggaagatgctgacgcgcttgctgaaannaaaatgggatggcgatatgcgcgcccgggctcctgggtggtcgttccctggccgcgcttgaacaaggttaatcccattgaaattcccgantggggggggggggggtttaaaattcccccctggaaatcctccccaaggtgcttaaaagggcaaattaat

SEQ ID NO: 16698 - protein, 113 aa, Zea mays
  misc_feature: Ceres CLONE 1380994-F
  misc_feature (80)..(80): Xaa is any aa, unknown, or other
  misc_feature (104)..(104): Xaa is any aa, unknown, or other
  misc_feature (110)..(110): Xaa is any aa, unknown, or other
MPFRFQFPWLKNPTTNGGTSNIDTNPSPRFPNPFLPIQAHVTSFFSSFPRALPPPPPWARITSPASTSGALPTSEIEERXRRGCPCTRSQRPPKEFRGLCVHTXWEGQGXRRA

SEQ ID NO: 16699 - DNA, 735 bp, Zea mays
  misc_feature: Ceres CLONE 1380995-F
  misc_feature: Translation starting site: 222
  misc_feature (649)..(649): n is a, c, t, g, unknown, or other
ggagctccccgcggtggcggccgctctagaactagtggatcccccgggctgcaggaattcgcacgagaccattacctagaacatcctaatcgaaaaacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtggctgtttttgttgaccttgagcccactgtcatcgatgaggtgaggactggcacctatcgccagctcttccatcctgagcagctcatcagtggcaaggaggatgcagccaacaactttcgctcgtggtcactacaccattggcaagggagattgttgacctgtgccttgaccgcatcaggaagcttgcagataattgcactggtctccagggcttctcgtcttcaacgctggtggntggaggaacggctcctgggcttggttctctcctcctgaaggcgctgtctgttgactatggcaagaagtccaagctcggtttcacgg

SEQ ID NO: 16700 - DNA, 552 bp, Zea mays
  misc_feature: Ceres CLONE 1380998-F
  misc_feature: SWISSPROT Homolog: EC 1.2.1.12 Glyceraldehyde-3-phosphate dehydrogenase (phosphorylating)
  misc_feature (162)..(162): n is a, c, t, g, unknown, or other
  misc_feature (166)..(166): n is a, c, t, g, unknown, or other
  misc_feature (173)..(173): n is a, c, t, g, unknown, or other
  misc_feature (175)..(175): n is a, c, t, g, unknown, or other
  misc_feature (176)..(176): n is a, c, t, g, unknown, or other
  misc_feature (179)..(179): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (201)..(201): n is a, c, t, g, unknown, or other
  misc_feature (202)..(202): n is a, c, t, g, unknown, or other
  misc_feature (214)..(214): n is a, c, t, g, unknown, or other
  misc_feature (215)..(215): n is a, c, t, g, unknown, or other
  misc_feature (217)..(217): n is a, c, t, g, unknown, or other
  misc_feature (218)..(218): n is a, c, t, g, unknown, or other
  misc_feature (252)..(252): n is a, c, t, g, unknown, or other
  misc_feature (297)..(297): n is a, c, t, g, unknown, or other
  misc_feature (298)..(298): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (390)..(390): n is a, c, t, g, unknown, or other
  misc_feature (411)..(411): n is a, c, t, g, unknown, or other
  misc_feature (428)..(428): n is a, c, t, g, unknown, or other
  misc_feature (450)..(450): n is a, c, t, g, unknown, or other
ggagctccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctacntcgncccaggntnncgnccccattgggggggggnnnccnnaaagggaaattnntnnttaaaaaggaaattccggggggggaaaaaatccncaacggcttcggaaggatcggcaggctcgtggccagggtcgcccnntccagaaagcgagggatggtccnnnagggccttcggtccggcccggttccaaaaaccgcgaaccccccccccttttcctttttcccaaaccncccagcggggacttaaaaccnattttggactacatggntcagtacgacacggtccacggnccaactgggaagcacagcgacatcacactccagggatgcgaggacctttcttctcggtgaacagccgggtcaccgtcttttgggaatcagggaacccctgag

SEQ ID NO: 16701 - DNA, 737 bp, Zea mays
  misc_feature: Ceres CLONE 1380999-F
  misc_feature: Encodes the peptide sequence at SEQ ID NO. 16702
  misc_feature (361)..(361): n is a, c, t, g, unknown, or other
  misc_feature (369)..(369): n is a, c, t, g, unknown, or other
  misc_feature (447)..(447): n is a, c, t, g, unknown, or other
tccccgcggtggcggccgctctagaactagtggatcccccgggctgcaggaattcgcacgagaccattacctagaacatcctaatcgaaaaattctgcagcgccagctcgctcctcgccccgcccccttctctcagcggcgacgcctcgggcgttcctaccctgccccctctccggacccccacgccgtcggcgaagcagccgggcaagagcccgatccagaccccgcgagctccacctgagagatacgggctcgccgcgatggaattcgagtcagcggcgcggcggcggcagcgcagactctcttcgccgtcgttgaggacccacctcacgcctgcttttgacgccgtgccgggtggggnagggcggncgtgtctgggtactcttcatcgtcgtcttccagcggtctcggaactgcgggttcgacgcctctctcctccgcaccggncggctccggtttcgccgccccctcggacctgggacagccgtgtcctcctctactccccgcagtccgtggccgcgcagatggagggcggcgtacctggcagcgggatggatgggggtcagggcacctggcgtcaaccactacggatcccaatatggaggctggccggcttactggggcgccagggttttcaggggtcaaaaaccaacttttcttttgcctccccccggagacaaggacaatattccaactacggttcgggggggcctccccccccccaagcttcctgctga

SEQ ID NO: 16702 - protein, 60 aa, Zea mays
  misc_feature: Ceres CLONE 1380999-F
MGVRAPGVNHYGSQYGGWPAYWGARVFRGQKPTFLLPPPGDKDNIPTTVRGGLPPPKLPA

SEQ ID NO: 16703 - DNA, 696 bp, Zea mays
  misc_feature: Ceres CLONE 1381000-F
  misc_feature: Translation starting site: 128
  misc_feature: Pfam Name: DUF1084 Pfam Description: Protein of unknown function (DUF1084)
  misc_feature (389)..(389): n is a, c, t, g, unknown, or other
  misc_feature (390)..(390): n is a, c, t, g, unknown, or other
  misc_feature (442)..(442): n is a, c, t, g, unknown, or other
tggagctccccgcggtggcggccgctctagaactagtggatcccccgggctgcaggaattcgcacgagaccattacctagaacatcctaatcgaaaagaaaggatctctctgcgcgccggggcggcgatggcggcggcgccggcgcccctgccggcgcccgtcgcagactggtgggagcgcgtcaacggctcgccggcgtggcaggacgggatcttctgggaccctcgccgtcctctacggtgccattgctaccgcctcattcatccaagttgccaggatacagtgcagagtccctgaatatggatggacaacccaaaaggtcttccagttcctgaatttcgtggtcaatggggcccaggtgctctatctttgctttcccgtcgccagnntgcacagtgaacccctccgatctttcagcatgttattcttgatcttcctggncttgcatttctcactacctatgcactggtagcgcttttctgggccgagatactttaccagcacgtgaaatatgactgatcgacttagatcaggttctacatcttaattggggtggttatgcattgcagggtttcctgggggtggggttgggggggaatccaaatctttctaggtaggccctttaagttttccttgggggcctttcttttcacggggctggggttttgggacctgggggggaggtttcttctggg

SEQ ID NO: 16704 - DNA, 763 bp, Zea mays
  misc_feature: Ceres CLONE 1381003-F
  misc_feature: Translation starting site: 185
  misc_feature (363)..(363): n is a, c, t, g, unknown, or other
  misc_feature (447)..(447): n is a, c, t, g, unknown, or other
  misc_feature (537)..(537): n is a, c, t, g, unknown, or other
  misc_feature (631)..(631): n is a, c, t, g, unknown, or other
ggagctccccgcggtggcggccgctctagaactagtggatcccccgggctgcaggaattcgcacgagaccattacctagaacatcctaatcgaaaagccggcgatcggcggagatccgctgttctgacatcgtctcccgctgctgacttgtgaacaaggcagcagcatggttcagtttggaaacatgtcatcaaagaagatagagttggatcacaaggacatggtccatgattctgctatcgactactatggcaagcgccttgccactgcctcctcagactctaccgtgaagatcatcaacattggcgcggcaaatgccccatcccaggtcctggcaacgcttagtggccactatggtccctngtgtggcgtgttgcttgggcccatccaaagtatggcgctatccttgcttcgtgccagttaatgatgggcgtgtcattattttgnaaaggaggatgcacgaggcatttggtctcaaaggtccatgggtgttcagtgacaccaagtcatctgtcacctccattgcatgggctcgcnaaatggaggtttgggcttttgccttgcctgtgcatctttccagggtggaagaatatccatcttgagatgcgagttttttttgggggggtttggntatactggaaaccatttgagcgagcacaatccctgtttggtgcgactgcccatattcctgggcttctggcacagctttcatagtggggaaaaggggggggagtttgtttacagctggttcttcaagagggtt

SEQ ID NO: 16705 - DNA, 752 bp, Zea mays
  misc_feature: Ceres CLONE 1381006-F
  misc_feature: Encodes the peptide sequence at SEQ ID NO. 16706
tggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcggtgagggggaatcgggcaaggaggaggctgagggagtatgagagcgacatgaggaagctggaggagctgctttctaagctgaacccctcgggcgggaggagttccgtgccgcagtccccgccgcccgcgttggacgggcggcgctcccccgccctttcggccgacgcgccccgtgtttcgtggtcgccggggaatcgactaattacgcgggccaccaccaggctcccgccgccgcagtttctgcaaaagcagcaaccgatgcccgggggttgcaggcttggtggtggctgacatacgaagtttattttgcgcgggtgccggggaaccctccctacccctcacttgcgtcccgcactggctgcgcctcttacctcgatttcactcttttccctatgttcggcgcgccgcctt

SEQ ID NO: 16706 - protein, 48 aa, Zea mays
  misc_feature: Ceres CLONE 1381006-F
MVAVAVDGLIRGADAVPAAEREAVRAAAAEAAAKGGEGESGKEEAEGV

SEQ ID NO: 16707 - DNA, 728 bp, Zea mays
  misc_feature: Ceres CLONE 1381008-F
  misc_feature: Encodes the peptide sequence at SEQ ID NO. 16708
  misc_feature (74)..(74): n is a, c, t, g, unknown, or other
  misc_feature (75)..(75): n is a, c, t, g, unknown, or other
  misc_feature (318)..(318): n is a, c, t, g, unknown, or other
  misc_feature (375)..(375): n is a, c, t, g, unknown, or other
tccccgcggtggcggccgctctagaactagtggatcccccgggctgcaggaattcgcacgagaccattacctanngaacatcctaatcgaaaatctcccgcagagcagccgacaactctctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccnggacacagggtaccaggattgcttctgagggtctgaagcacagagtctttgaggttngcctagctgatcttcagggcgacgagggatcagcttacaggaaatcaggctccgggctgaagatgtgcagggcaggaatgtgctcacaaacttttggggtatgaattttaccctgaaaaaatggagccctaaggggaaaaggggaaacattatccaagcccctggtggtggcagacaacccaaactcacggggggggttggtccggcacgggttcccccaagagggcccaaccgggtaaagaaaccgggtttgtcgggttccccaaacccaaaaaccccgaaaaagggggggaaattatataccccggttttcctgggggcaaaaaaatttttgtgcaaattctcccaagggg

SEQ ID NO: 16708 - protein, 102 aa, Zea mays
  misc_feature: Ceres CLONE 1381008-F
  misc_feature (11)..(102): Pfam Name: Ribosomal_S3Ae Pfam Description: Ribosomal S3Ae family
  misc_feature (50)..(50): Xaa is any aa, unknown, or other
  misc_feature (69)..(69): Xaa is any aa, unknown, or other
MAVGKNKRISKGKKGGKKKTVDPFSKKDWYDIKAPSVFSVRNIGKTLVSXTQGTRIASEGLKHRVFEVXLADLQGDEGSAYRKSGSGLKMCRAGMCSQTFGV

SEQ ID NO: 16709 - DNA, 713 bp, Zea mays
  misc_feature: Ceres CLONE 1381015-F
  misc_feature (358)..(358): n is a, c, t, g, unknown, or other
  misc_feature (683)..(683): n is a, c, t, g, unknown, or other
tggagctccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcanaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaatgggcgccccgcaggcccaccttcgtgggcatctggaagaagcgtgcggtggagcagtactcgccgatcccgtacgtggcgacgctgctgaactgcatgantggtgggtgctgtacgggctgccgctggtg

SEQ ID NO: 16710 - DNA, 718 bp, Zea mays
  misc_feature: Ceres CLONE 1381016-F
  misc_feature: Encodes the peptide sequence at SEQ ID NO. 16711
  misc_feature (488)..(488): n is a, c, t, g, unknown, or other
  misc_feature (539)..(539): n is a, c, t, g, unknown, or other
  misc_feature (564)..(564): n is a, c, t, g, unknown, or other
  misc_feature (627)..(627): n is a, c, t, g, unknown, or other
  misc_feature (632)..(632): n is a, c, t, g, unknown, or other
  misc_feature (651)..(651): n is a, c, t, g, unknown, or other
  misc_feature (679)..(679): n is a, c, t, g, unknown, or other
ggagctccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagagagacatagactcggactcggagagaaggagatgatgtcgagggagcgcaagaaggcggctgctcttcaggagaagctgaagatcctccgctccatcactcactcccacgctctgagcaacacgtcgataatcatggacgcgtcggcgtacatcaaggagctgaagcagaaggtggtgaggctgaaccaggagattgcgtgcgcgcaggacgcgctgagacacaaggcatcatcctatcccacggtgaccgtggaagccctaggagtgncaggggtcgtcgttcctgggtgaacgtgttctccgacaagagctgcccggngctgggctcgtcgcccgtgctggangccttcgacgagctgggggctcagcgtgctccaggccaccgcgtcctgcgccgactcttccgncttcnagggcggtgggcgggaagnaacgtggcggaccacgtggacgagcagntcgtggaagcaggccgtcctgcaggccgtcagaacctgt

SEQ ID NO: 16711 - protein, 86 aa, Zea mays
  misc_feature: Ceres CLONE 1381016-F
  misc_feature (80)..(80): Xaa is any aa, unknown, or other
MMSRERKKAAALQEKLKILRSITHSHALSNTSIIMDASAYIKELKQKVVRLNQEIACAQDALRHKASSYPTVTVEALGVXGVVVPG

SEQ ID NO: 16712 - DNA, 679 bp, Zea mays
  misc_feature: Ceres CLONE 1381018-F
  misc_feature: Encodes the peptide sequence at SEQ ID NO. 16713
  misc_feature (618)..(618): n is a, c, t, g, unknown, or other
  misc_feature (647)..(647): n is a, c, t, g, unknown, or other
tcaccgcggtggcggccgctctagaactagtggatcccccgggctgcaggaattcgcacgagaccattacctaaacatcctaatcgaaaagtccttgtgcgttccttgtagccatctccgactccgcgcctccgctgcctcccgaaagcattgccagttcctccgcacaacatgacgcgcatccaccgcctccgccccctcttcctcttcgttctcttggcgtcgctgcaatgcggtgcggcgacggcggcggctggatacggaggtggcgccgaggggttctgctcggcggagccgtccagcaagtgctccggggatcagccgctctactggaaggtcacccatcccaccctcgcgcccgcgcacctccaagatttacctggcttcacacgtagtgttttcaaaagggatcatgctttaataacaccagagagtcatgtattcagtcctttgcctgattggatcaatacagtaggagcatatttgatcagtccagctattggtgcacacttcattatgtatctagcaaacatgcaaggctggaaggctcctttaatgaaccagctggaagataaacactgtcagatctgtcctcactggcatccctaattatcaccnttatgcgattccctgccctaaatggtggntcaggctatcgacaaatcagaaagggcttttt

SEQ ID NO: 16713 - protein, 145 aa, Zea mays
  misc_feature: Ceres CLONE 1381018-F
MTRIHRLRPLFLFVLLASLQCGAATAAAGYGGGAEGFCSAEPSSKCSGDQPLYWKVTHPTLAPAHLQDLPGFTRSVFKRDHALITPESHVFSPLPDWINTVGAYLISPAIGAHFIMYLANMQGWKAPLMNQLEDKHCQICPHWHP

SEQ ID NO: 16714 - DNA, 657 bp, Zea mays
  misc_feature: Ceres CLONE 1381019-F
  misc_feature (634)..(634): n is a, c, t, g, unknown, or other
  misc_feature (657)..(657): n is a, c, t, g, unknown, or other
tccccgcggtggcggccgctctagaactagtggatcccccgggctgcaggaattcgcacgagaccattacctagaacatcctaatcgaaaaatcatgcttaatctctctccagtttcccccagttcccgtttccatctccatcctcccccccgggagcaggagctgcagccaggagtcgagtcggcgtcgtcacgggagatatcagcttcgctatcaccggatccccctctgctccctccgcacctcccatctgcgctctctgttttcttccgcgcaccccggctgttggtgtcccgtccggcagcgttgctggtggctgaatccgagcctttgaggggtctgctgccgccgccgccgccgctgtcaccgctcttgagatctctttattgatctggagagattaaagagggattcttgccttcctactggagcaagagaaaggggagaacgtgtttcttcaggcgtggttgaacagtgaggaccggagaacaatgcgagggttcggatttaagatgttctggcttttagggccgttcttctgaagcaggggacgggcgattcgaccacccgagctcagatctgattacaaaacgttcagaaaaacacaggcggtctcacaccgcctttcacttnctgcttaactttggcaaccactn

SEQ ID NO: 16715 - DNA, 686 bp, Zea mays
  misc_feature: Ceres CLONE 1381022-F
  misc_feature: Encodes the peptide sequence at SEQ ID NO. 16716
  misc_feature (686)..(686): n is a, c, t, g, unknown, or other
ggagctccccgcggtggcggccgctctagaatagtggatcccccgggctgcaggaattcgcacgagaccattacctagaacatcctaatcgaaaaagattcgtagcttcgggggaaaaaggcaggcacagtatcgtcgaacatgctgccaggtcgccacccggcgcgccgggccgacaccaccgggacggggccgctcctgccggacgccactcgcgcggtggcgtcgcagttcgtcgccacagcacatgttcgtgttcgccgccgaaggctccgactacggactctgtaagctgacaaggacactgcaacgccgggagggctgctcgcggtggccatcgcccacacactggcgctggaggccgcggtggcgccagcgagcaacgcgtcgggtgagcacgtcaactctggggccacgttcggcctgatcgcgggccgcccatctctttcggccgtggggcgtaatactgcttcatgcaaaatgttcgcccccagggaccccgccaatttttgccaaaagaactcccccaagaaagaactccgttcgcaggctgcctatacgagcttaaacctgcgcgtgtcacgacccacagcccagaaccgcagcctcatcgggtagaaaagcacctcccacctgggtgctaaccccgcggccctaaacctcaaacacatcccgagccacaaccn

SEQ ID NO: 16716 - protein, 49 aa, Zea mays
  misc_feature: Ceres CLONE 1381022-F
MLPGRHPARRADTTGTGPLLPDATRAVASQFVATAHVRVRRRRLRLRTL

SEQ ID NO: 16717 - DNA, 692 bp, Zea mays
  misc_feature: Ceres CLONE 1381024-F
  misc_feature: Encodes the peptide sequence at SEQ ID NO. 16718
  misc_feature (692)..(692): n is a, c, t, g, unknown, or other
tccccgcggtggcggccgctctagaactagtggatcccccgggctgcaggaattcgcacgagaccattacctagaacatcctaatcgaaaaaattcttccccgagtcgccgtcgtctgctccgggctgctgttctgcgcctccacaaggctttggcctctgttgtaagttttaagcttcacctccagccatgggtaaggagaagtcccacatcaacattgtggttattggccatgtcgactctggcaagtcaaccaccaccggccacctgatctacaagcttggaggcattgacaagcgtgtgattgagaggttcgagaaggaagccgctgaaatgaacaaacggtccttcaagtacgcttgggtgcttgacaagctcaaggctgagcgtgagagaggtatcaccattgatatcgctctgtggaagtttgagaccaccaagtactactgcactgtcattgatgcccctggacatcgcgacttcatcaagaacatgatcacgggtacctcccaggctgactgtgctgtcctgatcattgactccaccactggtggttttgaggccggtatctctaaggatggccagacccgtgagcatgctctccttgctttcacccttggggtcaagcagatgatttgctgctgcaacaagatggatgcgaccactcccaagtattccaaggcccgttacgn

SEQ ID NO: 16718 - protein, 167 aa, Zea mays
  misc_feature: Ceres CLONE 1381024-F
  misc_feature (5)..(167): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARY

SEQ ID NO: 16719 - DNA, 674 bp, Zea mays
  misc_feature: Ceres CLONE 1381035-F
  misc_feature: Encodes the peptide sequence at SEQ ID NO. 16720
agagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggggcgggaggcgttccagcgcacccccggactaccgtggagggaggcccacccgagggatgggcggaggccgccggcccccgcccggcccacgagaa

SEQ ID NO: 16720 - protein, 156 aa, Zea mays
  misc_feature: Ceres CLONE 1381035-F
  misc_feature (44)..(148): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPVFLIFSPVLVPAALLIGTAVMGFLTSGALGLGGLSSLTCLANTGREAFQRTPGLPWREAHPRDGRRPPAPARPTR

SEQ ID NO: 16721 - DNA, 703 bp, Zea mays
  misc_feature: Ceres CLONE 1381036-F
  misc_feature: Encodes the peptide sequence at SEQ ID NO. 16722
tacccgcggtggcggccgctctagaactagtggatcccccgggctgcaggaattcgcacgagaccattacctagaacatcctaatcgaaaaatcgcaagaaaaaggaaatcaaaacaaagtaaagtggggggaaaagcatggcgatagctcttctcccatccgttcgtcttcttccacaaagtctctccagaaggccaccaccaacctcgtcgccattatccgttcgccgcccacggccaagagcccttcccctccctcgcgtccactgccgcgccggccggaccccggaccccctcaccgctgctagggaggctgctgccttttgggctgggaagctcgccggcgctgtgccatggaaggccgcggtctccggcgtggtcgccctcgccgtctccttcacctgccttgttggtttggccaatgccagaactggggtaaacaaaccagaattgcttcctaaagaatttactaccgtcatcgatgttgctggttttctctcgtcaggccaggaaaaccgtttgcgccaagagatagaagacctggagaaagatacagggtacaaactgcgagttcttgcacaaaattatcctgatacacctggattggctatcaaagatttttggcaggttgatgagcgtactattgtttttgttgctgatccaacctttggtaacataataaattttaacattggtccattac

SEQ ID NO: 16722 - protein, 188 aa, Zea mays
  misc_feature: Ceres CLONE 1381036-F
MAIALLPSVRLLPQSLSRRPPPTSSPLSVRRPRPRALPLPRVHCRAGRTPDPLTAAREAAAFWAGKLAGAVPWKAAVSGVVALAVSFTCLVGLANARTGVNKPELLPKEFTTVIDVAGFLSSGQENRLRQEIEDLEKDTGYKLRVLAQNYPDTPGLAIKDFWQVDERTIVFVADPTFGNIINFNIGPL

SEQ ID NO: 16723 - DNA, 720 bp, Zea mays
  misc_feature: Ceres CLONE 1381037-F
  misc_feature: Encodes the peptide sequence at SEQ ID NO. 16724
ggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgctttcacccgtccgtcgcctctctctcggctgcctgattgatttggttgccccggttccagcaatggcggtccaggcgcattatcaccaccactaccaccgcgagtcccctttcctcgtcaggtacctgccgtggccgctgtgcatcttctaatcgtttcttccgcgtcgatcgtcggtctgctggatcgtattcggatgggtgatttgagcgtctgggttgtcagcggcgcgccggagggcagccggttggcggcggcgatggagctgcatcatcaggcgcagaaggaggctatggcgccgcagcaggctcaggctccgcccctcttcttggacttctcgcatggaggtaagcagatcaaacaaagcgcactccttggctccgcggcggatttcgtcttcttgggcagcagcaccgcacccttctgttccgatttcggatcgtgaaaagtcgtcggggacttaattgccggggtgctgtgtgcacatagattacggcggcggaaggaaccgcagcgccaggcggaacccatgtcctcccaatcttctct

SEQ ID NO: 16724 - protein, 82 aa, Zea mays
  misc_feature: Ceres CLONE 1381037-F
MGDLSVWVVSGAPEGSRLAAAMELHHQAQKEAMAPQQAQAPPLFLDFSHGGKQIKQSALLGSAADFVFLGSSTAPFCSDFGS

SEQ ID NO: 16725 - DNA, 695 bp, Zea mays
  misc_feature: Ceres CLONE 1381046-F
  misc_feature: Translation starting site: 217
  misc_feature: SWISSPROT Homolog: EC 1.2.1.27 Methylmalonate-semialdehyde dehydrogenase (acylating)
  misc_feature (456)..(456): n is a, c, t, g, unknown, or other
  misc_feature (463)..(463): n is a, c, t, g, unknown, or other
  misc_feature (494)..(494): n is a, c, t, g, unknown, or other
  misc_feature (505)..(505): n is a, c, t, g, unknown, or other
  misc_feature (509)..(509): n is a, c, t, g, unknown, or other
  misc_feature (510)..(510): n is a, c, t, g, unknown, or other
aaagctggagctccccgcggtggcggccgctctagaactagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcaggaagtggtgtccccggatcccgctcaccacggncgatgangtcaaagctgcggtcgatgcccgcaggacgnccttccccggntggnngaaaccgccggtcacaaccgggaagggggtcatggtcaattccaggaggctcatccggggtaaactgggacaagttgggaaaaaaattccctacgggaccggggaaaaaccttaaaaaagtttggggggaacggtttccccggccctaaagggggggaacaattttttggaaaagggaacccggg

SEQ ID NO: 16726 - DNA, 737 bp, Zea mays
  misc_feature: Ceres CLONE 1381050-F
  misc_feature: Encodes the peptide sequence at SEQ ID NO. 16727
  misc_feature (411)..(411): n is a, c, t, g, unknown, or other
  misc_feature (432)..(432): n is a, c, t, g, unknown, or other
  misc_feature (434)..(434): n is a, c, t, g, unknown, or other
  misc_feature (436)..(436): n is a, c, t, g, unknown, or other
  misc_feature (437)..(437): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (455)..(455): n is a, c, t, g, unknown, or other
  misc_feature (499)..(499): n is a, c, t, g, unknown, or other
ggagctccccgcggtggcggccgctctagaactagtggatcccccgggctgcaggaattcgcacgagaccattacctagaacatcctaatcgaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccacggagagggcagcgcccgccgcggcgntgcaggggttcctgtgcctgnangnnagtgacggnnnagcgtgnagctacgtggtgggacgtggggccgcaaaggggaagagcagggncggggccgtcccccgctggggcccgcgtcagggccggtgccgttgaattcgccccttccgcctggcgagggaaataatggcattcaataaaatcatatgggggggctgaagggtttcccagactggggacccccttcaaatggaccttacaggacccggaggggctccgaactttttctttgggggggcgggtgggaggttttacaaaaaaccccttggggggatcctgtgggagacc

SEQ ID NO: 16727 - protein, 97 aa, Zea mays
  misc_feature: Ceres CLONE 1381050-F
  misc_feature (54)..(54): Xaa is any aa, unknown, or other
  misc_feature (61)..(61): Xaa is any aa, unknown, or other
  misc_feature (62)..(62): Xaa is any aa, unknown, or other
  misc_feature (66)..(66): Xaa is any aa, unknown, or other
  misc_feature (68)..(68): Xaa is any aa, unknown, or other
  misc_feature (83)..(83): Xaa is any aa, unknown, or other
MAPAVGLKRSATQTITLPPPDTRLAVRDVMRSTIPSQPAVAPASTERAAPAAAXQGFLCLXXSDGXAXSYVVGRGAAKGKSRXGAVPRWGPRQGRCR

SEQ ID NO: 16728 - DNA, 636 bp, Zea mays
  misc_feature: Ceres CLONE 1381054-F
  misc_feature: Encodes the peptide sequence at SEQ ID NO. 16729
aagctggagctccccgcggtggcggccgctctagaactagtggatcccccgggctgcaggaattcgcacgagaccattacctagaacatcctaatcgaaaaactaaaaacatgggactccaccctgtctccgaggccaacgcttcaagccccttcggctctctctccgccgccgaattctactccctccattccgtcgcccactcctccgcctacatcaccaacccaaccggtctcaaactcttcacccaatggtggacccctctccaccgtccaccactcggcctcatcgccgtcgtccacggcttcaccggcgagtccagctggttcctccaactaacctccgtcctcttcgccaagtcagggttcctcacttgcgccatcgaccaccaaggccacggcttctccgacgggctaaccgctcacatccccaacatcaacctcatcgtcgacgactgcatctccttcttcgacgactttcgtaggcgtcacgctttcctcctcctccctagctttccttcctctaactccaaggccctcgggggggggggaaggttcttaaaataaccccccgcgcggaaaaaaaaaaagggggaggggtccctccccccccggggggggggggggggcccccata

SEQ ID NO: 16729 - protein, 151 aa, Zea mays
  misc_feature: Ceres CLONE 1381054-F
  misc_feature: SWISSPROT Homolog: EC 3.1.1.23 Acylglycerol lipase
MGLHPVSEANASSPFGSLSAAEFYSLHSVAHSSAYITNPTGLKLFTQWWTPLHRPPLGLIAVVHGFTGESSWFLQLTSVLFAKSGFLTCAIDHQGHGFSDGLTAHIPNINLIVDDCISFFDDFRRRHAFLLLPSFPSSNSKALGGGGRFLK

SEQ ID NO: 16730 - DNA, 666 bp, Zea mays
  misc_feature: Ceres CLONE 1381056-F
  misc_feature: Encodes the peptide sequence at SEQ ID NO. 16731
tggagctccccgcggtggcggccgctctagaactagtggatcccccgggctgcaggaattcgcacgagaccattacctagaacatcctaatccaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttaccgaaggagtggtgacggatggatccgatgaatgggcaatctacggcgggaccggagagtttgctatggcgagaggtgtcgtcaaaagaaggtaccttgccgatagggacggcgccgggaacactgacgagctcagcatgcaggtttttctgcccggtgtttggctcatcacagcagcaaacaagcaggcacgtgct

SEQ ID NO: 16731 - protein, 174 aa, Zea mays
  misc_feature: Ceres CLONE 1381056-F
  misc_feature (7)..(159): Pfam Name: Dirigent Pfam Description: Dirigent-like protein
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTDGSDEWAIYGGTGEFAMARGVVKRRYLADRDGAGNTDELSMQVFLPGVWLITAANKQARA

SEQ ID NO: 16732 - DNA, 662 bp, Zea mays
  misc_feature: Ceres CLONE 1381058-F
  misc_feature: Encodes the peptide sequence at SEQ ID NO. 16733
  misc_feature (618)..(618): n is a, c, t, g, unknown, or other
  misc_feature (620)..(620): n is a, c, t, g, unknown, or other
  misc_feature (646)..(646): n is a, c, t, g, unknown, or other
tggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacatacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaggtcgtcgtcgctaaggagccggagccggtggaggccgagactgagactgagaccaaggaggccgaggccgttgctgagccgaccgaggcagagcccaaggaagcagagccggaggccgccgcgccggcagcagagacggaggtcaaggaagcagagacggaggccgccgcgccggcagcagagacggaggctgctgctgccccggtcgaggctgctgagccggagatagccgccgagaccaaagaagtggcgctgggaangnccttacgaaggaggaagaggaggcancgcctgctgttgctgc

SEQ ID NO: 16733 - protein, 142 aa, Zea mays
  misc_feature: Ceres CLONE 1381058-F
  misc_feature (128)..(128): Xaa is any aa, unknown, or other
  misc_feature (129)..(129): Xaa is any aa, unknown, or other
  misc_feature (137)..(137): Xaa is any aa, unknown, or other
MAAVEVQVPTAAPVEEAAQLAAASAVETPNEETAAPAVETEVVVAKEPEPVEAETETETKEAEAVAEPTEAEPKEAEPEAAAPAAETEVKEAETEAAAPAAETEAAAAPVEAAEPEIAAETKEVALGXXLRRRKRRXRLLLL

SEQ ID NO: 16734 - DNA, 673 bp, Zea mays
  misc_feature: Ceres CLONE 1381059-F
  misc_feature: Translation starting site: 206
  misc_feature (391)..(391): n is a, c, t, g, unknown, or other
  misc_feature (452)..(452): n is a, c, t, g, unknown, or other
  misc_feature (530)..(530): n is a, c, t, g, unknown, or other
aaagctggagctccccgcggtggcggccgctctagaactagtggatcccccgggctgcaggaattcgcacgagaccattacctagaacatcctagtcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctnggtgctgtcgggggctggcgctgaacgcctcccgtggtggggctggccgtggccacgccgntgttcctgatcttcagccccgtgctggtcccgccgcgctgctcatcgggacggccgtcatggggtccctcacgtcggncgcgctgggggctcgggggcctgccctcgctcacgtggctcggcaacagggggcggaagcgttccagcgcacccggactacgtggaggagcgcacgcaggatggcggagggcgcgccgcagcgggccaaagaaccggccagca

SEQ ID NO: 16735 - DNA, 676 bp, Zea mays
  misc_feature: Ceres CLONE 1381070-F
  misc_feature: Encodes the peptide sequence at SEQ ID NO. 16736
aaagctggagctccccgcggtggcggccgctctagaactagtggatcccccgggctgcaggaattcgcacgagaccattacctagaacatcctaatcgaaaagttatatctcctcaaggcacgttcaccacagtcctctctttccccggcaccaccaccacccaggctaaccggactggaccgagtgttgaacaacactgagggcgaggcagatagagcgacggcaggcatggtgagccgtgaaaatttgcacctggtgctggacccggcgtctctgggcgcgccgtgggccgacccgtccgccgcagagatcccgccgcagctcctcgccgcgctggaagagtacctctcctccacccgcgccgagggcggtgacgtcgcgacggaggaggacgaccagttcatgatgcacaagttcaaggtgcgtgagtgcgcgcgcgcgcggaatcactagtggacggtgtgcccctacgagtatacgaccgaggacgcgcggcgcttggacccgaggcgcgtgacttagatcgaggagcctgttgatgtaattacgactgacaactaaacagtgaggcttttgtgcattggcttcactatgacacgtgctaaacgaggcatgagaactgggtatgctcacgctacgcaaagccagcagattctgaagaagatgagggacatg

SEQ ID NO: 16736 - protein, 74 aa, Zea mays
  misc_feature: Ceres CLONE 1381070-F
MVSRENLHLVLDPASLGAPWADPSAAEIPPQLLAALEEYLSSTRAEGGDVATEEDDQFMMHKFKVRECARARNH

SEQ ID NO: 16737 - DNA, 682 bp, Zea mays
  misc_feature: Ceres CLONE 1381078-F
  misc_feature (426)..(426): n is a, c, t, g, unknown, or other
  misc_feature (457)..(457): n is a, c, t, g, unknown, or other
  misc_feature (568)..(568): n is a, c, t, g, unknown, or other
  misc_feature (569)..(569): n is a, c, t, g, unknown, or other
  misc_feature (592)..(592): n is a, c, t, g, unknown, or other
  misc_feature (638)..(638): n is a, c, t, g, unknown, or other
  misc_feature (668)..(668): n is a, c, t, g, unknown, or other
tggagctccccgcggtggcggccgctctagaactagtggatcccccgggctgcaggaattcgcacgagaccattacctagaacatcctaatcgaaaaaatcctgtctactactaccatcgccgtccttgtgtttcatttttaatgaccattctctcatctgctgctggctgcggctatatacccccctctctctgtctctctatctcctcctgttcttagacgtttctccagagcctgaagccaaatctagggggcttgcttcatctgctgtccgagcgtggtttggtttctcggggctggcgcggtcaagagctcacctgagttccaccgaaatctgccacggtagttcttgcctaggtgtgtcgttgcgttgtgaccccttgcggattttcttggttttcttttgagttgcgatctttgcaggntagtctcccccccaatccgtaatcatccggncgtctaagaaattgcagtccagtttgcttaaattgtcgtctagtgccttctccccatcctggttagaaagatatcggaaagggggattttttttttttttgctggtcgtannagaagcagtgaagaactaattgntgcatctgataaagtcggggcgaatacaagcaatccttgtaaattngcatccctttgctggctcttttctgaatcnaagaacccatgggg

SEQ ID NO: 16738 - DNA, 621 bp, Zea mays
  misc_feature: Ceres CLONE 1381080-F
  misc_feature: Encodes the peptide sequence at SEQ ID NO. 16739
  misc_feature (196)..(196): n is a, c, t, g, unknown, or other
  misc_feature (235)..(235): n is a, c, t, g, unknown, or other
  misc_feature (239)..(239): n is a, c, t, g, unknown, or other
ggagctccccgcggtggcggccgctctagaactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcnactcgtgaggatgtggatcgcgaggcggctcttcctcgncgcngcggcgctgctgatggctgggcttctgctccgcccggggcccgtggcggcgcaagacacggcgggggagggcctggcccccgcctggggaggaaaatccgggcgaaacccaaggcccaggaaggcgggggttttgggcccccaagttaagggagtttaaggggaaaaaatcccccgtataaaatctcccaattggaaaaaaaaaaacctggggttccaaaaccaaaaaagggggctccccaaaaacctgtaaattaattttgcggggaaaaaaccccccaaaaattttttttattttgaaagaaagaaaattttctcccccggggcacaaaggggttttttttttttggaagagagaagggaaaaaaaagcgcccgtttttt

SEQ ID NO: 16739 - protein, 63 aa, Zea mays
  misc_feature: Ceres CLONE 1381080-F
  misc_feature (10)..(10): Xaa is any aa, unknown, or other
MWIARRLFLXAAALLMAGLLLRPGPVAAQDTAGEGLAPAWGGKSGRNPRPRKAGVLGPQVKGV

SEQ ID NO: 16740 - DNA, 658 bp, Zea mays
  misc_feature: Ceres CLONE 1381087-F
  misc_feature: Encodes the peptide sequence at SEQ ID NO. 16741
tccccgcggtggcggccgctctagaactagtggatcccccgggctgcaggaattcgcgcgagaccattacctagaacatcctaatcgaaaaactccgcctgcatctccaaagcacactgctccctctggcttcccgcctcctcttcggctccttcgcgtcccgacgccccctcatggccaccgccgccgccaccgcagcagcagcagcagtctcctccccggctgcgcgtggagcagccggggccgccgccgcctcccgccgggggttcgtcacgtttggtggaggcgccgcccgcttctctcccacgctgcggtccggccgtgggttctctggtgtgcaaacccatgttgctgctgttgaacaagcagttgtaaaagatgctaccaagctggaagctcccagttgtgttgttacaggtgcatctagagggattggtaaggcaactgctctagcctttggaaaagcaggatgcaaggttctggtaaactatgcccgggtcctcaaaagaggctgaagagggtctccaaagagattgaagcatctggtggggaggctatcaccttccggaggagatgtttcaaaggaagctgatgtagagtctatgatgaaagcagctctagataaatgggaaacaaaagatggggctgtaaaaaaagg

SEQ ID NO: 16741 - protein, 113 aa, Zea mays
  misc_feature: Ceres CLONE 1381087-F
  misc_feature: SWISSPROT Homolog: EC 1.1.1.100 3-oxoacyl-[acyl-carrier-protein] reductase
MATAAATAAAAAVSSPAARGAAGAAAASRRGFVTFGGGAARFSPTLRSGRGFSGVQTHVAAVEQAVVKDATKLEAPSCVVTGASRGIGKATALAFGKAGCKVLVNYARVLKRG

SEQ ID NO: 16742 - DNA, 692 bp, Zea mays
  misc_feature: Ceres CLONE 1381092-F
tggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctgggggattcgttgtacggcacagaccgagggttgagcgcatcgagcgagacaagagccgagatcggagatctaatcacacaggtcgagtccaagaaccctacaccagctcccaccgatgctctcttccttctcaacggcaaatggatccctcgcgtaacccatcgttcgttggttttgttccccgtttgctttcacgaaaggaatcgtggccctttaggttaaagtccaacgaagatcctccaaaaaattatggaaatccgcgaaaa

SEQ ID NO: 16743 - DNA, 833 bp, Zea mays
  misc_feature: Ceres CLONE 1381093-F
  misc_feature: Encodes the peptide sequence at SEQ ID NO. 16744
  misc_feature (44)..(44): n is a, c, t, g, unknown, or other
  misc_feature (45)..(45): n is a, c, t, g, unknown, or other
tctccacacccgctgttatttatcaccccgaccgcccccccccnnccccaaagctggggctccaccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgaaggcgctgacggtggcgaagctgttcccgctgggccgcgctgctggctggtggcttgcccggggctgggggctgaacggccctcccggggggggggctgggccgggggccacccccgggtggtttccggattctttcaccccccggggggtggtcccccggcccgggcttgttacatcggggaacggcccgtcattgggggttccccccaccgcccgggcgcggcttgggggctttgggaggggcctgggtcctccgcttccctgtggccttggccaaaaaacagggggggggtcgaggtggttctcctcgcccaccccccggaatttacccggggagaggaaggccgcaccccccccacaaaggtccgggaaaggccctccgcggcacacacgctggggtcctcaaaaaaaaccgcgccaagtcaaatgcccaccgcc

SEQ ID NO: 16744 - protein, 192 aa, Zea mays
  misc_feature: Ceres CLONE 1381093-F
MADRDRSGIYGGAHATYGQQQQQGGGGRPMGEQVKGMLHDKGPTASKALTVAKLFPLGRAAGWWLARGWGLNGPPGGGAGPGATPGWFPDSFTPRGVVPRPGLVTSGNGPSLGVPPTARARLGGFGRGLGPPLPCGLGQKTGGGSRWFSSPTPRNLPGERKAAPPPQRSGKGPPRHTRWGPQKKPRQVKCPP

SEQ ID NO: 16745 - DNA, 666 bp, Zea mays
  misc_feature: Ceres CLONE 1381100-F
  misc_feature: Encodes the peptide sequence at SEQ ID NO. 16746
  misc_feature (357)..(357): n is a, c, t, g, unknown, or other
  misc_feature (401)..(401): n is a, c, t, g, unknown, or other
  misc_feature (457)..(457): n is a, c, t, g, unknown, or other
tggagctccccgcggtggcggccgctctagaactagtggatcccccgggctgcaggaattcgcacgagaccattacctagaacatcctaatcgaaaaatatttcagtcgtcgctcgcggagccgtggcgcatcgcgactcaggcactcaccgaccgcggatatggccccgccgccatggcctctccttgcgacttccctcctcctcatcctattccaccactcgcctcgcgccgcggtggcgtttccgccgtctctgggcgacagcctcctgggcgccgcccgcgcgccgggtttcgcggcttggctgcgcggcttgcggcgccgcatccacgagcgccccgagctcgccttccagnagcaccgcaccagcgagctcgtccgcgacgagctcgacgcgatncgggtgccgtacgcgtggcccgtcgcgcagacgggcgtcgtgccgaccatcgccgncggcagcgatggccccgtcgtcgcgctccaagccgacatggacgcgctacccttgcaggaattggtagactgggaacacaagaccaaggaaagtggaaagatgcatgccttgggaaaatgatgctcaacccacgatggttctttgggcaagctaaattgcttcattggtcgaaagatgaactgaaggggaccgggaaactttgccttcc

SEQ ID NO: 16746 - protein, 138 aa, Zea mays
  misc_feature: Ceres CLONE 1381100-F
  misc_feature: SWISSPROT Homolog: EC 3.5.1.32 Hippurate hydrolase
  misc_feature (66)..(66): Xaa is any aa, unknown, or other
  misc_feature (80)..(80): Xaa is any aa, unknown, or other
  misc_feature (99)..(99): Xaa is any aa, unknown, or other
MAPPPWPLLATSLLLILFHHSPRAAVAFPPSLGDSLLGAARAPGFAAWLRGLRRRIHERPELAFQXHRTSELVRDELDAXRVPYAWPVAQTGVVPTIAXGSDGPVVALQADMDALPLQELVDWEHKTKESGKMHALGK

SEQ ID NO: 16747 - DNA, 643 bp, Zea mays
  misc_feature: Ceres CLONE 1381103-F
gctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcgaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaagggcaccaagctctgcgatttggggcctagggacagcgtatgcgcagtgcattggtcacgggaaagctcttatctttccattgggaccggccttggagatgtccaaatttgggatagttctcggtggaagcggatta

SEQ ID NO: 16748 - DNA, 750 bp, Zea mays
  misc_feature: Ceres CLONE 1381105-F
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (20)..(20): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (750)..(750): n is a, c, t, g, unknown, or other
nnnncccccccccaacaacncacccaccaaagggaaannnnatctnnnnnnnacaaagctgggactccaccgcggtggcggccgctctagaactagtggatcccccgggctgcaggaattcgcacgagaccattacctagaacatcctaatcgaaaaataggaatcatccatcgcgtctgtgctccccctcgcgcaatcctaccgcactcgcctcccgaaatcggcgcgccacgggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctccgctcgcgtcagcctcggccagcgtcacaagtggcggccgccgccgggggtcggctacttcgatcttcccgccccgccgtcgactcgtccaggaggacctacggctctgaaacccaatcccctcccccgggggcgaaccggatcgggctggacccatcccccaagctcggcgcggggaggcccataccggaaagccgaaattgggccccggggccgtcccccccgcattcaacctccaaaacccgaaagggaacggacccaaagcgggggagtcctaaaaaggttccaaaggaggcaaaaccggggcaacccccgccccgtgggattcttn

SEQ ID NO: 16749 - DNA, 716 bp, Zea mays
  misc_feature: Ceres CLONE 1381113-F
  misc_feature: Translation starting site: 146
  misc_feature (364)..(364): n is a, c, t, g, unknown, or other
ggcggccgctctagaactagtggatcccccgggctgcaggaattcgcacgagaccattacctagaacatcctaatcgaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtccccagatgaaggtgtgcatgcttggtgatgcccagcatggntgagaggcccgagagatgggacttgactacatggatgttgaggctctcaagaaaaatgaacagaacagaaagcttgttagaggctttgcaaaaataccatgctttctgtggatcagaggcattcttcaggaaattcccggctcctttggcctgggcccaaaaagggaggaaattcccgaccctgtttatccaccggaatcctcgagccagggggaaggaactagggacccgcaagttcccgctcaaaaggccttttggtgggggcgcccccccaaacttggggtgggggaaaaaaattccccaaaacccccagtgggggccttttctgtttcccctttaaaaaaaaggggag

SEQ ID NO: 16750 - DNA, 715 bp, Zea mays
  misc_feature: Ceres CLONE 1381114-F
  misc_feature: Encodes the peptide sequence at SEQ ID NO. 16751
  misc_feature (311)..(311): n is a, c, t, g, unknown, or other
  misc_feature (312)..(312): n is a, c, t, g, unknown, or other
  misc_feature (439)..(439): n is a, c, t, g, unknown, or other
  misc_feature (443)..(443): n is a, c, t, g, unknown, or other
  misc_feature (444)..(444): n is a, c, t, g, unknown, or other
  misc_feature (471)..(471): n is a, c, t, g, unknown, or other
  misc_feature (507)..(507): n is a, c, t, g, unknown, or other
  misc_feature (552)..(552): n is a, c, t, g, unknown, or other
  misc_feature (553)..(553): n is a, c, t, g, unknown, or other
  misc_feature (580)..(580): n is a, c, t, g, unknown, or other
  misc_feature (582)..(582): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
tcataactagagggtcccccgggctgcaggaattcgcacgagaccattacctagaacatcctaatcgaaaaatttccattcctcgctcaccaagccaacagccaaatccaattcgccgacgactctctttattcctcccgctcgccgccgccgccaccgcctgagggcaagaagcgagcgagcgcaccgcgggaattccctctcccgggcccgccggcgcggaccgcgtgaagaacacgagccccctcgtgaatggtgggagaccccgcgcgacgtccggtcgcctcgcagccgcagccggaggaggctcnncttccgcggcttcggttactgcatggcagggctggtaccacccgctgcatcggtctcgacccctggaaccccgccgccacttgcttcttcgatttgattttcaattcggttcgttcggtgcccctcnccgnntcctggatctgttgcgcgagagcgcgncagcgcgcgagattcgccccccttctcttctcctangaagcaggaaagcagcgaccgctcgctgacgccgcggcagggggnncgtcgccgtgcgagaaactttctgggnangtggagaaccgcgcaggcnnnnnnncgcgggggggcgaaaaccctgggcgnnnnngggggggggacggaccggcctctccgaggccccgggccgttgcgctttnnnnnncccccgaggggggggcaaccccgc

SEQ ID NO: 16751 - protein, 154 aa, Zea mays
  misc_feature: Ceres CLONE 1381114-F
  misc_feature (20)..(20): Xaa is any aa, unknown, or other
  misc_feature (63)..(63): Xaa is any aa, unknown, or other
  misc_feature (64)..(64): Xaa is any aa, unknown, or other
  misc_feature (85)..(85): Xaa is any aa, unknown, or other
  misc_feature (101)..(101): Xaa is any aa, unknown, or other
  misc_feature (110)..(110): Xaa is any aa, unknown, or other
  misc_feature (117)..(117): Xaa is any aa, unknown, or other
  misc_feature (118)..(118): Xaa is any aa, unknown, or other
  misc_feature (119)..(119): Xaa is any aa, unknown, or other
  misc_feature (128)..(128): Xaa is any aa, unknown, or other
  misc_feature (129)..(129): Xaa is any aa, unknown, or other
  misc_feature (145)..(145): Xaa is any aa, unknown, or other
  misc_feature (146)..(146): Xaa is any aa, unknown, or other
  misc_feature (147)..(147): Xaa is any aa, unknown, or other
MVGDPARRPVASQPQPEEAXLPRLRLLHGRAGTTRCIGLDPWNPAATCFFDLIFNSVRSVPLXXSWICCARARQRARFAPLLFSXEAGKQRPLADAAAGGXSPCEKLSGXVENRAGXXXRGGENPGRXXGGDGPASPRPRAVALXXXPEGGATP

SEQ ID NO: 16752 - DNA, 669 bp, Zea mays
  misc_feature: Ceres CLONE 1381122-F
  misc_feature: Encodes the peptide sequence at SEQ ID NO. 16753
tggagctccccgcggtggcggccgctctagaactagtggatcccccgggctgcaggaattcgcacgagaccattacctagaacatcttaatcgaaaaaacaccgccctcttgtgctctccctgtccctgccctcccccgctataataccgccacgccctcgtcgccatcgtcaccacaccaccactccctccctgccctctcactcccgatccctcctccaccaccgcttcctccgcgtcacccctctcgtcgtcgcctcacgaggcgaccagcggcggaccctccgcggcgcaaccatggggctcttcaccgtgacgaagaaggccaccacgcccttcgacggccagaagcccggcacctccggcctccgcaagaaggttactgtattccagcagccccattatctgcagaactttgtccaatcaacattcaatgcccttcctgtggatcaagtaagaggtgcaacaattgttgtctctggtgatggccgctatttctcaaaagatgctgttcagatcataacaaaaatggctgctgccaatggagtaagacgtgtttgggttggacaaaacagtctcatgtctactcctgctgtatctgctgtcatccgtgaaaaagttggtgcagatggatcaaaggctactggtgccttcatcttgacagcgagc

SEQ ID NO: 16753 - protein, 124 aa, Zea mays
  misc_feature: Ceres CLONE 1381122-F
  misc_feature (16)..(124): Pfam Name: PGM_PMM_I Pfam Description: Phosphoglucomutase/phosphomannomutase, alpha/beta/alpha domain I
  misc_feature: SWISSPROT Homolog: EC 5.4.2.2 Phosphoglucomutase
MGLFTVTKKATTPFDGQKPGTSGLRKKVTVFQQPHYLQNFVQSTFNALPVDQVRGATIVVSGDGRYFSKDAVQIITKMAAANGVRRVWVGQNSLMSTPAVSAVIREKVGADGSKATGAFILTAS

SEQ ID NO: 16754 - DNA, 693 bp, Zea mays
  misc_feature: Ceres CLONE 1381123-F
  misc_feature (693)..(693): n is a, c, t, g, unknown, or other
ggagctccccgcggtggcggccgctctagaactagtggatcccccgggctgcaggaattcgcacgagaccattacctagaacatcctaatcgaaaaaaactcgcagattgagttcaagcattcaccggagaatccccaaatcacactctccagtaaccgtccgctactccagccgcatctctagccgagcctatctcctcctcttccgacgccgcatctatcctagtgtcttgcttcgccgtggtctcggcgatcgttgaccacctcaccgtcgtcgcggcgtcgcaggcgccggccggcgcctcgaccacggctcccaaaggggcacccaggatgttcacggtgacaactccccctgctcggtcctcggcaagaggcccggtgcctgccgccaggccgattatccccgcaagtgtggccccgcaagattcattgccagcccggggaccggaggacacgggacccctgggcggtcgccgggagggccgactatgttccgggggagggcgcccaggtggtgacccaaagggctggctcttcgggggggagggaccggcatcgaagggatacaaaccaggggggtcggcaaactccgggcggcaggctggtgaagctcccggagaataatgtttagccccgcattgcggtggaaaaaacaaggggggggcgggtggagtctacgaacgaccggan

SEQ ID NO: 16755 - DNA, 598 bp, Zea mays
  misc_feature: Ceres CLONE 1381125-F
  misc_feature: Encodes the peptide sequence at SEQ ID NO. 16756
gctctagaactagtggatcccccgggctgcaggaattcgcacgagaccattacctagaacatcctaatcgaaaaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcggcagcatcggccgccgctccgcccgcatcgcctactgcggcctcttcgcgctctccctcttcgcatcctgggcgctccgcgaggtcgccgcgcccctccctcagtcgatcccatgggattaaccacttccacaagacccccgaccggcgagtgggtcgaggacgacgcgggggtcagggtcagcctcgggaaatttcctcttcttcaccatcttcgccggcatcttgggcgggaataagggcccagaaggacccccgggaaaagatcccccacggggggatgggggggcaaaaatttttcgg

SEQ ID NO: 16756 - protein, 63 aa, Zea mays
  misc_feature: Ceres CLONE 1381125-F
MWAASCLASCCAACACEACRTAVGSIGRRSARIAYCGLFALSLFASWALREVAAPLPQSIPWD

SEQ ID NO: 16757 - DNA, 654 bp, Zea mays
  misc_feature: Ceres CLONE 1381127-F
  misc_feature: Encodes the peptide sequence at SEQ ID NO. 16758
gctctagaactagtggatcccccgggctgcaggaattcgcacgagaccattacctagaacatcctaatcgaaaactaacgctgtccgccgccacctctcctccggcatcgacgaggcgaaaccctagcgcccgagtccctctccctgctcccacaacccatggcggcggatatggcgtacgcgccgccgatgaaggctggcaaggccgggttcgaggctggcatgatggatccacagcacaggatccgcatcacgctctcctccaagagcgtcaagaacctcgagaaagtctgcggggatctggtgaagggcgccaagggtaaggagctcaaggtcaagggccccgtgcggatgcctaccaaggtgctccacatcaccacccaggaagtctccctgtggagaagggtaccaacacctggggatcgctttgagatgaggattcacaagagggtgatcgatctcgtcagtacaccagacgttgtcaagcagatcacctcaatcaccattgaaaccaggtggcgagggtgaggtgactatcagggacgcttaatatgggagcccttatcatttcaaaaggggttctagggaacaggatattttcaattcctagggaaaacttgtgtaacagaggaatccaagtatttcatatcaaag

SEQ ID NO: 16758 - protein, 122 aa, Zea mays
  misc_feature: Ceres CLONE 1381127-F
  misc_feature (28)..(118): Pfam Name: Ribosomal_S10 Pfam Description: Ribosomal protein S10p/S20e
MAADMAYAPPMKAGKAGFEAGMMDPQHRIRITLSSKSVKNLEKVCGDLVKGAKGKELKVKGPVRMPTKVLHITTQEVSLWRRVPTPGDRFEMRIHKRVIDLVSTPDVVKQITSITIETRWRG

SEQ ID NO: 16759 - DNA, 853 bp, Zea mays
  misc_feature: Ceres CLONE 1381131-F
  misc_feature: Translation starting site: 267
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (23)..(23): n is a, c, t, g, unknown, or other
  misc_feature (24)..(24): n is a, c, t, g, unknown, or other
  misc_feature (39)..(39): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (853)..(853): n is a, c, t, g, unknown, or other
nnnnnnnnnnnnggggggggaannaggtgggggacaccncacnnnnnnnnncaaagctggggctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcactaccggaaagggagcggccgcgccgaaacagggaaatgccgagagccgagtgcccgcgaggcggcacccagcaaagcctgaccgcggggccgaaggaaccggccgaccagccggccggtggaacgcccttaacgttctccccgccttcccgggaaggggggcccaagggtgcccggacgcccaggtggctctgggcgccccgcccacccgaaggggcccaaagccggggcggtaaaaacccacaggaaagggccattggagggccggtgggcccgcccggcccgcgggaactggggcccgtccgaacatggggaggcaaaagagttacccgggcccccggcaaagccgaagaagccccggggccaaaggggccccggggaagaaggggggctaaaggccccccaccaaccggcccgggaactgggtggggn

SEQ ID NO: 16760 - DNA, 706 bp, Zea mays
  misc_feature: Ceres CLONE 1381132-F
  misc_feature (348)..(348): n is a, c, t, g, unknown, or other
gcgggaattcgcacgagaccattacctagaacatcctaatcgaaaactggtgagtccacactccccactccattatctaccatcacactgacacgttcatagctagctagtcgtcaggctagtaacttacgacgggataatctcgatctgggagcgagggggaggacgaccaccatgaacatgacctccgtgcccgcggtagcggcggtgatggtggtggtggtggtgctcgctctctgcgggggggacgactgtgacccgccacgtccttttgcccggggtgatgatcttcggccaaccttttttttccccccccccggggggaaagaaagggggaatttttccttncccctctatttccccccccccacgcccccccacttatcccgcgcccgcccgggccgccgcggggggggctgggggcggcgggggaacgctccccccccccaactacgcgtggggcgaagggcgggtgggggctcgagcgctcaccccccccgcggcgcgacacgcccccccgaggcggcgcgcgtgggggggaaagagatggaggcgcgcgggtccccgggtccgcggcctcgggccgccccggcggccggtcgcggtgcccggcgcggcgcgaccgcggtcccgccgcggttctccccccccccgcctcccccctccccgctccgcgtgctcgccgccgcggggggcgcccccggcg

SEQ ID NO: 16761 - DNA, 660 bp, Zea mays
  misc_feature: Ceres CLONE 1381140-F
  misc_feature: Encodes the peptide sequence at SEQ ID NO. 16762
  misc_feature (457)..(457): n is a, c, t, g, unknown, or other
  misc_feature (539)..(539): n is a, c, t, g, unknown, or other
tccccgcggtggcggccgctctagaactagtggatcccccgggctgcaggaattcgcacgagaccattacctagaacatcctaatcgaaaactctcgatgaggaaatggaattcaaagaatttgcacagaggccagatgcatatgccaagctctgctcaatgattggtccttcaatttatggtcattctgatgtcaagaaagctattgcatgcttgttatttggggggtctaagaagaggctacctgatggtgtacgtttgagaggggacattcatgtcttgcttctgggtgacccatccacagcaaaatcacagttcctcaaatttgtagagaagactgcccctattgcagtctatacatctggcaaaggttcatctgcagctggtcttacagcatctgtaactcgggatagtagctcgcgcgagttttatttggaaggaggagccatggttttgnctgatgggggagtagtttgtatcgatgaatttgacaagatgcgaccctgaagacgagtggcgattcagagggcatggaacancaaaaaatatctattgccaaaggctggattacacggaactcaatcaaggacttcagttttggaactgccatccattggcggacctttgatgtcttaaactcccaaaaaaatttggcccccc

SEQ ID NO: 16762 - protein, 133 aa, Zea mays
  misc_feature: Ceres CLONE 1381140-F
  misc_feature (2)..(134): Pfam Name: MCM Pfam Description: MCM2/3/5 family
  misc_feature: The sequence is a functional homolog of SEQ ID NO 8 in US patent 7189893
  misc_feature (118)..(118): Xaa is any aa, unknown, or other
MEFKEFAQRPDAYAKLCSMIGPSIYGHSDVKKAIACLLFGGSKKRLPDGVRLRGDIHVLLLGDPSTAKSQFLKFVEKTAPIAVYTSGKGSSAAGLTASVTRDSSSREFYLEGGAMVLXDGGVVCIDEFDKMRP

SEQ ID NO: 16763 - DNA, 671 bp, Zea mays
  misc_feature: Ceres CLONE 1381145-F
  misc_feature: Encodes the peptide sequence at SEQ ID NO. 16764
tggagctccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattgggtgactcttccgagaacatgctggctgacacttacgtgtggagggatgcagaggatctcattctttatggaaaatgggactttgaggggaatgacttgtttcctgcagccctggggggttaatggtatgggagtatcatgctaccgggattataatcaaaggatgaactctatcagttactggccggcctccgggatctaaaatttctggttgggacccccgcaca

SEQ ID NO: 16764 - protein, 143 aa, Zea mays
  misc_feature: Ceres CLONE 1381145-F
  misc_feature (19)..(118): Pfam Name: AIG2 Pfam Description: AIG2-like family
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTRTRVEISLGDSSENMLADTYVWRDAEDLILYGKWDFEGNDLFPAALGG

SEQ ID NO: 16765 - DNA, 665 bp, Zea mays
  misc_feature: Ceres CLONE 1381150-F
  misc_feature: Encodes the peptide sequence at SEQ ID NO. 16766
ctggagctccccgcggtggcggccgctctagaactagtggatcccccgggctgcaggaattcgcacgagaccattacctagaacatcctaatcgaaaaaagaaaataggagcagcttcacctcggaagctcagactcaatggttggtgcgaaggggtgtgagagatgcagggactggcaggagcactactactgggagcatatggatgcgagcaagatccgcttcttcaggtgcatgacaggagactttgctcatcgcattagcgtgccagagaagttcgcaaagaacttcaaggggcagatcaccgaagagtttcacctgaaatcacctagcagcgctgagacatggcacgtcggtgtagagaagcatggcgacaaactattcctcgtgtcagggtgggagaatttcgccaaggctcatgagctggaggagaacgatctcctgctcttcgcttgctctggaaactcttcctttgaggtcctagtcttcggagcaagtggctgtgagaaagtgtcatccctgtttggcagtggacttggtccggacatgggcaaacaatcaatgatgtggtgcgtccacatggtgtgcatcactctgtgactgtgagtgattctgaggataccgttgcgccgtcccagctggttcgatcccctcgtaacgcttgg

SEQ ID NO: 16766 - protein, 153 aa, Zea mays
  misc_feature: Ceres CLONE 1381150-F
  misc_feature (28)..(122): Pfam Name: B3 Pfam Description: B3 DNA binding domain
MVGAKGCERCRDWQEHYYWEHMDASKIRFFRCMTGDFAHRISVPEKFAKNFKGQITEEFHLKSPSSAETWHVGVEKHGDKLFLVSGWENFAKAHELEENDLLLFACSGNSSFEVLVFGASGCEKVSSLFGSGLGPDMGKQSMMWCVHMVCITL

SEQ ID NO: 16767 - DNA, 716 bp, Zea mays
  misc_feature: Ceres CLONE 1381151-F
  misc_feature: Encodes the peptide sequence at SEQ ID NO. 16768
cgcggtggcggccgctctagaactagtggatcccccgggctgcaggaattcgcacgagaccattacctagaacatcctaatcgaaaagcactcaagccctgcccatcagcacaaccaccaccaccaccgcctggccgtaacgtcacacgctcgcctccttccatggcgcccaggaacgctctccccgccgccagcgccgtggccaacggcatggtgatggagccgaggttccgcggcgtccggaagcgcccgtgaggcaggttcgcggcggagatccgggacccggccaggaaggcgcgcgtgtggctcggcaccttcaacaccgccgaggccgcggcgcgcgcctacgacgccgcagcagctccagttgcgagggccaaaggccaagaccaacttcccccgtcgcgttcgccggggtttccgccggccgccgccgccaaaaaagccgggcccgccgtgaccggtgacccccagcaagcaaaaggaccggtggaattcctcctccctcctcctcccgggaatgggcccggccatgccgcacaggaccgggttatcggtccagaagggcccggtccatcaagctctagcctaaggggggaccccggccatggtgggcccccacccgtttcttcttcctggaaccaaagctccccgtcgaccgggggcctcccccgggaccgttgcctcaccggccaaccgggttttgcgccgggggc

SEQ ID NO: 16768 - protein, 30 aa, Zea mays
  misc_feature: Ceres CLONE 1381151-F
MAPRNALPAASAVANGMVMEPRFRGVRKRP

SEQ ID NO: 16769 - DNA, 698 bp, Zea mays
  misc_feature: Ceres CLONE 1381152-F
  misc_feature: Encodes the peptide sequence at SEQ ID NO. 16770
  misc_feature (391)..(391): n is a, c, t, g, unknown, or other
  misc_feature (415)..(415): n is a, c, t, g, unknown, or other
ggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtggatctgccacctccggttcacctgccacctccggggcatctcccaccgccggtccacctggtttttttccccccccccggggggaaagaaagcggggtccctccnccaatttcattttcccccccgccncctgggcactaacgctactcaccggccggcggggggggcgccatcgccacggaccgcccaggccgcggcgcgccagccccgatccaggcgccgggccaccctggcagataaccagggggggcggggccccgcgccgcgccctcccccccggcgggggggggtcgcggggtcgatacgcggcttccccggggagggacggcccaagcggaccgccgacggagcgaccggtcgcgcgcgcgtggtcgacgcccggaccaccccccccctccccccgccgtccgcg

SEQ ID NO: 16770 - protein, 86 aa, Zea mays
  misc_feature: Ceres CLONE 1381152-F
MRVLLVALALLALAASATSTHTSGGCGCQPPPPVHLPPPVDLPPPVHLPPPGHLPPPVHLVFFPPPGGKESGVPPPISFSPPPPGH

SEQ ID NO: 16771 - DNA, 715 bp, Zea mays
  misc_feature: Ceres CLONE 1381161-F
  misc_feature: Encodes the peptide sequence at SEQ ID NO. 16772
  misc_feature (589)..(589): n is a, c, t, g, unknown, or other
  misc_feature (590)..(590): n is a, c, t, g, unknown, or other
  misc_feature (678)..(678): n is a, c, t, g, unknown, or other
  misc_feature (679)..(679): n is a, c, t, g, unknown, or other
tccccgcggtggcggccgctctagaactagtggatcccccgggctgcaggaattcgcacgagaccattacctagaacatcctaatcgaaaaatggtcacgctagctgtagctttttgcagagcgtcgtctgtaaatacgtagcccttccacaagcgaggcaaggggggagagagtatcgtcagctagcagagagagtgcgtagcaactagcaatggcggagaaccctgctccgagttccccgctagtgacttctcccgacgccgctgcgccgcctctgccagcggagttcaccaagctcaccttccgtagcctgtacatccgtcggacaggtccaggcagccgggagatgactgtggacgggaggccgtctgaccagctgggacgacggttcgtgagcgactttcccatatacgatggccgtggctccggcgcccacctcgtcgctcgcttgcagggagtcactgtccaaatcggcagctcgcaccagctagtcagcatcgtcttcgaggccgagaggcttaagggctccacgctgctcaccaacggagtgataacggatgggtcagacgagtgggccatctacgtggnnaaccggggtgttcgcatgggccaccgggtaataaccgaagaggtttctcgccggtagcaacgacgggaactctgagattccccccccnnttcgagtttttttccccccgggggtttgcctcggca

SEQ ID NO: 16772 - protein, 144 aa, Zea mays
  misc_feature: Ceres CLONE 1381161-F
  misc_feature (126)..(126): Xaa is any aa, unknown, or other
MAENPAPSSPLVTSPDAAAPPLPAEFTKLTFRSLYIRRTGPGSREMTVDGRPSDQLGRRFVSDFPIYDGRGSGAHLVARLQGVTVQIGSSHQLVSIVFEAERLKGSTLLTNGVITDGSDEWAIYVXNRGVRMGHRVITEEVSRR

SEQ ID NO: 16773 - DNA, 740 bp, Zea mays
  misc_feature: Ceres CLONE 1381164-F
  misc_feature: Encodes the peptide sequence at SEQ ID NO. 16774
  misc_feature (550)..(550): n is a, c, t, g, unknown, or other
  misc_feature (643)..(643): n is a, c, t, g, unknown, or other
  misc_feature (644)..(644): n is a, c, t, g, unknown, or other
  misc_feature (683)..(683): n is a, c, t, g, unknown, or other
aaactggagctccccgcggtggcggccgctctagaactagtggatcccccgggctgcaggaattcgcacgagaccattacctagaacatcctaatcgaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgaggactggcacctaccgccagctcttccaccctgagcagctcatcagtggggaaggaggatgcagccaacaatttttgccgtggtcactacaccattggncagggagattgttgacctatgccttgatcgcatcaggaagcttgccgacaactgcactggtctccagggcttctcgtcttcaccgctggtggnnggaagaacgggctcttggcccttggttcctctcctaaangggcgctggctgtgacttacgcaagagcccccaggttttggggttcactgtgaccct

SEQ ID NO: 16774 - protein, 154 aa, Zea mays
  misc_feature: Ceres CLONE 1381164-F
  misc_feature (112)..(112): Xaa is any aa, unknown, or other
  misc_feature (143)..(143): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGEGGCSQQFLPWSLHHWXGRLLTYALIASGSLPTTALVSRASRLHRWWXEERALGPWFLS

SEQ ID NO: 16775 - DNA, 603 bp, Zea mays
  misc_feature: Ceres CLONE 1381166-F
  misc_feature: Encodes the peptide sequence at SEQ ID NO. 16776
  misc_feature (77)..(77): n is a, c, t, g, unknown, or other
  misc_feature (78)..(78): n is a, c, t, g, unknown, or other
  misc_feature (110)..(110): n is a, c, t, g, unknown, or other
  misc_feature (509)..(509): n is a, c, t, g, unknown, or other
ggagtccccgcggtggcggccgctctagaactagtggatcccccgggctgcaggaattcgcacgagaccattacctnnagaacatcctaatcgaaaacatccgctccccngccttccgcttccctaccccccgcatcacctaccaacgccgacaccatgggggccttcgcgaaggaggagcaccagttcctagccgagctcggcctcgcgcagcgcaacccaggcgcgttcgcatgcggtgcgtggggcggctcaggtcccaccgtcacctccacgagcccgaccaacaatcaggtcatcgcagaggtcgtggaggcgtccgtgcacgactacgaggagggcatgcgcgcctgcttcgatgccgccaagacatggatggcgattcctgctccaaagcgaggagagatcgttaggcaaatcggtgatgcactgagagcaaagctccatcaccttggcaggcttgtgtcacttgagatggggaaaattcttcctgaagggatcggtgaggntcaggaaatcatcgacatgtgtgattatgctgggggggtaaatcgcaactaaatggatccttataccctctggacgaccaaacctatgatggtg

SEQ ID NO: 16776 - protein, 134 aa, Zea mays
  misc_feature: Ceres CLONE 1381166-F
  misc_feature: SWISSPROT Homolog: EC 1.2.1.3 Aldehyde dehydrogenase (NAD(+))
  misc_feature (118)..(118): Xaa is any aa, unknown, or other
MGAFAKEEHQFLAELGLAQRNPGAFACGAWGGSGPTVTSTSPTNNQVIAEVVEASVHDYEEGMRACFDAAKTWMAIPAPKRGEIVRQIGDALRAKLHHLGRLVSLEMGKILPEGIGEXQEIIDMCDYAGGVNRN

SEQ ID NO: 16777 - DNA, 753 bp, Zea mays
  misc_feature: Ceres CLONE 1381167-F
  misc_feature: Encodes the peptide sequence at SEQ ID NO. 16778
  misc_feature (497)..(497): n is a, c, t, g, unknown, or other
  misc_feature (502)..(502): n is a, c, t, g, unknown, or other
  misc_feature (515)..(515): n is a, c, t, g, unknown, or other
  misc_feature (602)..(602): n is a, c, t, g, unknown, or other
tcaccgcggtggcggccgctctagaactagtggatcccccgggctgcaggaattcgcacgagaccattacctagaacatcctaatcgaaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgttggtcggggcttggcgctgacggcctccgtggggtgggggctggccgtggccccacgcccggtggttcctggatcttcagccccccgtggctggtcccccgccgcgctgctncatcngggacggcccggntcatggggttcccctcacgtcgggcgcgctgggggggtctccggggggcctgtcctctcgctcacgtggcctcgccaacacgggcgncgggcaggcgtttccagcgcaccccgggacttaacgtgggaggaggcgcaccgcaggaattggcggaaggccgcgggcgcacgcgggccacaaagaccgcgcaggcaggccaggccatccagggcaagggcgcaggagggccggcgcccgg

SEQ ID NO: 16778 - protein, 69 aa, Zea mays
  misc_feature: Ceres CLONE 1381167-F
MADRDRSGIYGGAHATYGQQQQQGGGGRPMGEQVKGMLHDKGPTASQALTVATLFPLGGLLLVLVGAWR

SEQ ID NO: 16779 - DNA, 677 bp, Zea mays
  misc_feature: Ceres CLONE 1381169-F
  misc_feature: Encodes the peptide sequence at SEQ ID NO. 16780
  misc_feature (405)..(405): n is a, c, t, g, unknown, or other
tccccgcggtggcggccgctctagaactagtggatcccccgggctgcaggaattcgcacgagaccattacctagaacatcctaatcgaaaaccaccacctcggctcctcccccgcggccatggccaccaccactctggggcaaggcgacgacggctgcaaaggccgcagcgccaacgggaatgacaatgccgtcgccttccatttggaggatgccaacatccaagatactcctaccaagatgaacagtaacagccttgcaatgagtggtgggcctgcagccggtgcaggaggcgagcacgaggagcagcagcaggatggggacggggatggcagtcccaagcaggcagtcaaccctgggaaagaggagaagacggggatctgtcctgtcacagccacgcccattngtgcctgtggattccaagaaagtggcgtggtgggagcacatcttgcctgacagcccctttgcgtcccccagcaggcctccactcaaaatgggagcatcatcaggaatgggggttcatccttcttccccccggctggatccaccatggaggtggccccggaacggttctgggttctttcagggggccaaggttttcccctgggaatgaagccatggggtggaaaaaacgaaggaggggggggggaggggggcttcctttcctctaaacggggg

SEQ ID NO: 16780 - protein, 111 aa, Zea mays
  misc_feature: Ceres CLONE 1381169-F
  misc_feature (96)..(96): Xaa is any aa, unknown, or other
MATTTLGQGDDGCKGRSANGNDNAVAFHLEDANIQDTPTKMNSNSLAMSGGPAAGAGGEHEEQQQDGDGDGSPKQAVNPGKEEKTGICPVTATPIXACGFQESGVVGAHLA

SEQ ID NO: 16781 - DNA, 668 bp, Zea mays
  misc_feature: Ceres CLONE 1381171-F
  misc_feature: Encodes the peptide sequence at SEQ ID NO. 16782
  misc_feature (398)..(398): n is a, c, t, g, unknown, or other
  misc_feature (399)..(399): n is a, c, t, g, unknown, or other
  misc_feature (451)..(451): n is a, c, t, g, unknown, or other
  misc_feature (482)..(482): n is a, c, t, g, unknown, or other
  misc_feature (628)..(628): n is a, c, t, g, unknown, or other
  misc_feature (668)..(668): n is a, c, t, g, unknown, or other
aagctggagctccccgcggtggcggccgctctagaactagtggatcccccgggctgcaggaattcgcacgagaccattacctagaacatcctaatcgaaaactcgttgtcttggcggctgcggcggagcacggaggcgaaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgnncacgcatgtacttgttgatggcaaggtcaggactgacaagactaccctgctnggttcatggatgtcatttccatccctaagancatggagaactacaggctgctttatgacaccaaggccgcttccgtcttcaccaatcagggatgaggatgccaagttcaagctctgcaagggtgagtccgttcagtttggccagaagggcatcccctacctgaacacctacgacggncgtaacatccgctaccccgacccggtcatcaaggccacgn

SEQ ID NO: 16782 - protein, 156 aa, Zea mays
  misc_feature: Ceres CLONE 1381171-F
  misc_feature (3)..(40): Pfam Name: RS4NT Pfam Description: RS4NT (NUC023) domain
  misc_feature (98)..(156): Pfam Name: Ribosomal_S4e Pfam Description: Ribosomal family S4e
  misc_feature (67)..(67): Xaa is any aa, unknown, or other
  misc_feature (95)..(95): Xaa is any aa, unknown, or other
MARGLKKHLKRLNAPKHWMLDKLGGAFAPKPSSGPHKSRECLPLILIIRNRLKYALNYREVISILMXTHVLVDGKVRTDKTTLLGSWMSFPSLRXWRTTGCFMTPRPLPSSPIRDEDAKFKLCKGESVQFGQKGIPYLNTYDGRNIRYPDPVIKAT

SEQ ID NO: 16783 - DNA, 716 bp, Zea mays
  misc_feature: Ceres CLONE 1381174-F
  misc_feature: Translation starting site: 349
  misc_feature (470)..(470): n is a, c, t, g, unknown, or other
ccggatgacggccgctccaaaactaatggattccccgggctgcaggaatttccaacaaaccctttacctaaacattcctattcaaaaaaagtaccaccgaccacgcacgcgtagatccggcgtactgcaaattttgaaaactgcactgcaagatggcatcaccatagctttcccgcgaagaaaatgtgtacatgtcgaagttcactgtatcatctgctcagctaccatgatatgtctgagctcatgtagaagacatccaagactgatgactcgaagcagctcactgtgccaggagctaaacctcttgcctgttgtatacaacaacctcattgaagcccgccgcgcctcatgaagaatacatctcctccatcgagcagaaaagaggagctcccaggcaatgagaaccgagtaacactcatcaccgattatcgtgcctagattgagactgagctgaccacgatctgagatgncatcctcaagctgcttgaaacccatcttgtgccgccttccactgcccccgagatcctaggtcttctatctcaaaatgcactccgattactacagatacccttgctgatgaccacgactgcacttgctagtaaggacgacgctgaccaccttatgaggtcctacaaagctgaccaggacattgcatctgactgaacttgactcaactcactctattaccgcttgcactgtcaataaaacgtctcagg

SEQ ID NO: 16784 - DNA, 746 bp, Zea mays
  misc_feature: Ceres CLONE 1381178-F
  misc_feature: Encodes the peptide sequence at SEQ ID NO. 16785
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
tttnnnnnnnnnnttttttttttnnnnntttttgcccgtcgggtagagaaattttcaaagctggagctccccgcggtggcggccgctctagaactagtggatcccccgggctgcaggaattcgcacgagaccattacctagaacatcctaatcgaaaaaaccatcttctcccccagctccccagcaccagtccccaattatttggcctccgtcagagaggggagaaagacccgttcgaggcggcggcgatgtcggggcgcggcaagggcggcaagggtctgggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatccgcgacgccgtcacctacaccgagcacgcgcgccgcaagaccgtcaccgccatggatgtcgtctacgcgctcaagcgccagggccgcaccctctacggcttcgggaggctaggcgcctcttcgtagctggggaatgcttagggtgatacgtctctgtccctgggggtcgaagtgttgctgcgttcctggatggaatccatttttttttttctgcaatgaaaagatgctggcaagcaatacctaccctgcataatgttggcgcccgggggggatttggtccccccttaaaaaaacggc

SEQ ID NO: 16785 - protein, 108 aa, Zea mays
  misc_feature: Ceres CLONE 1381178-F
  misc_feature (25)..(94): Pfam Name: Histone Pfam Description: Core histone H2A/H2B/H3/H4
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGRLGASS

SEQ ID NO: 16786 - DNA, 690 bp, Zea mays
  misc_feature: Ceres CLONE 1381183-F
  misc_feature: Translation starting site: 140
  misc_feature (360)..(360): n is a, c, t, g, unknown, or other
  misc_feature (560)..(560): n is a, c, t, g, unknown, or other
  misc_feature (561)..(561): n is a, c, t, g, unknown, or other
  misc_feature (665)..(665): n is a, c, t, g, unknown, or other
cgctctagaactagtggatcccccgggctgcaggaattcgcacgagaccattacctagaacatcctaatcgaaaaaaggacgaccgacgacgcacgcggagatccggcgtactgcaaattttgaaaactgaactgtaagatggcatcagcagagctttcccgtgaggaaaatgtgtacatggcgaagctcgctgagcaggcggagaggtacgaggagatggttgagttcatggagaaggtagccaagactgttgactcggaggagctcactgtggaggagcgaaacctcttgtctgttgcatacaagaacgtcattggagcccgccgcgcctcatggcgcatcatctcctccatcgagcnagaaggaggagggccgaggcaatgaggaccgagtaacactcatcaaggattatcgtggcaagattgagactgagctgaccaagatctgtgatggcatcctcaagctgcttgagacccatcttgtgccgtcttccactgcccccgagtccaaggtcttctatctcaagatgaagggtgattactacagataccttgctganngtcagactggagctgagagaaagacgccgctgagaacacgatggtggcatacaaggctgccccagacattgctctggctgagcttgctccactcaccctattangcttgactgcactaaacctctcagg

SEQ ID NO: 16787 - DNA, 719 bp, Zea mays
  misc_feature: Ceres CLONE 1381186-F
  misc_feature: Encodes the peptide sequence at SEQ ID NO. 16788
  misc_feature (471)..(471): n is a, c, t, g, unknown, or other
  misc_feature (474)..(474): n is a, c, t, g, unknown, or other
  misc_feature (477)..(477): n is a, c, t, g, unknown, or other
  misc_feature (480)..(480): n is a, c, t, g, unknown, or other
  misc_feature (481)..(481): n is a, c, t, g, unknown, or other
  misc_feature (516)..(516): n is a, c, t, g, unknown, or other
tacccgcggtggcggccgctctagaactagtggatcccccgggctgcaggaattcgcacgagaccattacctagaacatcctaatcgaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcgncgncgncgnntacggtggtggccgtggaggcggcggctacggcgntggcgggcgccgtgatggcggcggcgcctacggcggtgccgccggctacggtggtggtgccgccgtctaccggggtggtgcctgcggttaccggggggggcaaccgggggggcggttacgggacttccgacgggaactggagaaattgaccggggggggcccccccgctcaattaatcctgttgcgccacccggtgggtaacc

SEQ ID NO: 16788 - protein, 176 aa, Zea mays
  misc_feature: Ceres CLONE 1381186-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (94)..(94): Xaa is any aa, unknown, or other
  misc_feature (95)..(95): Xaa is any aa, unknown, or other
  misc_feature (96)..(96): Xaa is any aa, unknown, or other
  misc_feature (97)..(97): Xaa is any aa, unknown, or other
  misc_feature (109)..(109): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGXXXXYGGGRGGGGYGXGGRRDGGGAYGGAAGYGGGAAVYRGGACGYRGGQPGGRLRDFRRELEKLTGGGPPAQLILLRHPVGN

SEQ ID NO: 16789 - DNA, 716 bp, Zea mays
  misc_feature: Ceres CLONE 1381189-F
  misc_feature: Encodes the peptide sequence at SEQ ID NO. 16790
  misc_feature (627)..(627): n is a, c, t, g, unknown, or other
  misc_feature (651)..(651): n is a, c, t, g, unknown, or other
tggcggccgctctagaactagtggatcccccgggctgcaggaattcgcacgagaccattacctagaacatcctaatcgaaaaaaccatattattgagaccaacaagcaacatagaaagtggaatccagtatcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaaccatcagggcacaacagctgcagcaactcgtgctacctctgatcaaccaagtagctctggaaaacctttctccctactctcagcaacaacaatttcttccattcaaccaactgtctacactgaaccctgctgcttatttgcagcaacaactattaccatttagccagctagctactgcctactctcagcaacgacaacttcttccattttaaccnattggccgcactggaccccgctgnctatttgcagcagcaaatactactaccatttagccagctagctgcagcaaccgggggcttccttt

SEQ ID NO: 16790 - protein, 158 aa, Zea mays
  misc_feature: Ceres CLONE 1381189-F
MATKIFSLLMLLALSTCVANATIFPQCSQAPIASLLPPYLPSIIASICENPALQPYRLQQAIAASNIPLSPLLFQQSPALSLVQSLVQTIRAQQLQQLVLPLINQVALENLSPYSQQQQFLPFNQLSTLNPAAYLQQQLLPFSQLATAYSQQRQLLPF

SEQ ID NO: 16791 - DNA, 706 bp, Zea mays
  misc_feature: Ceres CLONE 1381190-F
  misc_feature: Translation starting site: 237
  misc_feature: SWISSPROT Homolog: EC 1.1.1.22 UDP-glucose 6-dehydrogenase
gctctagaactagtggatcccccgggctgcaggaattcgcacgagaccattacctagaacatcctaatcgaaaaagacacacaaacacaagtcgtcgtaggcagcgagcgtctctcctctcccacgcatcgcgccaaggaagagagagagatcgccgctccccttctcggcgtcggtggtgcgggtgccctccctcctcgagcgagatctgtctggtcacagatctatctgacaaaatggtgaagatctgctgcatcggtgctggctatgtcggtggcccaaccatggccgtcattgccctcaagtgcccagacattgaggtcgtcgtcgttgacatctccaagccccgcattgaggcctggaacagtgacaccctggcaatctacgagcctggtctcgatgatggtgtgaagcagtgcaggggcaggaacctctttctcagcactgatggtgagaagcacgtcgctgaggctgacattatcttttgtctcggtgaacacccccaccaagacccgtgggcttggagctggcagggctgccgacctcacctactgggagagcgctgcccgcatgattgcggatgtctcaagtctgacaagatggttgtgaaaagcccctgtccctgtcaagacggtgagctatggaaagaacttgaccccaaagcagggctcaattaccgatctttccacccaaagtcctggggggg

SEQ ID NO: 16792 - DNA, 716 bp, Zea mays
  misc_feature: Ceres CLONE 1381193-F
  misc_feature: Encodes the peptide sequence at SEQ ID NO. 16793
  misc_feature (668)..(668): n is a, c, t, g, unknown, or other
  misc_feature (712)..(712): n is a, c, t, g, unknown, or other
gctctagaactagtggatcccccgggctgcaggaattcgcacgagaccattacctagaacatcctaatcgaaaaatcatccacaatgggtcgtgtcatcagagctcaacgtaagggagcaggttccgtcttcaaatcccacactcaccaccgtaaaggccccgccaagttccgcagcctcgactacggcgagagaaatggatacctcaggggcgtcgtgacggagatcatccacgatcccggccgtggtgcgccgctcgctcgcgtcgccttccgtcatcctttccgttacaagaagcagaaggagctcttcgtcgccgccgaaggcatgtacaccggacagttcttgtactgcggtaagaaagcgacgctcgttgtcggaaatgttctcccgcttagagctatccctgaaggagctgttgtctgtaacgtcgagcatcatgtcggtgaccgtggtgtgctcgctagagcttctggcgattacgccatcgtgatttcgcacaaccctgacaacgacactactaggatcaagttgccatctggatcgaagaagattgttccgagtggatgcaggtccatggattggtcatgtcgctgggtgctggaagaacggagaagccgatgctcaagtggttaacgcgtacaccagtaacgtgtgaagagaacggntggctaaagggttacgtgatgtgctatgaaatcagtgcagctcntcca

SEQ ID NO: 16793 - protein, 183 aa, Zea mays
  misc_feature: Ceres CLONE 1381193-F
  misc_feature (11)..(90): Pfam Name: Ribosomal_L2 Pfam Description: Ribosomal Proteins L2, RNA binding domain
  misc_feature (96)..(184): Pfam Name: Ribosomal_L2_C Pfam Description: Ribosomal Proteins L2, C-terminal domain
MGRVIRAQRKGAGSVFKSHTHHRKGPAKFRSLDYGERNGYLRGVVTEIIHDPGRGAPLARVAFRHPFRYKKQKELFVAAEGMYTGQFLYCGKKATLVVGNVLPLRAIPEGAVVCNVEHHVGDRGVLARASGDYAIVISHNPDNDTTRIKLPSGSKKIVPSGCRSMDWSCRWVLEERRSRCSSG

SEQ ID NO: 16794 - DNA, 709 bp, Zea mays
  misc_feature: Ceres CLONE 1381196-F
  misc_feature: Encodes the peptide sequence at SEQ ID NO. 16795
  misc_feature (486)..(486): n is a, c, t, g, unknown, or other
  misc_feature (517)..(517): n is a, c, t, g, unknown, or other
  misc_feature (518)..(518): n is a, c, t, g, unknown, or other
  misc_feature (568)..(568): n is a, c, t, g, unknown, or other
gctctagaactagtggatcccccgggctgcaggaattcgcacgagaccattacctagaacatcctaatcgaaaagacggaggcactactagtgtcgtaacgacgccacgacggtgtgtctgactctgatctcgcatcgcgccgaggccctccggaatcccaatcctctcctctcccgcaagcaccccgggtctgctgcagcgcctcgtctccgtggtctggcatcagagtccccgggagaatggttgctctgtcggcaggagcgctggctccgctcgcaggtctgtctccgctgccgtcgtgcagcgcggctccgttgtactgccgcaggagtccgccacttctcaatgtcgccatcgccaagacgcggccagctgttcaccaatctgctcctgcaagcttccgaaaatgtgcagctatgtcagaacatggacgtcaggaactccggaccaatgagtaccagctggatgatgatgatgagccgttntggctggcagtggtcagagaccttgctgtgnngtttcaagggattggtagctttcttagctgagcagccgaggcactgaggncacttggaagtggccgggctttctacacccggctgagacggcacactaactctttgattgggggaagtataggtttaatggttgcattatcaactatggatgctgccctctgctacatgctggcctggctacttcgaaatt

SEQ ID NO: 16795 - protein, 102 aa, Zea mays
  misc_feature: Ceres CLONE 1381196-F
  misc_feature (82)..(82): Xaa is any aa, unknown, or other
  misc_feature (93)..(93): Xaa is any aa, unknown, or other
MVALSAGALAPLAGLSPLPSCSAAPLYCRRSPPLLNVAIAKTRPAVHQSAPASFRKCAAMSEHGRQELRTNEYQLDDDDEPXWLAVVRDLAVXFQGIGSFLS

SEQ ID NO: 16796 - DNA, 672 bp, Zea mays
  misc_feature: Ceres CLONE 1381198-F
  misc_feature: Encodes the peptide sequence at SEQ ID NO. 16797
  misc_feature (472)..(472): n is a, c, t, g, unknown, or other
  misc_feature (500)..(500): n is a, c, t, g, unknown, or other
  misc_feature (550)..(550): n is a, c, t, g, unknown, or other
  misc_feature (611)..(611): n is a, c, t, g, unknown, or other
ggcggccgctctagaactagtggatcccccgggctgcaggaattcgcacgagaccattacctagaacatcctaatcgaaaaatcacctataatattttgagcattcagaaacacacctagggaagcgcactagcaacgacctaacaacaatggctaccaagatattatccctccttgcgcttcttgccctttttgtgagcgcaacaaatgtgttcattattccacaatgctcacttgctcctagtgccattattccaaagttcctcccaccagttacttcaatgggcttcgaacacccagctgtgcaagcctacaggctacaacaagcgcttgcggcgagcgtcttacaacaaccaattgcccaattacaacaacaatccttggcacatctaacaatacaaaccatcgcaacgcaacagcaacaacagttcctaccagcactgagccacctaggcatggtgaaccctgccgnctacttgcaacaacactgcttgcatccnacgcactttgctctggcaacgtagttgcaaccagctaacacatagctgcnacagtttctgccagcgctcagtcactagccatggtgaaacctgcccgctaccctacaaagnaaaactggtttcttcaacccgttggtgggggccatggccctacttccttacaaaaagaatg

SEQ ID NO: 16797 - protein, 124 aa, Zea mays
  misc_feature: Ceres CLONE 1381198-F
  misc_feature (1)..(125): Pfam Name: Zein Pfam Description: Zein seed storage protein
  misc_feature (108)..(108): Xaa is any aa, unknown, or other
MATKILSLLALLALFVSATNVFIIPQCSLAPSAIIPKFLPPVTSMGFEHPAVQAYRLQQALAASVLQQPIAQLQQQSLAHLTIQTIATQQQQQFLPALSHLGMVNPAXYLQQHCLHPTHFALAT

SEQ ID NO: 16798 - DNA, 715 bp, Zea mays
  misc_feature: Ceres CLONE 1381199-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (157)..(157): n is a, c, t, g, unknown, or other
  misc_feature (158)..(158): n is a, c, t, g, unknown, or other
  misc_feature (160)..(160): n is a, c, t, g, unknown, or other
  misc_feature (161)..(161): n is a, c, t, g, unknown, or other
  misc_feature (163)..(163): n is a, c, t, g, unknown, or other
  misc_feature (164)..(164): n is a, c, t, g, unknown, or other
  misc_feature (166)..(166): n is a, c, t, g, unknown, or other
  misc_feature (179)..(179): n is a, c, t, g, unknown, or other
  misc_feature (185)..(185): n is a, c, t, g, unknown, or other
  misc_feature (189)..(189): n is a, c, t, g, unknown, or other
  misc_feature (191)..(191): n is a, c, t, g, unknown, or other
  misc_feature (193)..(193): n is a, c, t, g, unknown, or other
  misc_feature (197)..(197): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (236)..(236): n is a, c, t, g, unknown, or other
  misc_feature (258)..(258): n is a, c, t, g, unknown, or other
  misc_feature (263)..(263): n is a, c, t, g, unknown, or other
  misc_feature (278)..(278): n is a, c, t, g, unknown, or other
  misc_feature (287)..(287): n is a, c, t, g, unknown, or other
  misc_feature (292)..(292): n is a, c, t, g, unknown, or other
  misc_feature (305)..(305): n is a, c, t, g, unknown, or other
  misc_feature (306)..(306): n is a, c, t, g, unknown, or other
  misc_feature (314)..(314): n is a, c, t, g, unknown, or other
  misc_feature (315)..(315): n is a, c, t, g, unknown, or other
  misc_feature (319)..(319): n is a, c, t, g, unknown, or other
  misc_feature (330)..(330): n is a, c, t, g, unknown, or other
  misc_feature (452)..(452): n is a, c, t, g, unknown, or other
  misc_feature (453)..(453): n is a, c, t, g, unknown, or other
  misc_feature (466)..(466): n is a, c, t, g, unknown, or other
  misc_feature (468)..(468): n is a, c, t, g, unknown, or other
  misc_feature (570)..(570): n is a, c, t, g, unknown, or other
nnnnnnnnnnnnnnnnnnnnnnnnnnnnnnnnnnnnnnnnnnnnnnnnnnnnnnnnnnnnnnnngggggggggccgctcccgaacaggggggcccccccgggcggcgggagatcccaggagagcattacccagaacgccccaagccggaaaaaagtnnanngnncntccggaccgccancccttnggtncncncccntccnnnnnnnnccccccaatnnnnnnncaaaaactgggnggacctccaccggccggggggncgggncccggccttcctagnaaaactagntgggnatcccccccgggnnctgcaggnnaatntccgcacgagnaccattacctagaacatcctaatcgaaaaatctcccataatattttcagcattcaaaaacacaccaagcgaagcgcactagcaacgacctaacaccaatgctaccagatatagccctccgtnngcgctctgccccntnagtgagcgcaacagatgcgttccatatcccacagtgctcacctggctccctagtgcccgggaattcccccaggtcccccccacccccagttaaccttccaantggcgctttccaaaaatcccgcccccggggaaagcctaaccggggtacccaacaaaacccctttggggggaaaagcccccttaaaaaaaaaccccattgggccccccattgggaaaaaaaaaaaacccccgtggggcccaccccc

SEQ ID NO: 16799 - DNA, 702 bp, Zea mays
  misc_feature: Ceres CLONE 1381200-F
  misc_feature: Encodes the peptide sequence at SEQ ID NO. 16800
  misc_feature (533)..(533): n is a, c, t, g, unknown, or other
tccccgcggtggcggccgctctagaactagtggatcccccgggctgcaggaattcgcacgagaccattacctagaacatcataatcgaaaactgcgctccgaataccccagacccccgatcctcccaatggccaccgcattttcgctgcgcgctgcggccccggccaccgctccccgcgccgtctcccgatccacctccgcggcgagggtcgtgcccgtggcctcggcactggcgggacgcggaaggctggtggcgcgtgcagcagttacagcaaaggcggatgtaccatcgagcacgtccgacggccatgaggtcttgctgtttgaagctcttcgtgaggccttgatggaagagatggaattagatccaacagtgtgtgtatttggtgaagatgttggccattacggtggttcttacaaggtgacaaaaggtttggctgatacgtttggagaccttcgagttctggacacccctattgcggagaactcgtttactggcatgggagttggagggggatgaaaagggctgaggncccgtcgttgaaggatgaacatgggattcctgctcccttgctacaccagatctcaataaactgtggcatgcttcattacacttcccggcgccagtcaaatcccaccttgtgacgtggccccccccgcgggggggggggccccgcagcctgggacagagcactcgagcgc

SEQ ID NO: 16800 - protein, 130 aa, Zea mays
  misc_feature: Ceres CLONE 1381200-F
  misc_feature: SWISSPROT Homolog: EC 1.2.4.1 Pyruvate dehydrogenase (acetyl-transferring)
MATAFSLRAAAPATAPRAVSRSTSAARVVPVASALAGRGRLVARAAVTAKADVPSSTSDGHEVLLFEALREALMEEMELDPTVCVFGEDVGHYGGSYKVTKGLADTFGDLRVLDTPIAENSFTGMGVGGG

SEQ ID NO: 16801 - DNA, 681 bp, Zea mays
  misc_feature: Ceres CLONE 1381206-F
  misc_feature: Encodes the peptide sequence at SEQ ID NO. 16802
tccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccatggatgatgccgagcatgatgtcaccaatggtcttgccgagcatgatgtcgcaaatgatgatgccacaatgtcactgcgacgccgtctcgcaaaattatgctggaacaacaattacccatccaggttccaccccaatgggcatgaccaattccacccttggtcctaacagcaaccctttgggttggggctgcaatccaaaaaaaaaaaattttggggttgaccccgaaaaaaggagttggcactggcccacccggggggacctcattaa

SEQ ID NO: 16802 - protein, 176 aa, Zea mays
  misc_feature: Ceres CLONE 1381206-F
MAAKMLALFALLALCASATSATHIPGHLPPVMPLGTMNPCMQYCMMQQGLASLMACPSLMLQQLLALPLQTMPVMMPQMMTPNMMSPWMMPSMMSPMVLPSMMSQMMMPQCHCDAVSQNYAGTTITHPGSTPMGMTNSTLGPNSNPLGWGCNPKKKNFGVDPEKRSWHWPTRGDLI

SEQ ID NO: 16803 - DNA, 733 bp, Zea mays
  misc_feature: Ceres CLONE 1381208-F
  misc_feature: Encodes the peptide sequence at SEQ ID NO. 16804
  misc_feature (438)..(438): n is a, c, t, g, unknown, or other
  misc_feature (439)..(439): n is a, c, t, g, unknown, or other
  misc_feature (574)..(574): n is a, c, t, g, unknown, or other
  misc_feature (581)..(581): n is a, c, t, g, unknown, or other
  misc_feature (693)..(693): n is a, c, t, g, unknown, or other
  misc_feature (720)..(720): n is a, c, t, g, unknown, or other
aagctggagctccccgcggtggcggccgctctagaactagtggatcccccgggctgcaggaattcgcacgagaccattacctagaacatcctaatcgaaaagtgttttcgcttccccttccccatcccctctcctcccctcgccggcttgtcggtctcgccgcgccactggccatacatccaagacgctaatccgtgtgggggaaaagcccccctctctctgaaactattcaaatggcgtggggcgtatccccgcggcggcagccgtcgttcccggtgcaggccctctacgagctctgcaagcgctccttcccctccccttccgccgcctcatcgtctcccccgcccgctgatgtcgtccgcagcatctcctcgctcatggatacaatcactcctgcggatgttgggctcagagattataatcttgaggacgacaggnngcatggattttttgactccaacctcctcaaggggtcaggaaggcttcctcggtgggcgcgggccatcaagtaccttcatatctacagctgtgatgcattctctattggaatattctgcttgccaacttcatcagncattccntctcatgatcatccaggaatgactgtactgagcaaatcctttatgggtccatgcatgtgaaatcatatgatgggatagagctactgtccctagcagtagcagccagcagggntggcaaatacatacagatgatggtcgnactgctcatgtcc

SEQ ID NO: 16804 - protein, 135 aa, Zea mays
  misc_feature: Ceres CLONE 1381208-F
  misc_feature (14)..(135): Pfam Name: DUF1637 Pfam Description: Protein of unknown function (DUF1637)
  misc_feature: SWISSPROT Homolog: EC 1.13.11.19 Cysteamine dioxygenase
  misc_feature (69)..(69): Xaa is any aa, unknown, or other
  misc_feature (114)..(114): Xaa is any aa, unknown, or other
MAWGVSPRRQPSFPVQALYELCKRSFPSPSAASSSPPPADVVRSISSLMDTITPADVGLRDYNLEDDRXHGFFDSNLLKGSGRLPRWARAIKYLHIYSCDAFSIGIFCLPTSSXIPSHDHPGMTVLSKSFMGPCM

SEQ ID NO: 16805 - DNA, 719 bp, Zea mays
  misc_feature: Ceres CLONE 1381211-F
  misc_feature: Encodes the peptide sequence at SEQ ID NO. 16806
  misc_feature (522)..(522): n is a, c, t, g, unknown, or other
  misc_feature (623)..(623): n is a, c, t, g, unknown, or other
  misc_feature (633)..(633): n is a, c, t, g, unknown, or other
  misc_feature (673)..(673): n is a, c, t, g, unknown, or other
  misc_feature (674)..(674): n is a, c, t, g, unknown, or other
cgcggtggcggccgctctagaactagtggatcccccgggctgcaggaattcgcacgagaccattacctagaacatcctaatcgaaaactagcgccgcaccctcccgcccaccgccgtcgccgcccaaccgcagtaaggaggaaggagcaggaagatgccggcggggcacgggctgcggtcgcggacccgcgacctgttcgcgcggcccttccgcaagaaggggtacatcccactcaccacgtacctgcgcacctacaagatcggcgactacgtcgacgtcaaggttaacggcgccgtgcacaagggcatgccgcacaagttctaccacggccgcaccgggagcgtctggaacgtcaccaagcgcgccatcggcgtcgagatcaacaagcaggttaatggccgcatcatcaggaagcggatccatgtccgcgtggagcatgtgcagccctcccgttgcacggaggagttccgcttgaggaaagccaagaatgaccagctcaaggcggatgccaaggcccgcgntgaggtgatcagcaccaagaggcagcctgtgggacccaacctggcttcatggttgagggtgctacactcgagacagtcactcctattccttatgatgtggntcacgatctncaggggcggtactagagagattttttgtaccttcagcagnntcaacgagctggcaacttatctgaatctttttgatattgcctagt

SEQ ID NO: 16806 - protein, 187 aa, Zea mays
  misc_feature: Ceres CLONE 1381211-F
  misc_feature (2)..(100): Pfam Name: Ribosomal_L21e Pfam Description: Ribosomal protein L21e
  misc_feature (123)..(123): Xaa is any aa, unknown, or other
  misc_feature (157)..(157): Xaa is any aa, unknown, or other
  misc_feature (160)..(160): Xaa is any aa, unknown, or other
  misc_feature (173)..(173): Xaa is any aa, unknown, or other
  misc_feature (174)..(174): Xaa is any aa, unknown, or other
MPAGHGLRSRTRDLFARPFRKKGYIPLTTYLRTYKIGDYVDVKVNGAVHKGMPHKFYHGRTGSVWNVTKRAIGVEINKQVNGRIIRKRIHVRVEHVQPSRCTEEFRLRKAKNDQLKADAKARXEVISTKRQPVGPNLASWLRVLHSRQSLLFLMMWXTIXRGGTREIFCTFSXXNELATYLNLFDIA

SEQ ID NO: 16807 - DNA, 675 bp, Zea mays
  misc_feature: Ceres CLONE 1381212-F
  misc_feature: Encodes the peptide sequence at SEQ ID NO. 16808
  misc_feature (453)..(453): n is a, c, t, g, unknown, or other
  misc_feature (455)..(455): n is a, c, t, g, unknown, or other
  misc_feature (514)..(514): n is a, c, t, g, unknown, or other
  misc_feature (565)..(565): n is a, c, t, g, unknown, or other
  misc_feature (566)..(566): n is a, c, t, g, unknown, or other
  misc_feature (582)..(582): n is a, c, t, g, unknown, or other
  misc_feature (584)..(584): n is a, c, t, g, unknown, or other
tggagctccccgcggtggcggccgctctagaactagtggatcccccgggctgcaggaattcgcacgagaccattacctagaacatcctaatcgaaaacgaacacaccagaccagctcatcatcacattcgcatacatctcttctagcacgcaaagatcgagctatagctagctctgcaaccagagacaaggaggactacccttcgccggccggcctaaggaggagtacgtacagaacttgggacatggaaaccgtcgtgggcgacctcatggcgaccgagctgaggcttggcctgccgggcaccgtcgacgactgcagccagccccaactggtgaaggccacgccgccgtcgacgccaaggggcaagaggcgcgccaccgcccgatgcgtggaggaagccgccggcgccgagaaggcaagcaagcgtgacgccgagacggcgccccccgcagncnaggcgcccgtggtggggtggccgccggtgaagtcgtaccggaagagctgcttccagcangccagcagcaagcaggcggcggcggccaaacaggagggcgcggcggcggcnngcgcccccggtgcacngnatcgtcagcagccgccacaaacaccagcagctgcagcagcgcccgccgtgtcgtcggctccttcgtcaagtgagcatggccggcgccccga

SEQ ID NO: 16808 - protein, 143 aa, Zea mays
  misc_feature: Ceres CLONE 1381212-F
  misc_feature (70)..(70): Xaa is any aa, unknown, or other
  misc_feature (71)..(71): Xaa is any aa, unknown, or other
  misc_feature (90)..(90): Xaa is any aa, unknown, or other
  misc_feature (108)..(108): Xaa is any aa, unknown, or other
  misc_feature (113)..(113): Xaa is any aa, unknown, or other
  misc_feature (114)..(114): Xaa is any aa, unknown, or other
METVVGDLMATELRLGLPGTVDDCSQPQLVKATPPSTPRGKRRATARCVEEAAGAEKASKRDAETAPPAXXAPVVGWPPVKSYRKSCFQXASSKQAAAAKQEGAAAAXAPGAXXRQQPPQTPAAAAAPAVSSAPSSSEHGRRP

SEQ ID NO: 16809 - DNA, 695 bp, Zea mays
  misc_feature: Ceres CLONE 1381213-F
  misc_feature: Translation starting site: 176
  misc_feature: Pfam Name: Ribosomal_S7e Pfam Description: Ribosomal protein S7e
  misc_feature (286)..(286): n is a, c, t, g, unknown, or other
  misc_feature (384)..(384): n is a, c, t, g, unknown, or other
tccccgcggtggcggccgctctagaactagtggatcccccgggctgcaggaattcgcacgagaccattacctagaacatcctaatcgaaaactcgaaaccctagcgccggcgcctccacttcgttttcctcactctctcctccagctcagggtccggcggcgaagggaaggcaagatgtacaccgcgaggaagaagatccagaaggagaagggccttgagccctccgagttcgaggactccgttgcccaggctttctttgatctggagaacgggaaccaggagctncagagcgacctcaaggacctgtacatcaacaatgctatccagatggatgttaccgggagcaggaaggctgtgtcatccacgtcccatacccgctgcgncaggccttcaggaagatccatgtcagactcgtcagggagctggagaagaaatcagcgggcaggatgtggtaatttgtgctacaaggaggatggggagccacccaagagggttcagctggtctgcgccctcgaccagaatctgactgctggtccgatggcatctgggaggaggtggctacaactaaaatggggggaacgtgtccaaaaccgccggaaggtcccaaaaaacaaattttctggccccaagggaagggacacctgaaaaaaggtgggaacctggctgggtctaccccgggtggggggaaaaaggt

SEQ ID NO: 16810 - DNA, 708 bp, Zea mays
  misc_feature: Ceres CLONE 1381214-F
  misc_feature: Translation starting site: 218
  misc_feature (345)..(345): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (355)..(355): n is a, c, t, g, unknown, or other
  misc_feature (357)..(357): n is a, c, t, g, unknown, or other
  misc_feature (364)..(364): n is a, c, t, g, unknown, or other
  misc_feature (365)..(365): n is a, c, t, g, unknown, or other
  misc_feature (367)..(367): n is a, c, t, g, unknown, or other
  misc_feature (385)..(385): n is a, c, t, g, unknown, or other
  misc_feature (391)..(391): n is a, c, t, g, unknown, or other
  misc_feature (397)..(397): n is a, c, t, g, unknown, or other
  misc_feature (404)..(404): n is a, c, t, g, unknown, or other
tggagctccccgcggtggcggccgctctagaactagtggatcccccgggctgcaggaattcgcacgagaccattacctagaacatcctaatcgaaaactcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtccgcgtcccgcccgggggcggccggcngnnnnnnacnanctctccnngnaggagcgcaacctgctgnccgccncctacnagaacgncatcggcgcccgcagggcctcggggcggatcatctcctccatcgagcataaggaggaaggccgcgggaacgaggcgcacgccgtatccatccgcgcctaccgttccaagatcgatgccgagcttgcccccatttgagagggaatctatcgaggtcctcgattcccacttcggtccatcccgctggggctggccaaatcaaattcctcctacctctggatggaagggagctaccctcggattccttgttaagtctagggatgggaccctttttactgatcctgctccaatcctctggaatgcctt

SEQ ID NO: 16811 - DNA, 712 bp, Zea mays
  misc_feature: Ceres CLONE 1381217-F
  misc_feature: Encodes the peptide sequence at SEQ ID NO. 16812
  misc_feature (406)..(406): n is a, c, t, g, unknown, or other
  misc_feature (638)..(638): n is a, c, t, g, unknown, or other
  misc_feature (712)..(712): n is a, c, t, g, unknown, or other
ggagctccccgcggtggcggccgctctagaactagtggatcccccgggctgcaggaattcgcacgagaccattacctagaacatcctaatcgaaaaattcgcggtttgcctctctgcctgcctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaagacaccgactctgaggaggagctncaggaggccttccgcgtgttcgacaaggaccagaacggcttcatctctgctgctgagcttcgacatgtcatgaccaacctaggtgagaaactgacggacgaggaggtggatgagatgattcgtgaaagcgacgtgaacggtgatggccagatcaactacgaggagttcttgaaggtgatgatggccaagtgagatgatgggcctgttttaaactagttcctctcctgatggnagtaactagtctaggggtggagactgactgcattgggcccgcctggtcctcccggtggatccatggaattatcn

SEQ ID NO: 16812 - protein, 149 aa, Zea mays
  misc_feature: Ceres CLONE 1381217-F
  misc_feature (85)..(113): Pfam Name: efhand Pfam Description: EF hand
  misc_feature (12)..(40): Pfam Name: efhand Pfam Description: EF hand
  misc_feature (121)..(149): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELQEAFRVFDKDQNGFISAAELRHVMTNLGEKLTDEEVDEMIRESDVNGDGQINYEEFLKVMMAK

SEQ ID NO: 16813 - DNA, 690 bp, Zea mays
  misc_feature: Ceres CLONE 1381218-F
  misc_feature: Encodes the peptide sequence at SEQ ID NO. 16814
  misc_feature (215)..(215): n is a, c, t, g, unknown, or other
  misc_feature (216)..(216): n is a, c, t, g, unknown, or other
tggagctccccgcggtggcggccgctctagaactagtggatcccccgggctgcaggaattcgcacgagaccattacctagaacatcctaatcgaaaaaggcgagctggggaagacgcaaggtactgcggctgcgcgcgaggggtcgtcggacgaccgacgaggacgagcggcataggcgcgtgcatggcgctcacgaacttcatcctcacggtgnntggggttgggcgccggcgtaatgctcctgcggaaagacctcaagcagtcggccaccgtcttccggcgcaacgtgcgccacatccgcaactggctcgaggaggagtccgccgccgccgccaaatctactgaacagtcttcagggaagagttggagtccccaagctggcaagaaggaccctgtgcccaaggaccacaaacattagatgatcttacaccctgtttcttgtatgcggtggcagtttgaggcccagattttaattggtcctttaaaaaatgatggggtggaggacctttaagtctggttgaaattttaccggaaaaagggaaaacctctttaagttccaggttctcaaatggggatccttaattccccatggagaataagaaggggggggaaacctcgcccccccaaaaaaaaaaaaaaaaaaaaggtttatttcaaacacgcgccaaccctcgaggggggggcgcccc

SEQ ID NO: 16814 - protein, 60 aa, Zea mays
  misc_feature: Ceres CLONE 1381218-F
MLLRKDLKQSATVFRRNVRHIRNWLEEESAAAAKSTEQSSGKSWSPQAGKKDPVPKDHKH

SEQ ID NO: 16815 - DNA, 705 bp, Zea mays
  misc_feature: Ceres CLONE 1381223-F
  misc_feature: Encodes the peptide sequence at SEQ ID NO. 16816
  misc_feature (660)..(660): n is a, c, t, g, unknown, or other
tggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggcgccccgcggcgcccctgcggtgccaccagggcggcgacgccggcatggatctgctcgacctcctcctgtcaaagcacagtggtttagggtgatgaacagtgacacctgcccttatccttgtggggggaaaaaaaaaaaaagggccacccccccccgggggggggggcggttgaaaggggccaccgcctgccgcccaataaaaaactgtcctggcaggcgccgnaacttctaggcccctccctcctccccctaatttcctatttcagtt

SEQ ID NO: 16816 - protein, 63 aa, Zea mays
  misc_feature: Ceres CLONE 1381223-F
MSHFAAAAVKSPLAVAAPAAGDAKSPLFCPKPRRPAAPLRCHQGGDAGMDLLDLLLSKHSGLG

SEQ ID NO: 16817 - DNA, 696 bp, Zea mays
  misc_feature: Ceres CLONE 1381226-F
  misc_feature: Encodes the peptide sequence at SEQ ID NO. 16818
tccccgcggtggcggccgctctagaactagtggatcccccgggctgcaggaattcgcacgagaccattacatagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgctgtcggggctggcgctgacggcctccgtggtggggctggccgtggccacgcccggtgtcctgatcttcagccccgtgctggtccccgccgcgctgctcatcgggacggccgtcatgggggtcctcacgtcgggcgcgctggggctcggggggcctgtcctcgctcacgtgcctcgccacacgggggcggaaggcgttccagcgcaccccggactacggtggaggagcgcacgcaaggatggcggaggcccgggcccacccgggccacaagacccgcgaggaaggccaggccatccagggcaaggcgccagaa

SEQ ID NO: 16818 - protein, 167 aa, Zea mays
  misc_feature: Ceres CLONE 1381226-F
  misc_feature (44)..(148): Pfam Name: Oleosin Pfam Description: Oleosin
MADRDRSGIYGGAHATYGQQQQQGGGGRPMGEQVKGMLHDKGPTASQALTVATLFPLGGLLLVLSGLALTASVVGLAVATPGVLIFSPVLVPAALLIGTAVMGVLTSGALGLGGPVLAHVPRHTGAEGVPAHPGLRWRSARKDGGGPGPPGPQDPRGRPGHPGQGAR

SEQ ID NO: 16819 - DNA, 725 bp, Zea mays
  misc_feature: Ceres CLONE 1381228-F
  misc_feature: Translation starting site: 200
  misc_feature: Pfam Name: Ribosomal_S3_C Pfam Description: Ribosomal protein S3, C-terminal domain
  misc_feature (515)..(515): n is a, c, t, g, unknown, or other
  misc_feature (516)..(516): n is a, c, t, g, unknown, or other
  misc_feature (530)..(530): n is a, c, t, g, unknown, or other
  misc_feature (560)..(560): n is a, c, t, g, unknown, or other
ggagctccccgcggtggcggccgctctagaactagtggatcccccgggctgcaggaattcgcacgagaccattacctagaacatcctaatcgaaaagtcgcgccgccgctcccctcccaacccactagctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggacggctactctggcgtggaggtgcgcgtcacgccgatgcgcacggagatcatcatccgcgccacgcgcacgcagaacgtgctcggcgagaagggccgtaggatcagggagctcacctccgtcgtccagaagaggttcacttccctgagaatggcgttgagctttatgcccgagaggtcgtcaaccgtgggctctgtgccatcgcgcaggccgagtccctccnngtacagctcctcgntgcccttgccgtccgcagggcttgctacgntgttctttcgtatgttatggagagtggtgccaggggttgggaggtgatcgtgagtggaaggctcagggccaaagagcccagtcatgaagttcaaggatgctacatgatctcatctggtcagccagtgaacgagtacattgactcggctgtgagacacgtcttccc

SEQ ID NO: 16820 - DNA, 737 bp, Zea mays
  misc_feature: Ceres CLONE 1381230-F
  misc_feature: Encodes the peptide sequence at SEQ ID NO. 16821
tggagctccccgcggtggcggccgctctagaactagtggatcccccgggctgcaggaattcgcacgagaccattacctagaacatcctaatcgaaaacacaagcagcatccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctccatggccgcctcgaccaagaccgtcgccgtcctcctcgccgcggtgctcctcgcgctggtcgcgtccgcggcagccagaagggagctggaggagaacgcacttctgggaagcctgcccccagcccccgcgcccggccgttggcgttgccgcggggctgcctggcggcaagccggggggggtgggccgtccccgttctggtctctctcggccccctccctcggatctgaagggggggaatccgggttggcatccggggaaatggaggaagaaccctggatcttgatctccaaaaaaaagggaagggggaaatttaatgtccctccgggttggtcaagggggccccctcttttgcctggaaaaaaaagggacatgattttttttaaaaaaaaaaaaccggttatttgtccaaaaaaaaaaaaaaaaaaatgtttttgatacccgccgcgaccccagggggggggcccgctaaactcaattccctc

SEQ ID NO: 16821 - protein, 144 aa, Zea mays
  misc_feature: Ceres CLONE 1381230-F
MAASTKTVAVLLAAVLLALVASAAARRELEENALLGSLPPAPAPGRWRCRGAAWRQAGGGGPSPFWSLSAPSLGSEGGESGLASGEMEEEPWILISKKKGRGKFNVPPGWSRGPPLLPGKKRDMIFFKKKKPVICPKKKKKKCF

SEQ ID NO: 16822 - DNA, 734 bp, Zea mays
  misc_feature: Ceres CLONE 1381243-F
  misc_feature: Encodes the peptide sequence at SEQ ID NO. 16823
  misc_feature (538)..(538): n is a, c, t, g, unknown, or other
  misc_feature (539)..(539): n is a, c, t, g, unknown, or other
  misc_feature (579)..(579): n is a, c, t, g, unknown, or other
  misc_feature (626)..(626): n is a, c, t, g, unknown, or other
  misc_feature (627)..(627): n is a, c, t, g, unknown, or other
  misc_feature (630)..(630): n is a, c, t, g, unknown, or other
  misc_feature (631)..(631): n is a, c, t, g, unknown, or other
  misc_feature (643)..(643): n is a, c, t, g, unknown, or other
  misc_feature (657)..(657): n is a, c, t, g, unknown, or other
  misc_feature (710)..(710): n is a, c, t, g, unknown, or other
aagctggagctccccgcggtggcggccgctctagaactagtggatcccccgggctgcaggaattcgcacgagaccattacctagaacatcctaatcgaaaaatccgtcttgacagctccactcctaactccagcgaccaccgcgtccccaccatggccgctcgccggagcactagccccgcccggcacggcgtcctccccgccctccttctcatcctatgctcgtccctcccttccctcgccgccgcataccgcccaggcgacatcgtcccgatgctccgctcgggccagtaccacggctcgaggtcggtgtggttcgacgtggtggggcgccattgcccggccttcgcggtcaaccgggaggtgctgatgccgatcccaaagcctacggggttcactggtgctgatccgtacaagataacatttcaaattggacatgaaaagttccatgttccttggctttatgttataaatcgcaaaacctctgaagttccactgatcgatttccatttgaagtactctggaaatgatatacttgnngtgacagctaaagttgtggacatgcctcaccactacgtgnaaagtcatcctgacataaagaagaattttctggatccacagaattgnncannaatacgtcttgntagatatacatggnaggagcatcagagatagatggtactgggaggatttatgtggtattgggatccngggctttgtttgccctcattcttg

SEQ ID NO: 16823 - protein, 173 aa, Zea mays
  misc_feature: Ceres CLONE 1381243-F
  misc_feature (129)..(129): Xaa is any aa, unknown, or other
  misc_feature (143)..(143): Xaa is any aa, unknown, or other
  misc_feature (158)..(158): Xaa is any aa, unknown, or other
  misc_feature (159)..(159): Xaa is any aa, unknown, or other
  misc_feature (160)..(160): Xaa is any aa, unknown, or other
  misc_feature (164)..(164): Xaa is any aa, unknown, or other
  misc_feature (169)..(169): Xaa is any aa, unknown, or other
MAARRSTSPARHGVLPALLLILCSSLPSLAAAYRPGDIVPMLRSGQYHGSRSVWFDVVGRHCPAFAVNREVLMPIPKPTGFTGADPYKITFQIGHEKFHVPWLYVINRKTSEVPLIDFHLKYSGNDILXVTAKVVDMPHHYVXSHPDIKKNFLDPQNXXXIRLXRYTWXEHQR

SEQ ID NO: 16824 - DNA, 703 bp, Zea mays
  misc_feature: Ceres CLONE 1381244-F
  misc_feature: Encodes the peptide sequence at SEQ ID NO. 16825
  misc_feature (291)..(291): n is a, c, t, g, unknown, or other
  misc_feature (292)..(292): n is a, c, t, g, unknown, or other
  misc_feature (322)..(322): n is a, c, t, g, unknown, or other
  misc_feature (340)..(340): n is a, c, t, g, unknown, or other
  misc_feature (385)..(385): n is a, c, t, g, unknown, or other
  misc_feature (397)..(397): n is a, c, t, g, unknown, or other
  misc_feature (515)..(515): n is a, c, t, g, unknown, or other
  misc_feature (576)..(576): n is a, c, t, g, unknown, or other
  misc_feature (589)..(589): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccgnngcggaggacggagtggtcgaacgggaccgncaggagggacctgcgtgntgcaaagcagcgtgcgagtggcagtacgggaaggacaccccgcgnaagaggaatgcnagagcgagtgccgcgagcggcaccagcaagctgacgcgggcgaagacggcgacagcggcgtggacgcctacgtctcccgctccggaagggggcgagtggccggcgccagtgcctgcgnccgcacgaagggccagccgtgggagaaccaaggagggcatggagggggtgccgcccgcggnggactgggcctcnaacatggaacaaagaataccggtcccggaaaccaagagacccggggcagtggcccgggaagagggggggagaggccccaacccggggggtaattggggggggaaaagcaaccct

SEQ ID NO: 16825 - protein, 165 aa, Zea mays
  misc_feature: Ceres CLONE 1381244-F
  misc_feature (28)..(28): Xaa is any aa, unknown, or other
  misc_feature (44)..(44): Xaa is any aa, unknown, or other
  misc_feature (103)..(103): Xaa is any aa, unknown, or other
  misc_feature (123)..(123): Xaa is any aa, unknown, or other
MGKGSVGASWWAFLLLAGVLLVVAATAXAEDGVVERDRQEGPAXCKAACEWQYGKDTPRKRNARASAASGTSKLTRAKTATAAWTPTSPAPEGGEWPAPVPAXARRASRGRTKEGMEGVPPAXDWASNMEQRIPVPETKRPGAVAREEGGRGPNPGGNWGGKSNP

SEQ ID NO: 16826 - DNA, 718 bp, Zea mays
  misc_feature: Ceres CLONE 1381245-F
  misc_feature (428)..(428): n is a, c, t, g, unknown, or other
  misc_feature (529)..(529): n is a, c, t, g, unknown, or other
  misc_feature (618)..(618): n is a, c, t, g, unknown, or other
tccccgcggtggcggccgctctagaactagtggatcccccgggctgcaggaattcgcacgagaccattacctagaacatcctgatcggaaaactcttctcccctctctctcttccccgccccctctgtctcgacatcggtgccgtcatcttctcggcctctcgccggttggatccatcgggcgctggtcggatctgcctttcggtcgccgttgcccctccgccacgcctcgcgccagccggtcctgctgagcgccggcctgatccgcctccctctagtcggatctgcttggcgtcggcctctcgccgctactgctccgcatcctgggcttcctcaccgatgcacgatcctggcaccacgccacgccggtgtgctaccggctccttgcggcggagcggaccacatggtctgtgctcacgctgagcaggnacccacgatcgctcgcgttcctcatcattagggcgactttctacttctcgacgctggagcagcttgacctctcactgttgtcgtcgtcgcctctcgccggncggtcgcgtctcgcggtgccaggcgagcggccctggtgccattggctggtacccgtgacatggcgcccccgctggtcccatccgcgtgnttggacacgtgaccacaggggcgcccgggggtgttgctaagccctaaccgttgctgatgcggaagcctcggctcaatggatcggctcccttgggcctcgc

SEQ ID NO: 16827 - DNA, 738 bp, Zea mays
  misc_feature: Ceres CLONE 1381247-F
  misc_feature: Encodes the peptide sequence at SEQ ID NO. 16828
  misc_feature (616)..(616): n is a, c, t, g, unknown, or other
  misc_feature (625)..(625): n is a, c, t, g, unknown, or other
ggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatggtccagccgctcccggcacagtgctgccagcagcagatgaggatgatggacgtgcagtccgtcgcgcagcagctgcagatgatgatgcagcttgagcgtgccgctgcccgcagcagcagcctgtacgagccagctctgatgcagcagcagcagcagctgctggcagcccagggtctcaccccatggccatgatgatggcgcagaacatgccggccatggntggactctnacagtaccagctggccagctaccgcaccaacccctgttgggtctcccgctgcattccgcctactactgatccatgatatttggaaatctcctctatccatctctctctatcta

SEQ ID NO: 16828 - protein, 142 aa, Zea mays
  misc_feature: Ceres CLONE 1381247-F
MKMVIVLVVCLALSAASASAMQMPCPCAGLQGLYGAGAGLTTMMGAGGLYPYAEYLRQPQCSPLAAAPYYAGCGQPSAMVQPLPAQCCQQQMRMMDVQSVAQQLQMMMQLERAAARSSSLYEPALMQQQQQLLAAQGLTPWP

SEQ ID NO: 16829 - DNA, 707 bp, Zea mays
  misc_feature: Ceres CLONE 1381250-F
  misc_feature: Encodes the peptide sequence at SEQ ID NO. 16830
  misc_feature (531)..(531): n is a, c, t, g, unknown, or other
  misc_feature (623)..(623): n is a, c, t, g, unknown, or other
tccccgcggtggcggccgctctagaactagtggatcccccgggctgcaggaattcgcacgagaccattacctagaacatcctaatcgaaaaacaaagctctctctccctccccccattctctctctttctcctgttccccgcgagagtcgctcaaggccgcggcgaggagaagcggcagcgcgtcacctctccaatggcatccccgtccttcctccgtgcaacctgtgcgcttctcgagtgctgaggctccctgtccctgagacaagcttgcgcgcgcgatggagggtttttcgagggacttgctgtgcgggattggcaagggggacgcgccgccaccggagaagaggccggggcagctgcgggaggagatgggagaggtggagcttagcctcgggctgtcgcttggcggccgattcgggctcgacaggaaggggagcaaactcccccggtcgtcgtccgtggcggccatgctgacaacgccggtggaggtgccggcgccgcccgccctctcgcgggcgagctcgctgccngtccaggcggaggcgtcggaagtgagaggaagcaggggctgaatgggatggggtctttgccgggagggcgcggtctcggcgtgcacacccgncgaggctgccgcgagcgggacccttgctctggctctttcggaggagaaggaagattttgcaagcaccctcatgagactagtccc

SEQ ID NO: 16830 - protein, 97 aa, Zea mays
  misc_feature: Ceres CLONE 1381250-F
MEGFSRDLLCGIGKGDAPPPEKRPGQLREEMGEVELSLGLSLGGRFGLDRKGSKLPRSSSVAAMLTTPVEVPAPPALSRASSLPVQAEASEVRGSRG

SEQ ID NO: 16831 - DNA, 660 bp, Zea mays
  misc_feature: Ceres CLONE 1381251-F
  misc_feature: Encodes the peptide sequence at SEQ ID NO. 16832
gctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacgcacgcagggtggggggcgtacacatccagaaggagtcacccctccacttggggctgcgccttaagggaagcatggagatctttggcagaaccttgactgggaagaaaatcacccttggggggggagtcctcaaaccccattggacaatggcagggcaaagaatccgggacaggggggggcatccccccttgaccagaaagggtctcattttttgccgggcaagaagttgggaggattgggagggccctttggttgcatacaactcccggagggagagcccccccccccttgggggggggggcccttaaggggggggaatgcaa

SEQ ID NO: 16832 - protein, 154 aa, Zea mays
  misc_feature: Ceres CLONE 1381251-F
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDARRVGGVHIQKESPLHLGLRLKGSMEIFGRTLTGKKITLGGGVLKPHWTMAGQRIRDRGGHPPLTRKGLIFCRARSWEDWEGPLVAYNSRRESPPPLGGGGP

SEQ ID NO: 16833 - DNA, 634 bp, Zea mays
  misc_feature: Ceres CLONE 1381253-F
  misc_feature: Encodes the peptide sequence at SEQ ID NO. 16834
  misc_feature (393)..(393): n is a, c, t, g, unknown, or other
  misc_feature (394)..(394): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaaattacaagtataactccattcccctccgtcctcccgcatcaactcgaaccgaagggacgaccgagcggagtctagactcgagagcaacctcgacctcccggatctctctcccacccacgcctcgtcggcgccgtcgtctgctgcagcgatggcctcccccgacctgctctttcatctgcggaacctcttctacctggggcgcctaccagggcagcccttcaacaaaaggggaagttcccgggggccccaaaaaccccaaaaaagcgcccccttgtggtgaggggcccgccccctnnttttttgggacgaaaaaaaccccccggctcccccacggtggggaaaaaaaaaaacccccccccccccctcccttggggggggaaaactccccccccccccccccccgaagaaagaggggggggcccccccccccgcccgggggggggggggggccgcctcaaaaagaaaaaacacccccccgcgcggcgggggggtggtttttttttttttttttnnngagaccacccccccccccggcg

SEQ ID NO: 16834 - protein, 43 aa, Zea mays
  misc_feature: Ceres CLONE 1381253-F
MASPDLLFHLRNLFYLGRLPGQPFNKRGSSRGPQKPQKSAPLW

SEQ ID NO: 16835 - DNA, 766 bp, Zea mays
  misc_feature: Ceres CLONE 1381255-F
  misc_feature: Encodes the peptide sequence at SEQ ID NO. 16836
aaagctggagctccccgcggtggcggccgctctagaactagtggatcccccgggctgcaggaattcgcacgagaccattacctagaacatcctaatcgaaaaactaaactagtgcggggtataaagctctctccctccgcgcttccgaacagttcacgacgactccaggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaagtgaagaaagtgctccagaacatcagcggggtgtaccggatgcgaaatcgatgccccggagcaacaaggtcgtggcgacggtctccaagggagctccaacccctacatgctgttcgccaagctgcgcaagtccgcaaagaaggcggaagcttggggcccgaagcagccggtgcagcataaaggagaagcccgtccccaccagtttgaaagccaaagggcaggaaggagcccaaaaaaaaacccgccctggggtacccgggcaaaacccaatcaaaccttgccgaggaaggggcgtatcccacccccaaaaacgggccgaaggcccccccggtggtaaatccaaacaaccccccaacctttcgcccgcccgggaccccaatacccaaaccccccgctgtaaaaagcccccacaatcccggcgggcccccggaaacctaaaaaaaaaaaccccccaggcccag

SEQ ID NO: 16836 - protein, 85 aa, Zea mays
  misc_feature: Ceres CLONE 1381255-F
MASSEPIECQVVALRVSIHCQGCKKKVKKVLQNISGVYRMRNRCPGATRSWRRSPRELQPLHAVRQAAQVRKEGGSLGPEAAGAA

SEQ ID NO: 16837 - DNA, 730 bp, Zea mays
  misc_feature: Ceres CLONE 1381257-F
  misc_feature: Encodes the peptide sequence at SEQ ID NO. 16838
tccccgcggtggcggccgctctagaactagtggatcccccgggctgcaggaattcgcacgagaccattacctagaacatcctaatcgaaaacaacgccacaatccgccagtcacagacgcgacaatctcaaattgctgcgctgcactaccctgccctgacatatatcgtacctgaacccatgcgagtcatagcgactcacaggcttgcctggtcccaacctcctcattctgcttctgatcgtgctcctgtcagataccgtgatcgtatcccccggtcgccgatgcctccgcttcattgcacgtctccgccctgcaccgcagggtgatgtcttgcctgccatacgcacatatgcttgtcctcgtgccgccccgtgcgcgatggatcgacatccgccgcctgctgcagcaagtcaacatcacccacgaccgccgcaccatctgatcttgcctcgataccgtaggccacggcgacaacgctagcggtacctacatcattcgagcctccgcgctgcccagtgagtgctgagtcgacctgtcgcatgatatcgataacatcgctgactgactggcgattaatcagatgaggcctactacgcatcgtctgttttaggaatgcatagcatgctgtcataatcaaagactgctactgattcttacgtcacatcgaggtgtgactagcacttatctatactgcaggtaccaatggactaacggctctgaaaccggggtc

SEQ ID NO: 16838 - protein, 38 aa, Zea mays
  misc_feature: Ceres CLONE 1381257-F
MSCLPYAHMLVLVPPRARWIDIRRLLQQVNITHDRRTI

SEQ ID NO: 16839 - DNA, 916 bp, Zea mays
  misc_feature: Ceres CLONE 1381257-R
  misc_feature (693)..(693): n is a, c, t, g, unknown, or other
tttgggtactgggcccctccccctgccgaccgaatcgtactggatcaagcaccccctggccacgcattactacatagagagagtacacagacagaagcgcacacatcggttcatgcctacatactctgctcgcggtcaacatgcatccacgatacaccgtttaccaactgtgtagacaattgctaaacaccataaatgactagagacaggcacacctcgatctagcttaaaataccagtagcattactttattactctccgccatgcatgcattcctcgcccggacgcgcacaggacacatcatttaattaatcgtgttgcagttaacgttggtgctgatcttgtacggcagggcgacgccgtacttgctgggcagcgcgtcggcgcggctgatgtaggtgccgctcccgttggcgccattggcgacgttcttgaagcagccgcaaatggtgcggcggccggggggtggttgctgttctgttgcaacaaacatgcgaatgccgtttgggccatagctgaagcggggctgcggggggagtgagcatgttgaaaaggctgacaacccgacaggcaaaaggttttttcccacataaaaaaaaaaaaccctaccagcttcttcttaactttggtacagtagggcagggtgaccacgatgtcgatcttcgatcggaaagccagaataggggcaccacnaaacaaaagaggcattacagaaaacaggtggggtggcggacataaggtggcggtatgaggggaggggagaagggggggaagaatgcggacgggcagtgcggcatgggagacaaaggagaccgtccaggcccgtcggtgcagcgagcgtagtctggtgtcgggggaggtccgtgaagaaaggatacaacacttatcatcgttccgtgttgtatcacgcttggtg

SEQ ID NO: 16840 - DNA, 709 bp, Zea mays
  misc_feature: Ceres CLONE 1381258-F
  misc_feature: Encodes the peptide sequence at SEQ ID NO. 16841
  misc_feature (603)..(603): n is a, c, t, g, unknown, or other
  misc_feature (631)..(631): n is a, c, t, g, unknown, or other
tccccgcgggggcgggcgctctacaactactggatcccccgccgtgctgcaattattcccacgagatcattacctagataatcctaatcgaaaaatataagcacggcggggtggaaccggacgtccctcgctcccaaatatctctccccacctcccctgagcttctcccgacctttggtcaggcaaaggaggcgggcaacaaggacgagcgatggtgaccaaggtcatctgcttcctggtgctcgcatccgtgctcctcgccgtcgcttttcccgtgtctgctctgcggcagcaggtgaagaagggcggcggcggtgaaggcggaggcggaggcagtgttagcggaagcggaggcggcaacctgaatccctgggagtgctcgcccaagtgcgggtcgcggtgctccaagacgcagtacaggaaggcctgcctcaccttatgcaacaagtgctgcgccaagtgcctctgcgtgccagccgggttctacggcaacaagggcgcctgcccctgctacaacaacgggaagacaaggaaggagggccccagtgcccctagaagatccacgcagctcccgtcccgcattgtcccccctttctcgaatcntggaaacgtgtgtcatcttcgaccaccngctagctgggcattttattactagtataatgctaggggcccgccgttgcttaatctggaatgctacagccagatctcc

SEQ ID NO: 16841 - protein, 147 aa, Zea mays
  misc_feature: Ceres CLONE 1381258-F
  misc_feature (2)..(114): Pfam Name: GASA Pfam Description: Gibberellin regulated protein
  misc_feature (131)..(131): Xaa is any aa, unknown, or other
MVTKVICFLVLASVLLAVAFPVSALRQQVKKGGGGEGGGGGSVSGSGGGNLNPWECSPKCGSRCSKTQYRKACLTLCNKCCAKCLCVPAGFYGNKGACPCYNNGKTRKEGPSAPRRSTQLPSRIVPPFSNXGNVCHLRPPASWAFYY

SEQ ID NO: 16842 - DNA, 654 bp, Zea mays
  misc_feature: Ceres CLONE 1381259-F
  misc_feature: Encodes the peptide sequence at SEQ ID NO. 16843
  misc_feature (413)..(413): n is a, c, t, g, unknown, or other
  misc_feature (424)..(424): n is a, c, t, g, unknown, or other
  misc_feature (431)..(431): n is a, c, t, g, unknown, or other
  misc_feature (451)..(451): n is a, c, t, g, unknown, or other
  misc_feature (495)..(495): n is a, c, t, g, unknown, or other
  misc_feature (510)..(510): n is a, c, t, g, unknown, or other
  misc_feature (602)..(602): n is a, c, t, g, unknown, or other
aaagctggagctccccgcggtggcggccgctctagaactagtggatcccccgggctgcaggaattcgcacgagaccattacctagaacatcctaatcgaaaatattcgcggtttgcctctctgcctgcctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctncaggaggcttnccgcgtngtcgacaaggaccagaacgncttcatctctgctgctgagcttcgacatgtcatgaccaacctangtgagaagctgacgnacgagggagtggatgaaatgatccgtgaagccgacgtggacggtgatggccagaatcactacgaggagttcgtgaaagtgatgatggccaanggagatgatgggcctgttttaaaactagttcctcctctggatggagaactaa

SEQ ID NO: 16843 - protein, 166 aa, Zea mays
  misc_feature: Ceres CLONE 1381259-F
  misc_feature (12)..(40): Pfam Name: efhand Pfam Description: EF hand
  misc_feature (48)..(76): Pfam Name: efhand Pfam Description: EF hand
  misc_feature (85)..(113): Pfam Name: efhand Pfam Description: EF hand
  misc_feature (121)..(149): Pfam Name: efhand Pfam Description: EF hand
  misc_feature: SWISSPROT Homolog: EC 2.7.11.1 Non-specific serine/threonine protein kinase
  misc_feature (90)..(90): Xaa is any aa, unknown, or other
  misc_feature (99)..(99): Xaa is any aa, unknown, or other
  misc_feature (114)..(114): Xaa is any aa, unknown, or other
  misc_feature (119)..(119): Xaa is any aa, unknown, or other
  misc_feature (149)..(149): Xaa is any aa, unknown, or other
MADQLTDDQIAEFKEAFSLFDKDGDGCITTKELGTVMRSLGQNPTEAELQDMINEVDADGNGTIDFPEFLNLMARKMKDTDSEEELQEAXRVVDKDQNXFISAAELRHVMTNLXEKLTXEGVDEMIREADVDGDGQNHYEEFVKVMMAXGDDGPVLKLVPPLDGEL

SEQ ID NO: 16844 - DNA, 720 bp, Zea mays
  misc_feature: Ceres CLONE 1381263-F
  misc_feature: Translation starting site: 159
  misc_feature (537)..(537): n is a, c, t, g, unknown, or other
  misc_feature (580)..(580): n is a, c, t, g, unknown, or other
  misc_feature (585)..(585): n is a, c, t, g, unknown, or other
  misc_feature (586)..(586): n is a, c, t, g, unknown, or other
  misc_feature (710)..(710): n is a, c, t, g, unknown, or other
tccccgcggtggcggccgctctagaactagtggatcccccgggctgcaggaattcgcacgagaccattacctagaacatcctaatcgaaaaagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccgccgccgccgccgccgccgcctcgaaggccggttccgacgacgtgggtgccgcctccgcaacagcaccgccgcctccggtgaggaccctcagaactgggatgcggacttcgtcaaggtcgacccaggcacgcttttcgacctcatcttggctgcaaactatctgaacatcangggtctgctcgacctgacctgtcagactggtgctgacatgatncaggnncagacaccagaagagattcgcaagaccttcacatcaagatgacttcacccctgaggaggaagagagatccgcagggagaccagtgggcttccagtaaggagtgctggatctatggatgcctaangttcgtgtgt

SEQ ID NO: 16845 - DNA, 675 bp, Zea mays
  misc_feature: Ceres CLONE 1381264-F
  misc_feature: Encodes the peptide sequence at SEQ ID NO. 16846
  misc_feature (273)..(273): n is a, c, t, g, unknown, or other
  misc_feature (393)..(393): n is a, c, t, g, unknown, or other
  misc_feature (394)..(394): n is a, c, t, g, unknown, or other
  misc_feature (539)..(539): n is a, c, t, g, unknown, or other
tccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggccggggcggaggacggagtggtcgaaacggacccgcaggaggacctgcggtggtgcaagcaggcgtgcgagtggcagtacggaaaggacaccccgcggaagagggaatgcnnagagcgagtgccgcgagcggcacagcaagctgacgcgggcgaggacggcgaccagcgcgtggacgcctacgtctcccgctccggaaggggcgagtgccggcgcagtgcctgcgccgccacgagggccagccggtgggaaacccangagtgcatgaagcggtgcccgccccggcggactggccgtcaacatggagaaagaataccggtcccggcaagcaaagccccgggccagtgcccggaaagagtgcaagcgccaccacccccgggactggtggaaaaaa

SEQ ID NO: 16846 - protein, 157 aa, Zea mays
  misc_feature: Ceres CLONE 1381264-F
  misc_feature (24)..(24): Xaa is any aa, unknown, or other
  misc_feature (64)..(64): Xaa is any aa, unknown, or other
  misc_feature (112)..(112): Xaa is any aa, unknown, or other
MGKGSVGASWWAFLLLAGVLLVVXATAGAEDGVVETDPQEDLRWCKQACEWQYGKDTPRKRECXERVPRAAQQADAGEDGDQRVDAYVSRSGRGECRRSACAATRASRWETXECMKRCPPRRTGRQHGERIPVPASKAPGQCPERVQAPPPPGLVEK

SEQ ID NO: 16847 - DNA, 718 bp, Zea mays
  misc_feature: Ceres CLONE 1381268-R
  misc_feature (454)..(454): n is a, c, t, g, unknown, or other
  misc_feature (455)..(455): n is a, c, t, g, unknown, or other
  misc_feature (475)..(475): n is a, c, t, g, unknown, or other
  misc_feature (476)..(476): n is a, c, t, g, unknown, or other
  misc_feature (508)..(508): n is a, c, t, g, unknown, or other
  misc_feature (511)..(511): n is a, c, t, g, unknown, or other
cgattgggtaccgggccccccctcgaggtcgacggtatcgataagcttttttttttttttttttggaaacgaatgtcacatctttactatataataggagttctgtacaaaatatataaataattacatcgaaaggagacaacaatctagcaacccaaagttgactgggaaacgacggcctagacctctcacgaacacatcacatcatccttcatgtgtgtcatcctgtggtacctgttcttgacctgtggggggtgtgagatagcaagggtgagctcacgtatgttcatcgctcaacaagttgtggagaataatgtgcatgaactcaccaaaggtaggagttcatatgatgtgtaaggctggtcaataataggggttaaagctgaacattgcttttaataagttggtcaaatttttattagcagttactaaaatgtagtaaataccaaacccnntacataatagaacaaaattnnatataaataaatccccatgcatgcaaatgacnaantggattttagtcccatagttaatcatgcgagagtcctgagctgctcatgaccgcgatcacaactaagatatcagttttaaactctacaaagattgtaccctgtaccaaacagtcgtgtattccatgtccccaggttacctacacccttaaccctaccgaggtgatggctagggatcccttacaaggctttacaaagtcccctaactt

SEQ ID NO: 16848 - DNA, 660 bp, Zea mays
  misc_feature: Ceres CLONE 1381268-F
  misc_feature (602)..(602): n is a, c, t, g, unknown, or other
gctctagaactagtggatcccccgggctgcaggaattcgcacgagaccattacctagaacatcctaatcgaaaaagaaattcgtaactagagaaccgtaactccggtttgatccattcgaattgcgttggattcataataatatcgtctgtacagtatgacactaacatatatcacaccccatacttttattattagaaatttgtctagcctatgtttaatagattaacccctctaattgaagttaacctctccataattatagtttgattaaaatatgatttctagttaagttataattaagattaaagttgaattaattattaatggaatattctctcatatggtgcatactaatcaatttataatatagtttaatcacatagatcttccataaatcataactccttaaccatgactccgatcttactagttctcgaacccacgatctcgtagcgacgagtagatcattattatgcaatttgttcttatgtttggtgtgatgttaattattcctataccatgtttgtttgtattgctatgactagtagtgaggtcacgagaatctaaagatcatcttgatacctggaaatctcagtcccnagaaagtatgcccttgatcactttatttacccaatatgttctttatatcatttactcc

SEQ ID NO: 16849 - DNA, 651 bp, Zea mays
  misc_feature: Ceres CLONE 1381270-F
  misc_feature (399)..(399): n is a, c, t, g, unknown, or other
tccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcaccctttgtcctcgagcatcatcagccctatacatcaggtaccttgntgcattattgcacaaacatcaggccaccacactacaacacttggctagcaacctgctgctactccagaaacagagttccttcattccaccactactggaatgaatttgctttaatttggaacaaaaaaatacctttagccgttacttgttgctacccccaaaaatttttcctttcacccagtgggaaattgaaactccccggttttttacgggggaaaaatttttcctttttcccctttatattgggggaac

SEQ ID NO: 16850 - DNA, 721 bp, Zea mays
  misc_feature: Ceres CLONE 1381272-F
  misc_feature: Encodes the peptide sequence at SEQ ID NO. 16851
  misc_feature (278)..(278): n is a, c, t, g, unknown, or other
  misc_feature (292)..(292): n is a, c, t, g, unknown, or other
  misc_feature (294)..(294): n is a, c, t, g, unknown, or other
  misc_feature (295)..(295): n is a, c, t, g, unknown, or other
  misc_feature (308)..(308): n is a, c, t, g, unknown, or other
  misc_feature (682)..(682): n is a, c, t, g, unknown, or other
aagctggagctccccgcggtggcggccgctctagaactagtggatcccccgggctgcaggaattcgcacgagaccattacctagaacatcctaatcgaaaaatgccattcgagcagcatcgtcacccagagccaagctgcaagcagctagtagcggccggcagcatcgcgtagtagagtgtgctcagagcagcgcgcgcatgggacccttgggccccaccgtgagcttcagtatcatggtcatggccaagctcagcggcgccgcccacagcagccggnaggaatggagaggnannaggaagagggcgncagtgggtgcggcttccggatgccgctgcactacccgcgctacaagaaggcggactacgaggccatgcccgagtggcgcgtcgactgcctgctccgcgagtacggcctccccgccgacggcgacctcgacagcaagcgccgcttcgccatgggcgccttcctctggggccgacagcactgatctgatacaaccaaaacagctagcgcgctagcccagagcgcggcgtgccggccgtgaatagtctcgtcatggtcagagcatcagctgtagcgatcgagacctaatcatcatcgggcatatgctctcttgctatttataagtaccatctgcttgtagttgatagtatagctaattattagctatggataattangagatgttatgggacaaaaaaaaaaaaaaagctatgatc

SEQ ID NO: 16851 - protein, 68 aa, Zea mays
  misc_feature: Ceres CLONE 1381272-F
  misc_feature (4)..(4): Xaa is any aa, unknown, or other
  misc_feature (5)..(5): Xaa is any aa, unknown, or other
  misc_feature (9)..(9): Xaa is any aa, unknown, or other
MERXXEEGXSGCGFRMPLHYPRYKKADYEAMPEWRVDCLLREYGLPADGDLDSKRRFAMGAFLWGRQH

SEQ ID NO: 16852 - DNA, 740 bp, Zea mays
  misc_feature: Ceres CLONE 1381273-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (44)..(44): n is a, c, t, g, unknown, or other
nnnnnnnnnnnnnnnnnnngggaaggtggaaagaatccccattnttaaaaatggagctccccgcggtggcggccgctctagaactagtggatcccccgggctgcaggaattcgcacgagaccattacctagaacatcctaatcgaaaaatatctccctgactcgcctcgtcctccagatatcggccgccaccttcacctccaccgccccggcgcacctgtgcgtctccatcgtcgccgcctctcctccttcggacacgactgaccttccactggcgccaacgaagaaaacacataggaagaagctcaccgccaaacctcatccagatccagtcgctgccctccgaaggccgcatacggaacgtctcgtctcttcctttggatccggcggtcaactccatcacccccagcttcacctcccttaggccccctccgtccgctctcacccaccgcttctatatcgccacctctctcgttgtagaagaagacactgaggatctggctttctggaatcacatttcttgagaactatctgttggagaactaaactagggctcttgttcatattatggatcagcaagctaagattgatgctgattttccttgaaccaactgtactcttagatgagacacattacccaggaggggtacaaaaatgggtattatgatggtttgggcatcttggaaaggaagagggggaagccaggttgggtttaaaaggatggggtttcccagggggggg

SEQ ID NO: 16853 - DNA, 724 bp, Zea mays
  misc_feature: Ceres CLONE 1381277-F
  misc_feature: Encodes the peptide sequence at SEQ ID NO. 16854
  misc_feature (561)..(561): n is a, c, t, g, unknown, or other
  misc_feature (680)..(680): n is a, c, t, g, unknown, or other
  misc_feature (685)..(685): n is a, c, t, g, unknown, or other
aagctggagctccccgcggtggcggccgctctagaactagtggatcccccgggctgcaggaattcgcacgagaccattacctagaacatcctaatccaaaaacgctgagccgtcgttgtcgctgggattgcagcagcgttggcgggccttgtggcgaggaggaggaggagaaggagggggcgtggaggcgcggcgattgttcgcgggatgagctacggcggcagcagctccctcgcgcccggtgccaagaggccgttcgagtacgggagaacgcatgtggtgaggcccaagggcacgcacaaggccaccattgtctggctccacggacttggggacaatggaaccagctggtctcaactgctggaaacgctcccccttcctaatataaaatggatatgcccaactgcaccttcaagacctgtgtcattgtttggcgggttcccctgcacagcatggtttgatgttgctgacctttctgaggatgctcccgatgacactgaggggatggatgcctcagcagcacatgttgcaaatttgttgtcaactgaacccgctgacatncagcttggtggtggtgggcttagtatgggtgctgctactgctctgtactctgcaacttgctttgctcatggaaaatatgggaacggcaatccataccctgtggacctaaagtctggcgntgggnctagggggctggcttcatggggccaggacctggaagaca

SEQ ID NO: 16854 - protein, 172 aa, Zea mays
  misc_feature: Ceres CLONE 1381277-F
  misc_feature (19)..(172): Pfam Name: Abhydrolase_2 Pfam Description: Phospholipase/Carboxylesterase
  misc_feature: SWISSPROT Homolog: EC 3.1.1.1 Carboxylesterase
  misc_feature (118)..(118): Xaa is any aa, unknown, or other
  misc_feature (158)..(158): Xaa is any aa, unknown, or other
  misc_feature (160)..(160): Xaa is any aa, unknown, or other
MSYGGSSSLAPGAKRPFEYGRTHVVRPKGTHKATIVWLHGLGDNGTSWSQLLETLPLPNIKWICPTAPSRPVSLFGGFPCTAWFDVADLSEDAPDDTEGMDASAAHVANLLSTEPADXQLGGGGLSMGAATALYSATCFAHGKYGNGNPYPVDLKSGXGXRGLASWGQDLED

SEQ ID NO: 16855 - DNA, 724 bp, Zea mays
  misc_feature: Ceres CLONE 1381279-F
  misc_feature: Encodes the peptide sequence at SEQ ID NO. 16856
  misc_feature (666)..(666): n is a, c, t, g, unknown, or other
aaagctggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccgggtcctccttgctgcttcaggaagtgtagccgctataaaatttgagagcctttgccgtagcttctctgagtgggcggatgtccgagctgtggccaccacgtcatccttgcacttcgttgatagatcatctctaccaagtggcatcgttctttacactgatgatgatgaatggtcaacctgnaagaaataggagatgaagtcttacacatcgagctgcgaaatgggcagacgttatggtg

SEQ ID NO: 16856 - protein, 84 aa, Zea mays
  misc_feature: Ceres CLONE 1381279-F
  misc_feature: SWISSPROT Homolog: EC 4.1.1.36 Phosphopantothenoylcysteine decarboxylase
  misc_feature (82)..(82): Xaa is any aa, unknown, or other
MATSEPVQESLVVHYSQPSRPRVLLAASGSVAAIKFESLCRSFSEWADVRAVATTSSLHFVDRSSLPSGIVLYTDDDEWSTXKK

SEQ ID NO: 16857 - DNA, 688 bp, Zea mays
  misc_feature: Ceres CLONE 1381282-F
  misc_feature: Translation starting site: 200
  misc_feature (337)..(337): n is a, c, t, g, unknown, or other
  misc_feature (342)..(342): n is a, c, t, g, unknown, or other
  misc_feature (343)..(343): n is a, c, t, g, unknown, or other
  misc_feature (345)..(345): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (525)..(525): n is a, c, t, g, unknown, or other
  misc_feature (526)..(526): n is a, c, t, g, unknown, or other
  misc_feature (530)..(530): n is a, c, t, g, unknown, or other
  misc_feature (533)..(533): n is a, c, t, g, unknown, or other
  misc_feature (534)..(534): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
  misc_feature (595)..(595): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctcccacgacaggggccggaccggcgntcccnnanggcgctgaagggggggaacctttttcccccttgggggggttttgtttttgggggggcctttccccccggggtgtttgttttttggttttttaaccccccccccccccccccccgggggggggggggggggggggnnnnnnnngnnnnnnnnnnnnnnnnnnnnnnnnnnnnnnnnnnncnngccnccnncnnnnnnnnnnnnntnnnnnnnnnnntnnnnnnnnnnncccnnnncngggcggggggcgcnccccttcctccgcgcgtggctnnnccggcgggccccccccgggggggggggggggggggtttttttttttttttttttttttcctcccccccc

SEQ ID NO: 16858 - DNA, 701 bp, Zea mays
  misc_feature: Ceres CLONE 1381283-F
  misc_feature: Encodes the peptide sequence at SEQ ID NO. 16859
  misc_feature (510)..(510): n is a, c, t, g, unknown, or other
  misc_feature (511)..(511): n is a, c, t, g, unknown, or other
  misc_feature (621)..(621): n is a, c, t, g, unknown, or other
ctccccgcggtggcggccgctctagaactagtggatcccccgggctgcaggaattcgcacgagaccattacctagaacatcctaatccaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcagcaggctaaagggctccacgctccttaccgaaggagtggtgacggatggatccgatgaatgggcaatctanncgcggaccggagagtttgctatggcgagaggtgtcgtcaaaagaaagtaccttgccgatagggacggcgccgggaacactgacgagctcagcatgcaggttttctgcccnggtgttggctcatcacagcaaccaaacagcaggactccaccatctctgtcacccagatttgggtatggggtgggcgagga

SEQ ID NO: 16859 - protein, 187 aa, Zea mays
  misc_feature: Ceres CLONE 1381283-F
  misc_feature (124)..(124): Xaa is any aa, unknown, or other
  misc_feature (125)..(125): Xaa is any aa, unknown, or other
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGSRLKGSTLLTEGVVTDGSDEWAIXXRTGEFAMARGVVKRKYLADRDGAGNTDELSMQVFCPGVGSSQQPNSRTPPSLSPRFGYGVGE

SEQ ID NO: 16860 - DNA, 693 bp, Zea mays
  misc_feature: Ceres CLONE 1381284-F
  misc_feature: Encodes the peptide sequence at SEQ ID NO. 16861
  misc_feature (547)..(547): n is a, c, t, g, unknown, or other
  misc_feature (568)..(568): n is a, c, t, g, unknown, or other
  misc_feature (591)..(591): n is a, c, t, g, unknown, or other
  misc_feature (633)..(633): n is a, c, t, g, unknown, or other
  misc_feature (644)..(644): n is a, c, t, g, unknown, or other
tggcggccgctctagaactagtggatcccccgggctgcaggaattcgcacgagaccattacctagaacatcctaatcgaaaaactaaactagtgcggggtataaagctctctccctccgcgcttccgaacagttcacgacgactccaggaggggcgcacttgactttcccctcctcctcctgcgagcaccttcctcgcctcgctctcatggcctcatcagagcctatagagtgccaggttgtggcgctgagggtgtcgattcactgccaaggatgcaagaagaaggtgaagaaggtgctccagaacatcagcggcgtgtaccgatgcgaaatcgatgcccggagcaacaaggtcgtggcgacggtctcgacggagctcgacccctacatgctggtcgccaagctgcgcaagtccggcaagcaggcggagctgtggccggagcagccggtgcagcagcaggagcagccggcaccaccagctgagagccaaagggcagaggagccccagacaaccagcctgcggagccgggcagaccccagcgacctgncgaggagcgcggcgccgccgncgacacggccgaggcccgcgcgncggagccgagcaacccgcaaccttcgcccgcggagcccaagncgagcgccggnggagaaggcccgaatccggcgggcccaggacagaaaagaaacggcagcg

SEQ ID NO: 16861 - protein, 162 aa, Zea mays
  misc_feature: Ceres CLONE 1381284-F
  misc_feature (13)..(75): Pfam Name: HMA Pfam Description: Heavy-metal-associated domain
  misc_feature (114)..(114): Xaa is any aa, unknown, or other
  misc_feature (121)..(121): Xaa is any aa, unknown, or other
  misc_feature (142)..(142): Xaa is any aa, unknown, or other
  misc_feature (146)..(146): Xaa is any aa, unknown, or other
MASSEPIECQVVALRVSIHCQGCKKKVKKVLQNISGVYRCEIDARSNKVVATVSTELDPYMLVAKLRKSGKQAELWPEQPVQQQEQPAPPAESQRAEEPQTTSLRSRADPSDLXRSAAPPXTRPRPARRSRATRNLRPRSPXRAPXEKARIRRAQDRKETAA

SEQ ID NO: 16862 - DNA, 670 bp, Zea mays
  misc_feature: Ceres CLONE 1381285-F
  misc_feature: Encodes the peptide sequence at SEQ ID NO. 16863
  misc_feature (475)..(475): n is a, c, t, g, unknown, or other
  misc_feature (548)..(548): n is a, c, t, g, unknown, or other
  misc_feature (624)..(624): n is a, c, t, g, unknown, or other
  misc_feature (670)..(670): n is a, c, t, g, unknown, or other
tccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgccgagcaaatgttgatcaataatccgtcacgtgtcaaggagtacctaccaatcaccggtctggctgaaattcataagctgagcgctaagcttatctttggcgctgacagccctgctattcaggagaatagggttgctaccgtgcagtgcctatncggtactggttctttaaggaggtcgaggtgaatttcttgcaggcactatcacgagcgcactatctacttcccnacagcaggctgggggaaatcacccaaagtcttcaccctatctggcttggacgttaggagctaccgctattatgatncctgcacatgcaggcttcacttcgaggactcctggaagacctcggn

SEQ ID NO: 16863 - protein, 119 aa, Zea mays
  misc_feature: Ceres CLONE 1381285-F
  misc_feature: SWISSPROT Homolog: EC 2.6.1.1 Aspartate transaminase
  misc_feature (110)..(110): Xaa is any aa, unknown, or other
MASQGSSVFAALEQAPEDPILGVTVAYNKDPSPVKVNLGVGAYRTEEGKPLVLNVVRRAEQMLINNPSRVKEYLPITGLAEIHKLSAKLIFGADSPAIQENRVATVQCLXGTGSLRRSR

SEQ ID NO: 16864 - DNA, 693 bp, Zea mays
  misc_feature: Ceres CLONE 1381288-F
  misc_feature (256)..(256): n is a, c, t, g, unknown, or other
  misc_feature (259)..(259): n is a, c, t, g, unknown, or other
  misc_feature (262)..(262): n is a, c, t, g, unknown, or other
tccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcgncgncgntgtgcgacatgagcaacgagcagttcatgtcgtgccagccccgcggcggccaagacgacggacccgccggccgcgccgtcgcaggggtgctgccacccgctggcgggggggggacgtcagtgcctgtgcggctaccagaactcgccggggatgggcgtctacaacatcgaccccaagcgcgccatggagcttccgggcaagtggggcctcgccacggcgcccgactgctaacagtgtgctagcccaggccagccaaggcaggaaggcccccggcattgctagctggaccgggtctgggtgggccatctgcaccagggtgcaggcaaggggcccccgaaggaacggggcttctttctcccctcccatctttggcacccggacctaatctaagaggggggggggggttccggaccaaattaaaaatgggtctt

SEQ ID NO: 16865 - DNA, 652 bp, Zea mays
  misc_feature: Ceres CLONE 1381291-F
  misc_feature: Translation starting site: 139
  misc_feature: Pfam Name: Glutaredoxin Pfam Description: Glutaredoxin
  misc_feature (418)..(418): n is a, c, t, g, unknown, or other
  misc_feature (486)..(486): n is a, c, t, g, unknown, or other
  misc_feature (541)..(541): n is a, c, t, g, unknown, or other
cgctctagaactagtggatcccccgggctgcaggaattcgcacgagaccattacctagaacatcctaatcgaaaaaagagacagacacgcaaacgagaggactcgagagagattccgccgccaccaccgccggctcagatgccgccgccgcagtcgggcatgaccctctgccgccttcccaaggccacccttggccttcccctttctctcccctctttgctatatcgtcccagcctgtccctcgccgcacgtcgcaccaaggccgtctccgccagggcctcctcctcctctccatcaccggactcttccttcggttcgcggatggaggattccgtcaagaagacggtggctgataaccccgttgtcatctactctaagtcatggtgctcatattccatgggaggtgaagtcactcttncaagcggatcggtgtgcagccccacgtcatcgagctcgacaatctcggagctcagggaccacactacnaaaaggtattagaaaggctgactggacagtctactggtcctaacgttttcatcgntggaaaaacacgtggaggctgcacagatacggtggagctgtatcgcaaggggagctagctagcatgctgtcggacctgatatcaacattgacactcatgacaggtatgttc

SEQ ID NO: 16866 - DNA, 676 bp, Zea mays
  misc_feature: Ceres CLONE 1381292-F
  misc_feature: Encodes the peptide sequence at SEQ ID NO. 16867
tccccgcggtggcggccgctctagaactagtggatcccccgggctgcaggaattcgcacgagaccattacctagaacatcctaatcgaaaaatcacattcccaaaccctccgtcgacccctcctcctcgatctacaccggcgatcggcggcgagtgatggggtgggcgacgcggttcctggcggcggtgtgcttctttgctgcgggtgtcctcttcgccccggaggtctccttggttccccctcccgggcaggcgccgtcaccgctgccaagctggcccacgtcctctccctttgcacttcctggggcgccgccctctgggccacctttatcgggcgcatcatcatgttccaaaacctggcgaggcacatggtcggcaacttgcagagcaagatggtcccggcctacttcacgcttatctctggctgcggagccatctcggtcgccaccttctcgcacctccacccggggaagacggcgtccaccgtggagcgctaccagcttggatccctcctatcagggctcggggtgcatctcccccacctggtagtcttcaccccccatgacatttgagatgatgaaaaagagggacaaggattgagccgggacctgagttatcggggaggaagtggggatggtcaaagaaatcagccagggtgcttaaaacccaccccccc

SEQ ID NO: 16867 - protein, 75 aa, Zea mays
  misc_feature: Ceres CLONE 1381292-F
MFQNLARHMVGNLQSKMVPAYFTLISGCGAISVATFSHLHPGKTASTVERYQLGSLLSGLGVHLPHLVVFTPHDI

SEQ ID NO: 16868 - DNA, 633 bp, Zea mays
  misc_feature: Ceres CLONE 1381293-F
  misc_feature: Encodes the peptide sequence at SEQ ID NO. 16869
  misc_feature (332)..(332): n is a, c, t, g, unknown, or other
tccccgcggtggcggccgctctagaactagtggatcccccgggctgcaggaattcgcacgagaccattacctagaacatcctaatcgaaaagagacccattagcgaccggccagtgatccccgaccccgagtcccgaggccgacgccattcctgattcctccatcttccgttccgccgcaccgccgccggagatatgtcgaggctcgctgctgccgccctccgctgcgtcctcactgcatcgagagatacctcctcatctcgcttcgccgtgtctgcgccggtgtctgctcggctcttctccgcggatgcatcccgtgaagccgccgccacnggcgcagagtcgcaggatgactctttcttcagggcatccgcggagggatagcctatggaaggtttacagtgccattggtggaggcagtcgtcctgagaagacatattggaaaactgatatatccatcacttggacgatggggatggtcattggatgatggggaaatggatacaacaggggatatgctccctggccggtttgctgaagttttctccgagggaatggttaccccgcattaggcagccaatcaaatccgctggccgggattgatgaaatagcctgaaaactgggatctccaaag

SEQ ID NO: 16869 - protein, 62 aa, Zea mays
  misc_feature: Ceres CLONE 1381293-F
MSRLAAAALRCVLTASRDTSSSRFAVSAPVSARLFSADASREAAATGAESQDDSFFRASAEG

SEQ ID NO: 16870 - DNA, 691 bp, Zea mays
  misc_feature: Ceres CLONE 1381297-F
  misc_feature: Encodes the peptide sequence at SEQ ID NO. 16871
  misc_feature (273)..(273): n is a, c, t, g, unknown, or other
  misc_feature (320)..(320): n is a, c, t, g, unknown, or other
  misc_feature (360)..(360): n is a, c, t, g, unknown, or other
  misc_feature (427)..(427): n is a, c, t, g, unknown, or other
  misc_feature (490)..(490): n is a, c, t, g, unknown, or other
tccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcancagcagcagaagcagggcgccatgatgacggcgctcagggccgcgancgccgcgaccttcggcgggtcgatgctggtgctgtccggnctgatcctggccggcaccgtgatcgcgctcacggtggccacccccgtgctggtgatctcagccgggnttggggggggcggcccccccatcgcgctggcgctcatggggggccgggttcgtcacctccggngggcctcggcggtcgctggggctggccgtggtcctcctggaatggacaaagtacctgacggggaaggccccggccggggggccgacccaggtggaccacgccaagggggaggttgggcgtccaagggccggcgaaattaagggatgaagcacagcaccggatcgacaagggggaggggggctttgaggagaacacccacct

SEQ ID NO: 16871 - protein, 147 aa, Zea mays
  misc_feature: Ceres CLONE 1381297-F
  misc_feature (36)..(135): Pfam Name: Oleosin Pfam Description: Oleosin
  misc_feature (29)..(29): Xaa is any aa, unknown, or other
  misc_feature (45)..(45): Xaa is any aa, unknown, or other
  misc_feature (81)..(81): Xaa is any aa, unknown, or other
  misc_feature (102)..(102): Xaa is any aa, unknown, or other
MADHHRGATGGGGGYGDLQRGGGMHGEAXQQQKQGAMMTALRAAXAATFGGSMLVLSGLILAGTVIALTVATPVLVISAGXGGGGPPIALALMGGRVRHLRXASAVAGAGRGPPGMDKVPDGEGPGRGADPGGPRQGGGWASKGRRN

SEQ ID NO: 16872 - DNA, 578 bp, Zea mays
  misc_feature: Ceres CLONE 1381300-F
  misc_feature: Encodes the peptide sequence at SEQ ID NO. 16873
  misc_feature (187)..(187): n is a, c, t, g, unknown, or other
  misc_feature (421)..(421): n is a, c, t, g, unknown, or other
  misc_feature (491)..(491): n is a, c, t, g, unknown, or other
gctcagaatagtggtcccccgggctgcaggattcgcacgagaccattacctagaactcctaatcgaaaaccaacaggaaaaaaggcccagaggcggtgccgtgaccgattcgagacgcaagagaaggtcgagacgaggcggcggttttccggggcagcatcggcgcggcccacgaagagtcttactncagaggctcaaggtatggatctcgctcgccttactcgagaagcacaaggtaccgaagtcgctctaggagtgtcgactctagtgatgctgaaaaccctgggaacacctgtatgtgactggtttgtcagctcgtgtaacgaatcgagatctggaggaggacttctccactgagggggggtgatggatgcaagcgtttgatatgatccttggacagggaatcccggggtttgggttnggtaccatggctgctgtaaagaggcggatccctgcatcaaatatcgggccggtctggggttgcagggccnggccataactggtgaaaaaattttgttaacccaaaagggggaaaaggggggaacttgccccgcaaaaaatgggaccaccctaaaccc

SEQ ID NO: 16873 - protein, 42 aa, Zea mays
  misc_feature: Ceres CLONE 1381300-F
  misc_feature (17)..(17): Xaa is any aa, unknown, or other
  misc_feature (41)..(41): Xaa is any aa, unknown, or other
MQAFDMILGQGIPGFGXGTMAAVKRRIPASNIGPVWGCRAXP

SEQ ID NO: 16874 - DNA, 680 bp, Zea mays
  misc_feature: Ceres CLONE 1381301-F
  misc_feature (281)..(281): n is a, c, t, g, unknown, or other
  misc_feature (393)..(393): n is a, c, t, g, unknown, or other
  misc_feature (394)..(394): n is a, c, t, g, unknown, or other
  misc_feature (441)..(441): n is a, c, t, g, unknown, or other
  misc_feature (544)..(544): n is a, c, t, g, unknown, or other
  misc_feature (545)..(545): n is a, c, t, g, unknown, or other
tccccgcggtggcggccgctctagaactagtggatcccccgggctgcaggaattcgcacgagaccattacctagaacatcctaatcgaaaaactgccatgttcgcctcgcgctcctcacccccgctatcccctccgtgtcggcgtgcgccgacggcatcttgcccagtctcaaccgattttatccttcggtctgctagggccttgtcaaatcgccgccacggcgaactcgcgccgctgccatgttcgcctcgcgcacccaccatctccctcacaatgttcnaactggcaaccacaacatcctcctccatagcccgacctctcacacattccaacttggtgcggcgtaaacgcgcagcagcacttcgacccggtcggccacggcctgcccctanngcgtgacatccagatccatctcgctccgatctacattcgagaagttngtctccgacatcgattccccagtctgaatcgttgtcgacgtcttctttggggtgaaacgtcgaagtcacgcgcacgcacatcccacacttgttcctccccggnngtgcattcagcaacactgtcttctttctcgtgtcggagcacctcgggccacagggggcggacccgtgaacgacgttcctttcgggggtggcacgatctccgggtcgcaagctcgatgctctccccaatcgacacg

SEQ ID NO: 16875 - DNA, 670 bp, Zea mays
  misc_feature: Ceres CLONE 1381304-F
  misc_feature: Translation starting site: 150
  misc_feature: Pfam Name: La Pfam Description: La domain
  misc_feature (261)..(261): n is a, c, t, g, unknown, or other
  misc_feature (453)..(453): n is a, c, t, g, unknown, or other
tccccgcggtggcggccgctctagaactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcggnagacggtcgagcagagcgatgacggattggtgagcttgcccttgatatgctccttctcgcggatgaagtcccacctggggctggacgcaaatgtcaagcccgagactgtgccggaggagaccgtgcttgcggttgctgaggtgctccggccttctcctgccctccgcgtatcggaggatggaaagaagattngtagagctagtgaaactcttgagccagatgagatcatagaaacagtagactctaggactattgctggatctccgctgccttggcatggaaagcaggaagacctccaatcttttttccaaataatgcaaaggtaaatagcgtgagacttccacgcaatattgccaacaaaaacacttctgggggactgcttttggttagttttctaagaaggaggaaa

SEQ ID NO: 16876 - DNA, 705 bp, Zea mays
  misc_feature: Ceres CLONE 1381306-R
  misc_feature (306)..(306): n is a, c, t, g, unknown, or other
  misc_feature (325)..(325): n is a, c, t, g, unknown, or other
  misc_feature (335)..(335): n is a, c, t, g, unknown, or other
  misc_feature (447)..(447): n is a, c, t, g, unknown, or other
  misc_feature (501)..(501): n is a, c, t, g, unknown, or other
  misc_feature (504)..(504): n is a, c, t, g, unknown, or other
  misc_feature (538)..(538): n is a, c, t, g, unknown, or other
  misc_feature (559)..(559): n is a, c, t, g, unknown, or other
  misc_feature (570)..(570): n is a, c, t, g, unknown, or other
cgattgggtaccgggccccccctcgaggtcgacggtatcgataagcttttttttttttttttttagataagtacttgcaaaaatctctatgactagtgaggtcatagtagactaagcttttcagtatagttgatccatggagagtgtacagctataaaatggtcaggtttttggaacttaagcctaccaagttcagctattgcatcgtgtagcagtactgaacttatcctgtcaacacacctaaaatcaaactagaaagattcatgctcatgataaagcattatatcttttccactggcattctcngttagtcaaaaagaccagnttacttactngaactggtgaatactccataatgaagaattggaaacatctttgcagaagaagaaaagagtgctgactagtacatagtagtagtacctcacttcagtagtatggcattagatncacagaggcagcagatagtacatagtagtagtacctcactttcagtgtcatcgncgncgtcctcctcctcctcccttctgaagcgggtggntccaccctctttgcttatggncagcttcatgntgccgaaaggagtgtcgacatcgatctttcccttgatggtgtatcccgtgcccctccccctgatcatgttccagacagcggatccgaagtcctttgggcctgaagctgaagggcacctgcatcctggtgaatccc

SEQ ID NO: 16877 - DNA, 727 bp, Zea mays
  misc_feature: Ceres CLONE 1381306-F
  misc_feature: Encodes the peptide sequence at SEQ ID NO. 16878
gctctagaactagtggatcccccgggctgcaggaattcgcacgagaccattacctagaacatcctaatcgaaaatcagcatctcgcgcttcagatctcgcccaccgatctgggaactggaattcccctcccgatctgtatgtatctcacgcacgctggctcgcggtcttgggtttgctccacctctctctagcagagtaacagtctagcagagcaagcatgtcgtcgtcggcggagaacgaccccacggtgacggggaccgaggggggaggcaaggacaagcaccgaggacggcggcaacaaggagcagggcggcgggggcttcatcgacaagggggaagggacttcatccgggaggtgcgggagaaaaatcgagggagagccttccggttttcgggaagggcccacgggccggaagtggggggggaatccacattcccggaaaataaagccttcaaccggggccggaccttcgttggggggagggggttcaataaaagaacccgaaaccccgggccccgaatcccggttggggggaaatcggaataacctcatcccaacagggaagggccgggaaagtttgggggttcgggccctcatttccggggagggcgggacaccattccaagggggcaggggccaggaaaaaccggccaaaaaaatcccgggggggtcgccttcggttttccgaaggaatttcagagaggacccttagagggggcggttcg

SEQ ID NO: 16878 - protein, 109 aa, Zea mays
  misc_feature: Ceres CLONE 1381306-F
MSSSAENDPTVTGTEGGGKDKHRGRRQQGAGRRGLHRQGGRDFIREVREKNRGRAFRFSGRAHGPEVGGESTFPENKAFNRGRTFVGGRGFNKRTRNPGPRIPVGGKSE

SEQ ID NO: 16879 - DNA, 628 bp, Zea mays
  misc_feature: Ceres CLONE 1381308-F
  misc_feature: Encodes the peptide sequence at SEQ ID NO. 16880
  misc_feature (195)..(195): n is a, c, t, g, unknown, or other
  misc_feature (313)..(313): n is a, c, t, g, unknown, or other
ggagctccccgcggtggcggccgctctagaatagtggatcccccgggctgcaggaattcgcacgagaccattacctagaacatcctaatcgaaaacagcaagctcagccccccagccctactgccaccgcgccgaacgccatggccgagccggcagagcaccgtccagcggaggaggagaaggcgcggcggccgncgaggatgaggacaccggccccaggtcgcgccatcgtgaagctgggagaggtcgccgttaccaccggagaggaggacgaggacccgctcctggacatgaaggcgaagctctaccgggntcgaacaggaggggaaccagtgggaaagagccgcggcacaggcactgtggagctgctcaagcacaagacacgggccaggccgcctcgtcatgcgtcaggggaagaccctaagatctgcccaaacatctcgggggggcaacaactaaatgcaaggaccaccggggaagcaacaagtcgtggggggggcacccccttgacttccccgacggcaactcaaaaaagagatggttgctatcccttttggatccggccaaaaattccaagagttccagggcccctggttaaaaaaaaacttgaaaccccaaggaaaggagg

SEQ ID NO: 16880 - protein, 162 aa, Zea mays
  misc_feature: Ceres CLONE 1381308-F
  misc_feature (19)..(19): Xaa is any aa, unknown, or other
  misc_feature (58)..(58): Xaa is any aa, unknown, or other
MAEPAEHRPAEEEKARRPXRMRTPAPGRAIVKLGEVAVTTGEEDEDPLLDMKAKLYRXRTGGEPVGKSRGTGTVELLKHKTRARPPRHASGEDPKICPNISGGQQLNARTTGEATSRGGGTPLTSPTATQKRDGCYPFWIRPKIPRVPGPLVKKKLETPRKG

SEQ ID NO: 16881 - DNA, 689 bp, Zea mays
  misc_feature: Ceres CLONE 1381309-F
  misc_feature: Encodes the peptide sequence at SEQ ID NO. 16882
  misc_feature (230)..(230): n is a, c, t, g, unknown, or other
  misc_feature (252)..(252): n is a, c, t, g, unknown, or other
ggagctccccgcggtggcggccgctctagaactagtggatcccccgggctgcaggaattcgcacgagaccattacctagaacatcctaatcgaaaactcagctgctggcccgctgcctgcagccattgcccgctcctcgaggtcaaatggcccctgcccccgctctcaccgccacatccgtcctgaagcgttcccacctacccggcgtccactcgttggcctgtcgccgncagccgggggcgaccgcgtctncgtgttttctcagcgatcccgcggcccgcgtttcatggcagcaaggatctggagtggttgctagaaggctcctctgggcgagtgcgagtgggtcctcaaaaaagataactcggggaggacggggtggttgcttctcaaaaagcgggggaagaaaaaggtaaattttttgagaattttaaagagggcaactccattatccccatataggggtggggagtacattctccgccggggggcacccgccttcgttaaaggggtccactaccaggaaatatgccccagctttgggggttcttgaggtttggtggggggggaaacccacggggccaaggtttttatttaaaccaaaaaaaagcccaaatggttattcgtgggggtttaaaccggaaggtttggccacaagccctttggttggattccctttttgggccccctgg

SEQ ID NO: 16882 - protein, 88 aa, Zea mays
  misc_feature: Ceres CLONE 1381309-F
  misc_feature (36)..(36): Xaa is any aa, unknown, or other
MAPAPALTATSVLKRSHLPGVHSLACRRQPGATASXCFLSDPAARVSWQQGSGVVARRLLWASASGSSKKITRGGRGGCFSKSGGRKR

SEQ ID NO: 16883 - DNA, 671 bp, Zea mays
  misc_feature: Ceres CLONE 1381311-F
  misc_feature: Encodes the peptide sequence at SEQ ID NO. 16884
  misc_feature (229)..(229): n is a, c, t, g, unknown, or other
  misc_feature (357)..(357): n is a, c, t, g, unknown, or other
  misc_feature (366)..(366): n is a, c, t, g, unknown, or other
  misc_feature (397)..(397): n is a, c, t, g, unknown, or other
  misc_feature (465)..(465): n is a, c, t, g, unknown, or other
  misc_feature (514)..(514): n is a, c, t, g, unknown, or other
ggagctccccgcggtggcggccgctctagaactagtggatcccccgggctgcaggaattcgcacgagaccattacctagaacatcctaatcgaaaaaaacgaaaggactgccctaacctcgtgcagtcgtgcccgcttgtttcccttgctcgccttcacccctcgccgccgccgccgccgtcgccgtcgcaagcgacgatgctcgacatcaacttgttccgcaccgacnagggcggcaacccagaccttattcgcgagtcccagcgcagtcggttcgcctccgtcgagctcgtcgacgaggtcatcgccctcgacaaggcatggcgcgaaaggcagttcgagctggacaagatccgncaggagctncacgctagcagcaagaagatcggcaagctcnaagccagcaagcaagaggaggaagcgaagaggctcatggagagcacagacgaaattaagaaaaggttngcagccaaagaagttgaggtgcaggaggccaagagcaccctcgacgccnaggtcacgacgattggcaacatcgtgcatgagtccgtgccagtcagcgacgacgaggcaacaataaaattgtacggacatttggagagaagagagtagaggatattttgaagaacacgtgaaccttttgaggatgcttgatattgcgcattgggaaa

SEQ ID NO: 16884 - protein, 137 aa, Zea mays
  misc_feature: Ceres CLONE 1381311-F
  misc_feature (1)..(114): Pfam Name: Seryl_tRNA_N Pfam Description: Seryl-tRNA synthetase N-terminal domain
  misc_feature: SWISSPROT Homolog: EC 6.1.1.11 Serine--tRNA ligase
  misc_feature (11)..(11): Xaa is any aa, unknown, or other
  misc_feature (67)..(67): Xaa is any aa, unknown, or other
  misc_feature (89)..(89): Xaa is any aa, unknown, or other
  misc_feature (106)..(106): Xaa is any aa, unknown, or other
MLDINLFRTDXGGNPDLIRESQRSRFASVELVDEVIALDKAWRERQFELDKIRQELHASSKKIGKLXASKQEEEAKRLMESTDEIKKRXAAKEVEVQEAKSTLDAXVTTIGNIVHESVPVSDDEATIKLYGHLERRE

SEQ ID NO: 16885 - DNA, 674 bp, Zea mays
  misc_feature: Ceres CLONE 1381312-F
  misc_feature: Encodes the peptide sequence at SEQ ID NO. 16886
  misc_feature (226)..(226): n is a, c, t, g, unknown, or other
  misc_feature (238)..(238): n is a, c, t, g, unknown, or other
  misc_feature (284)..(284): n is a, c, t, g, unknown, or other
  misc_feature (341)..(341): n is a, c, t, g, unknown, or other
  misc_feature (398)..(398): n is a, c, t, g, unknown, or other
  misc_feature (399)..(399): n is a, c, t, g, unknown, or other
  misc_feature (446)..(446): n is a, c, t, g, unknown, or other
  misc_feature (452)..(452): n is a, c, t, g, unknown, or other
aagctggagctccccgcggtggcggccgctctagaactagtggatcccccgggctgcaggaattcgcacgagaccattacctagaacatcctaatcgaaaaaatactccgtcactttgtttgcaaagctcctcctcgatccatcgatcactgcaccggccggcggcaccgcgctcgcaggggctagccaacgagacggcagcaatggcggaccgtgaccgcagcgncatctacggcgncgcccacgccacctacgggcagcagcagcagcagggaggaaggcgncgcccgatgggtgaacaggtgaagggcatgctccacgacaaggggccgacggcgtcncaagcgctgacggtggtgacgctgttccccctggccgggctgctgctggtgctttcnnggctggcgctgaacgcctcccgtggtggggctggcgtggccacgccngtgttnctgatcttcagccccgtgctcgtcccccgcgcgctgctcatcgggacgggccgtcatggggtccctcacgtcggggcggctgggggctccgggggcctgtcctcgctcacgtgcctcgccaaaaggggggcggagggggttccagcgcaccccggatttatgggaaggaggcccacgcaaaaatggcggaggcccccggccaaacccggccaaaagaaccgg

SEQ ID NO: 16886 - protein, 157 aa, Zea mays
  misc_feature: Ceres CLONE 1381312-F
  misc_feature (44)..(156): Pfam Name: Oleosin Pfam Description: Oleosin
  misc_feature (8)..(8): Xaa is any aa, unknown, or other
  misc_feature (12)..(12): Xaa is any aa, unknown, or other
  misc_feature (66)..(66): Xaa is any aa, unknown, or other
  misc_feature (83)..(83): Xaa is any aa, unknown, or other
MADRDRSXIYGXAHATYGQQQQQGGRRRPMGEQVKGMLHDKGPTASQALTVVTLFPLAGLLLVLSXLALNASRGGAGVATPVXLIFSPVLVPRALLIGTGRHGVPHVGAAGGSGGLSSLTCLAKRGAEGVPAHPGFMGRRPTQKWRRPPAKPGQKNR

SEQ ID NO: 16887 - DNA, 682 bp, Zea mays
  misc_feature: Ceres CLONE 1381313-F
  misc_feature: Translation starting site: 154
  misc_feature (601)..(601): n is a, c, t, g, unknown, or other
  misc_feature (619)..(619): n is a, c, t, g, unknown, or other
ggagctccccgcggtggcggccgctctagaactagtggatcccccgggctgcaggaattcgcacgagaccattacctagaacatcctaatcgaaaaaactagcctctatctcattccactccgacattcacgtgcagctgtcgggagcaggcaatggcgccggatctaagcgaactcgccgccgccgctccagcccgtggcgcctacctcgccggcgtcggtgtcgcggtcctcctcgctgcctccttcctccagtagccgagtcgtcctgcgtgcgagataactcattggtgagagacataagcccaatgccgcaaagcagctatgggattgaaggatggtcacatataacagttgctggggcgctcaatcatgggaggagggaggtggaagtgtggcttcagacaataggtccaggtcagaggacgccaatccacaggcattcctgtgaagaggttttcactggtctcaaaggggagggtacgctcttgatgggatcaggctcactaaagacccagggcagccacaggaattccctttctttcagattaccacattttcatcccctgtaatgatccccaccagggttgggattctgacnagcacgaaaattggcagntcttgtgatcatatccagaccgcctgctaagatatttttatatgaggatgggagcatgcctcc

SEQ ID NO: 16888 - DNA, 713 bp, Zea mays
  misc_feature: Ceres CLONE 1381319-F
  misc_feature (608)..(608): n is a, c, t, g, unknown, or other
ggagctccccgcggtggcggccgctctagaactagtggatcccccgggctgcaggaattcgcacgagaccattacctagaacatcctaatcaaaaaatcgcacatattattgagaccaactagcaacatagaaagcacaatagtgtaccaacaatggcagccaaaatattttgcctccttatgctccttggtctttctgcaagagctgctacagcgaccattttcccgcaatgctcgcaagctcctatagcttcccttcttcccccgtacctctcaccagcggtgtcttcggtatgagaaaacccaattcttcaaccctacaggatccaacaggcaatcacagctggcatcttacctttatcacccttgatcctccaacaatcatcaggcctattacatcagatacctttggtgcatttattggcacaaaacatcagggcacaacaactacaacaacttgtgctagcaaaccttgctgcctactctcagcaacagcagcttcttccattcgaccaactagctgcattgaactctgcttcttatttgcgacagcacgactaccattcagccagctacctgctgcctacccccagcaatttcttccattncaacaactggcagcattgaactctcctgcttatttacagcagcagctactactaccattcagtcagctagctagagtgagccctgctaccttactgatacaacaa

SEQ ID NO: 16889 - DNA, 715 bp, Zea mays
  misc_feature: Ceres CLONE 1381328-F
  misc_feature: Translation starting site: 211
  misc_feature (374)..(374): n is a, c, t, g, unknown, or other
  misc_feature (430)..(430): n is a, c, t, g, unknown, or other
  misc_feature (455)..(455): n is a, c, t, g, unknown, or other
  misc_feature (462)..(462): n is a, c, t, g, unknown, or other
  misc_feature (465)..(465): n is a, c, t, g, unknown, or other
  misc_feature (466)..(466): n is a, c, t, g, unknown, or other
  misc_feature (484)..(484): n is a, c, t, g, unknown, or other
  misc_feature (518)..(518): n is a, c, t, g, unknown, or other
  misc_feature (522)..(522): n is a, c, t, g, unknown, or other
  misc_feature (682)..(682): n is a, c, t, g, unknown, or other
  misc_feature (683)..(683): n is a, c, t, g, unknown, or other
  misc_feature (715)..(715): n is a, c, t, g, unknown, or other
tccccgcggtggcggccgctctagaactagtggatcccccgggctgcaggaattcgcacgagaccattacctagaacatcctaatcgaaaacccactctccctttccactctcaggctcccactccccccctaccggctaccctacccatcacacacaaacagccactcctcacctcccccgtcctccggttcatgtcctgctgctccccatgtcgcccccactcgacctcgactacataggcctctcgccggcggcggctgccgccgctgcccacgacgacctgaagggtaccgagctccgccttggtctgccggggtccggttcgccggaccgccgtgttgtggctgccaccgcaacaccctggacctgctnccggctaagggcgccaagcgcgggttttctgacgaagcgccgacgccatcgcccgntgcagctttccggaaaggaaagaangtagcgnaanngaggagacgacagaaagntgcagcgacgccgcagccggtcgcaaaagctcangtgntgggatggccaccattcgaagctaccgcaagacacgatgtctaccacccagctgaaggcagcaaggaggatgctgaggccagcaggaccaggggtcctgtacgtcaggtcagcatggatggcgcgcctacctcagaaattgacctcagactacaagactnnacagactgtcactgcccttgaaagatgtcagn

SEQ ID NO: 16890 - DNA, 673 bp, Zea mays
  misc_feature: Ceres CLONE 1381329-F
  misc_feature: Encodes the peptide sequence at SEQ ID NO. 16891
  misc_feature (347)..(347): n is a, c, t, g, unknown, or other
ggagctccccgcggtggcggccgctctagaatagtggatcccccgggctgcaggaattcgcacgagaccattacctagaacatcctaatcgaaaaacaaaactccccgtttcccatcgcggccactctccttcgagccgtccgccgctcccacccccaccactcgccagctcgccacttcctcccgtctcctcccttccagaggcggcgcgtaagccccgatggccgcctctctcctccacgccgccgccgcctcgctccagagttccacccagcacgcccgcgcgggcgccgccgcctttcaccccctcgcgtgtgccccatccctacgccttacgcgctcctcgntctcgaccaatcgccacctcgagatttcgctgcgggcgatctcggccagtcgcccgtttcgcggggaggggggcaccccgggaccgccacgtggtcgccgccctagcgggggagcaaaccgagggttcagaggtgggggatgacagaaaacgggagataaaggccgaggaggctcagggaattttggagggatggctggagcagttcaggggcgaggccctgcggatgcaggccctgtcaaatgcagcttatgatgtctactcccagaggacgaagggaggtcttgctgggaccatcaaaagagctgaagatacaggccagacaag

SEQ ID NO: 16891 - protein, 33 aa, Zea mays
  misc_feature: Ceres CLONE 1381329-F
MQALSNAAYDVYSQRTKGGLAGTIKRAEDTGQT

SEQ ID NO: 16892 - DNA, 768 bp, Zea mays
  misc_feature: Ceres CLONE 1381330-F
  misc_feature: Encodes the peptide sequence at SEQ ID NO. 16893
  misc_feature (617)..(617): n is a, c, t, g, unknown, or other
aaggtggagctccccgcggtggcggccgctctagaactagtggatcccccgggctgcaggaattcgcacgagaccattacctagaacatcctaatcgaaaaaccaccgcatcccacaacccccgagctcaggttagctccactccagctccaatcgcagtcgtgaccagaagcgcgagagctagctagagggccgtgaaaatgccgatcaataggatcgccctggggagccaccaggaggggtaccacccgggcgccctcaagggggcgttcggtgatttcatctccaccttcctcttcgtcttccccggcccaggggtccggcatggcctttccccaagctgaccggggggcggcccaacgaacccggagggccccgaatcgggggggggggggggcgcccgcagttcacgctggttcgggggcggtgtcctggggagaaccaaacatcccccggcggggcccagggacccctggccgcgcgcccctccgcggcccttccgggcggcggcaaagtccccccccgggtccgggggccctcctgaaattggcctagccctcaccctgctcggagggcccccgggggggggctcttcgcccccccatcccccaaagaangatccccgcccagcgcccccctgcggtccgaaagcagtcgagcgggcgggaaggggcctggggcccctaggaaacccaaacccctccgagcggggcggaaaacggctgccccccccccgctcgccaccccaaaaaaggcacccaggcgccc

SEQ ID NO: 16893 - protein, 47 aa, Zea mays
  misc_feature: Ceres CLONE 1381330-F
MPINRIALGSHQEGYHPGALKGAFGDFISTFLFVFPGPGVRHGLSPS

SEQ ID NO: 16894 - DNA, 713 bp, Zea mays
  misc_feature: Ceres CLONE 1381334-F
  misc_feature (244)..(244): n is a, c, t, g, unknown, or other
  misc_feature (273)..(273): n is a, c, t, g, unknown, or other
  misc_feature (275)..(275): n is a, c, t, g, unknown, or other
  misc_feature (280)..(280): n is a, c, t, g, unknown, or other
  misc_feature (283)..(283): n is a, c, t, g, unknown, or other
  misc_feature (284)..(284): n is a, c, t, g, unknown, or other
  misc_feature (290)..(290): n is a, c, t, g, unknown, or other
  misc_feature (294)..(294): n is a, c, t, g, unknown, or other
  misc_feature (296)..(296): n is a, c, t, g, unknown, or other
  misc_feature (297)..(297): n is a, c, t, g, unknown, or other
  misc_feature (305)..(305): n is a, c, t, g, unknown, or other
  misc_feature (335)..(335): n is a, c, t, g, unknown, or other
  misc_feature (337)..(337): n is a, c, t, g, unknown, or other
  misc_feature (338)..(338): n is a, c, t, g, unknown, or other
  misc_feature (349)..(349): n is a, c, t, g, unknown, or other
  misc_feature (380)..(380): n is a, c, t, g, unknown, or other
  misc_feature (426)..(426): n is a, c, t, g, unknown, or other
  misc_feature (427)..(427): n is a, c, t, g, unknown, or other
aagctggagctcaccgcggtggcggccgctctagaatagtggatcccccgggctgcaggaattcgcacgagaccattacctagaacatcctaatcgaaaagttatcccccacccggacaatcttccttcaggcttcagctgtccgcccgcggcccacccctccgccgtctccaccattccgccgttcccaccacgccactcgccagttcggcactccctcctgtctccccccccttgcgagacngcgcggacgccccgtcgcccacccgatgncntgcantcnntctcangcgncnnacgctcgntcagagctcctccagcccgcacgcgcgggngnncgcacgctttncacccctcgggtcaccccaatcatacgcttngggcgctcctcgtctcgtcaaatcgcggctcaaggttcctcccggnnggtttcggcgtcattggttccggggagggaaaacccggggccccgggtttccccgcctaaagggaaaaatggaggtccaaaggggcaatgacaggataaccccccgggaaaaaaccccggagagcccaaaaatttgaaaaaagtgggaaaaaataaggggaagcgccccggagcgccccccgtaatggggaaataattcccccccaagggggggggggggtttttggagcccttcaaaaaaaaaaaaagggggaaaaaaaaaaaagccctcgggggggttttcata

SEQ ID NO: 16895 - DNA, 737 bp, Zea mays
  misc_feature: Ceres CLONE 1381336-F
  misc_feature: Translation starting site: 395
  misc_feature: SWISSPROT Homolog: EC 3.4.21.92 Endopeptidase Clp
  misc_feature (569)..(569): n is a, c, t, g, unknown, or other
  misc_feature (570)..(570): n is a, c, t, g, unknown, or other
  misc_feature (576)..(576): n is a, c, t, g, unknown, or other
aagctggagctccccgcggtggcggccgctctagaactagtggatcccccgggctgcaggaattcgcacgagaccattacctagaacatcctaatcgaaaaagattagtcacactcttcgcaagcacacaaaaaaaaaaaacccccaaatagcgtaaggataagcctcgccggcgacgaaatcagggtttcatcgaacaagaagatggctcacgcttgcgtctccacatcagcttcctctctcaggtttacagccggattcgtctccgcgagtcccaacgcctcctctttcgattctcagaagctttccctccctttcgagcctcttcgttcaagaaagacgaagaagttggttagcggcagaaagacggctccgaaggctgtatactccggcaatgtctggactccggagactccttcgcctcaaggagtttggtccatcagagatgatttacaagtcccttcttcgccgtattttcctgtgtacgctcaaggacaaggaccacctcctatggtgcaagagcgtttccagagtatcataagccagctcttccatataggatttatccnntggggntggtggctggtggatgatgatatgggcaacataatcgtagctcagcttctttacctcgaatgctggtgatctacctaaggatattggttatgtatgtgactctcccggggggatcaagtaaacagctggtatggctatattcgatactatggagaattccc

SEQ ID NO: 16896 - DNA, 681 bp, Zea mays
  misc_feature: Ceres CLONE 1381339-F
  misc_feature: Encodes the peptide sequence at SEQ ID NO. 16897
  misc_feature (301)..(301): n is a, c, t, g, unknown, or other
  misc_feature (530)..(530): n is a, c, t, g, unknown, or other
  misc_feature (617)..(617): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggngggctagctagctgagctcgtgcgacgaagaatggcccggaattgcaagaacatgccgccgccgctcctggtgctcaacctcatcatgtacatcatcgtcatcggcttcgcgagctggaacctgaaccacttcatcaacggggcagaccaactaccccggcgtggccggcaacggcgcgacgttctacttcctgtgttcgccatcctggccggcgtggtgggcgcggcntccagctggcgggcgtgcaccagtgcgcgctggcgccacgacagctggccaccaacgcccgtcgtcgctcatcgctgggccatcacngggttcgccttcgggtggcctgaaagaaatccacatcggggaccggcggtggcgcctgcgcggg

SEQ ID NO: 16897 - protein, 116 aa, Zea mays
  misc_feature: Ceres CLONE 1381339-F
  misc_feature (14)..(116): Pfam Name: AWPM-19 Pfam Description: AWPM-19-like family
MARNCKNMPPPLLVLNLIMYIIVIGFASWNLNHFINGADQLPRRGRQRRDVLLPVFAILAGVVGAASSWRACTSARWRHDSWPPTPVVAHRWAITGFAFGWPERNPHRGPAVAPAR

SEQ ID NO: 16898 - DNA, 730 bp, Zea mays
  misc_feature: Ceres CLONE 1381340-F
  misc_feature: Translation starting site: 232
  misc_feature (584)..(584): n is a, c, t, g, unknown, or other
  misc_feature (635)..(635): n is a, c, t, g, unknown, or other
  misc_feature (636)..(636): n is a, c, t, g, unknown, or other
  misc_feature (648)..(648): n is a, c, t, g, unknown, or other
  misc_feature (662)..(662): n is a, c, t, g, unknown, or other
  misc_feature (663)..(663): n is a, c, t, g, unknown, or other
aagctggagctccccgcggtggcggccgctctagaactagtggatcccccgggctgcaggaattcgcacgagaccattacctagaacatcctaatcgaaaaatttatacccctccgtttcccacccttacctccccactccggcagtccccgtcccaccactacagccactgctgcccggccggccgcgtccctcttcctccgccaggcgccagccgcccgctctccagcaatggcgtctgcctcgcacgccccgacgccgctgctcaaggacgagctggacatcgtcatcccgacgatccgcaacctcgacttcctggagatgtggaggcccttcttccagccctaccacctcatcatcgtgcaggacggcgaccccagcaagaccatccgcgtccccgagggcttcgactacgagctctacaaccgcaacgacatcaaccgcatgctggggcccaaggcatcctgcatctccttcaaggactccccgctgcgctgcttcggctacatggtctccaagaagagtacatctacaccatcgacgatgactgcttcgtttgccaggatccatcagggaaggacatncatgcacttgagcagcacatcaagaacctcctgagcccttccactcatttnntctcatactctngatgacccttaccnngtgtgcgccgatttttgtcgtggtacccttcagccttcgtggggtgtccaactgctgttcccacggc

SEQ ID NO: 16899 - DNA, 737 bp, Zea mays
  misc_feature: Ceres CLONE 1381342-F
  misc_feature: Encodes the peptide sequence at SEQ ID NO. 16900
  misc_feature (436)..(436): n is a, c, t, g, unknown, or other
  misc_feature (485)..(485): n is a, c, t, g, unknown, or other
  misc_feature (546)..(546): n is a, c, t, g, unknown, or other
  misc_feature (658)..(658): n is a, c, t, g, unknown, or other
  misc_feature (702)..(702): n is a, c, t, g, unknown, or other
ggagctccccgcggtggcggccgctctagaactagtggatcccccgggctgcaggaattcgcacgagaccattacctagaacatcctaatcgaaaaatcgtcatcgcaaaatgcaggctctcctgctccccgcgcgggccgcgccgccgacgccggcgatgcttcggcagcgtgcggtttctgcctccgcgtgtgcgtcgcaggtctgccgccccctattcggtgccgccaattgcatctcctgtggggtctacggaagcgttcggcggcacctcacagtggcggtggcggcggccccgccctcgccttcgtcctcaccttcgtcgggaccgctctacccgacgcctccacccaccgagcaggaggtggagagggtcaagctcgagcaggttatgaggagactagagaaaacagcaaggtatttcaagaatttggntaccctgggggttctggtcccaattggtgtgcacaattatttctgctgnaattttggcattctctacagttgtaaaacgggaaggtgacatcaccctttacattctatgncactgctgctggtattgctgctgcttttatttcagtcttctggtcatttggttacatccgtctctctgaaaggctagaaaacatccaagaaactgctagggctctcaaccgntgctgatggttgtagagccttaaaatggcatcgtgggtataatnctggggatgggcgctgctgtctcgcatgcaagctt

SEQ ID NO: 16900 - protein, 137 aa, Zea mays
  misc_feature: Ceres CLONE 1381342-F
  misc_feature (109)..(109): Xaa is any aa, unknown, or other
  misc_feature (125)..(125): Xaa is any aa, unknown, or other
MQALLLPARAAPPTPAMLRQRAVSASACASQVCRPLFGAANCISCGVYGSVRRHLTVAVAAAPPSPSSSPSSGPLYPTPPPTEQEVERVKLEQVMRRLEKTARYFKNLXTLGVLVPIGVHNYFCXNFGILYSCKTGR

SEQ ID NO: 16901 - DNA, 720 bp, Zea mays
  misc_feature: Ceres CLONE 1381343-F
  misc_feature: Encodes the peptide sequence at SEQ ID NO. 16902
  misc_feature (597)..(597): n is a, c, t, g, unknown, or other
aagctggagctccccgcggtggcggccgctctagaactagtggatcccccgggctgcaggaattcgcacgagaccattacctagaacatcctaatcgaaaaaaaaaaccctagctagcgccgccgccgctgcagactcctccttttcgatcccttcacaaagcgccgccgtcgccccatcgaacatggctccgaagaaggataaggccccgcccccgtcgtcgaagcccgccaagtccggcggtggcaagcagaagaagaagaagtggagcaagggaaagctaaaggagaaggtgaacaacgcggtgctgttcgaccaggctacctacgacaagctgctctctgaggtgcccaagtacaagcagatcaccccctccatcctatccgagcgcctcaggatcaatggctccctggctcggagggctatcaaggacctgatggcgcgtggcctcatccggtttggtctcggttcactcaagccagcagatctacaccagggcaacaatacctaaggatgggattcccttgtttgccctctctgtaggagctcgtctcttttagacagttgccatctctgtcagagttgctatgctatggntagatgaggttctccgtggctgaacgttttcaaaagtttggggggtaagtttggcttgctataatacttatcggggcttagctttttctatgaatctgcttgaaaaggggcggacccgggatt

SEQ ID NO: 16902 - protein, 108 aa, Zea mays
  misc_feature: Ceres CLONE 1381343-F
  misc_feature (1)..(108): Pfam Name: Ribosomal_S25 Pfam Description: S25 ribosomal protein
MAPKKDKAPPPSSKPAKSGGGKQKKKKWSKGKLKEKVNNAVLFDQATYDKLLSEVPKYKQITPSILSERLRINGSLARRAIKDLMARGLIRFGLGSLKPADLHQGNNT

SEQ ID NO: 16903 - DNA, 712 bp, Zea mays
  misc_feature: Ceres CLONE 1381345-F
  misc_feature: Encodes the peptide sequence at SEQ ID NO. 16904
  misc_feature (576)..(576): n is a, c, t, g, unknown, or other
  misc_feature (650)..(650): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatgggcaagtgcctggagataagaccgcgggacatcacgatgatgccttcagcaccttctttcagcagactggtgctgggaaagcacgtccccgtgcaatctttcgtgatctaaaacccactgtgatcgatgaggtgcgcactggcacgtacccgcagctcttcccacctgagcagctcatcagtggcaaggaggatgccgctaacattttcgcccgtggncactacacatttggcaagggagattgttgatctgtgccttgaccgtatcccgcagcttgctgacactgcacggncctccagggcttcctggtctcaaaggccgtggggggggcactggctctggccttggtccccc

SEQ ID NO: 16904 - protein, 115 aa, Zea mays
  misc_feature: Ceres CLONE 1381345-F
MRECISVHIGQAGIQVGNACWELYCLEHGIQPDGQVPGDKTAGHHDDAFSTFFQQTGAGKARPRAIFRDLKPTVIDEVRTGTYPQLFPPEQLISGKEDAANIFARGHYTFGKGDC

SEQ ID NO: 16905 - DNA, 754 bp, Zea mays
  misc_feature: Ceres CLONE 1381350-F
  misc_feature: Encodes the peptide sequence at SEQ ID NO. 16906
  misc_feature (360)..(360): n is a, c, t, g, unknown, or other
  misc_feature (382)..(382): n is a, c, t, g, unknown, or other
  misc_feature (436)..(436): n is a, c, t, g, unknown, or other
acccgcggtggcggccgctctagaactagtggatcccccgggctgcaggaattcgcacgagaccattacctagaacatcctaatcgaaaagagaactccatttcgatctcatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgggtcagtatgacactgtgcacggacagtgaaagcaccatggagtcaaggtgaaggactccnagaccctttctcttggtgaaanggaggttgctgtgtttggctgcaggaacccctgagagatcccatgggggtcggntgggcgttgataatggtgttgagccaaactgtggttttccctgaccaggaagagggctgcagttcatttaagggggggggccaaaaaaggttggcatttcttgcccttaaaaaggatgccccctttttttttttgttggggcccaccaaaagggaacaaaagctgaaacaacattttgccctaaagggggggttggaaaaaaatgggcttgtcccctttgtaaaggacaaaaaagaaaaaattctttattttttgggggggtttgaaaaacccctgtttctcccccccctgtcccacacaaaaaaggtgtggggggcc

SEQ ID NO: 16906 - protein, 55 aa, Zea mays
  misc_feature: Ceres CLONE 1381350-F
  misc_feature (4)..(56): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MAKIKIGINGFGRIGRLVARVALQSDDVELVAVNDPFISTDYMTYMGQYDTVHGQ

SEQ ID NO: 16907 - DNA, 652 bp, Zea mays
  misc_feature: Ceres CLONE 1381353-F
  misc_feature (601)..(601): n is a, c, t, g, unknown, or other
  misc_feature (602)..(602): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (630)..(630): n is a, c, t, g, unknown, or other
ggagctccccgcggtggcggccgctctagaactagtggatcccccgggctgcaggaattcgcacgagaccattacctagaacatcctaatcgaaaaattttcgactttcgagcgcagaaacgagagggccggagcagccgcagtcccggcgatcccgccgccggtcgccctcatacttcctcgtcactgccttcgtttctctttcaacaatcaagatgagccgtggcggtagcgcgggtggtggtcaagttctctggggtacctctttggaagcgtgagccccccaaacagcagtggcacagctgtaagtgctccacctgctgctgcaggtgctccacctgctgagaaaccacctgctgcaaagcctgatggcaccagtcaaattgctgctgggggtaccagcccaaccaataaactaccccggggccgacgttcaaaaaaccggaatcttccttttaggaacggtcctttcaaaaaaggggacccctttttttctgggggggggtgttcttctcccccgggaaaaaaagggtgtgggggggggaaaaaaaattgtagcccccccccgccacaacaaattttttttccctccccccccccnnggggggggggggggggnnngggcgaggngggttttttgtgtttaatataa

SEQ ID NO: 16908 - DNA, 704 bp, Zea mays
  misc_feature: Ceres CLONE 1381355-F
  misc_feature: Encodes the peptide sequence at SEQ ID NO. 16909
  misc_feature (398)..(398): n is a, c, t, g, unknown, or other
  misc_feature (500)..(500): n is a, c, t, g, unknown, or other
  misc_feature (562)..(562): n is a, c, t, g, unknown, or other
  misc_feature (563)..(563): n is a, c, t, g, unknown, or other
  misc_feature (565)..(565): n is a, c, t, g, unknown, or other
aagctggagctccccgcggtggcggccgctctagaactagtggatcccccgggctgcaggaattcgcacgagaccattacctagaacatcctaatcgaaaactctcgcgccgccacttccctcccgacccactatcccaaaaccgtagcgccctcgcctgctcgccgccgccgtcgttgcgaactccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggcccngcagatcaggagctcacgtctgtcgtccagaaagagggtcacttccccgagaaacgcgtcgagctctacgcccgagaaggtcgtcaaccggcggcctctgcngcatcgcggaggctgagtccctccgctacaagctcctcgaaggcttgcccgtccggagggcnngntaatggggtcttccctttggaatgggaagggggggccaggggtttggaagccctttgggaggggaaagcttcagcctcaaaagcaaaacccatgaagattcagggagggtaatggattccttcggggcgccccgggaaa

SEQ ID NO: 16909 - protein, 156 aa, Zea mays
  misc_feature: Ceres CLONE 1381355-F
  misc_feature (119)..(119): Xaa is any aa, unknown, or other
  misc_feature (120)..(120): Xaa is any aa, unknown, or other
MATQISKKKKFVSDGVFYAELNEMLTRELAEDGYSGVEVRVTPMRTEIIIRATRTQNVLGEKGPADQELTSVVQKEGHFPEKRVELYAREGRQPAASAASRRLSPSATSSSKACPSGGXXNGVFPLEWEGGARGLEALWEGKASASKAKPMKIQGG

SEQ ID NO: 16910 - DNA, 699 bp, Zea mays
  misc_feature: Ceres CLONE 1381356-F
  misc_feature: Encodes the peptide sequence at SEQ ID NO. 16911
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (668)..(668): n is a, c, t, g, unknown, or other
  misc_feature (669)..(669): n is a, c, t, g, unknown, or other
gctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgtctaacttccctgtgtcccatccggcccnnnntgggggggggcgcggcgtcaaaatttggcggggggtgcaccacgtgcgcgcctggcgccacgacagcctgccaccaaacgccgggtcgtggctcatcgcctgggccatcacgcggctcgcccttcgggtggccccggaaggagatccacatcggggaaaaccgcggtgggnnccggggcccgggttggaggccttctcatca

SEQ ID NO: 16911 - protein, 128 aa, Zea mays
  misc_feature: Ceres CLONE 1381356-F
  misc_feature (14)..(128): Pfam Name: AWPM-19 Pfam Description: AWPM-19-like family
  misc_feature (60)..(60): Xaa is any aa, unknown, or other
  misc_feature (61)..(61): Xaa is any aa, unknown, or other
  misc_feature (118)..(118): Xaa is any aa, unknown, or other
MAGIGRNMVAPLLVLNLIMYIIVIGFASWNLNHFINGQTNYPGVAGNGATSNFPVSHPAXXGGGRGVKIWRGVHHVRAWRHDSLPPNAGSWLIAWAITRLALRVAPEGDPHRGKPRWXPGPGLEAFSS

SEQ ID NO: 16912 - DNA, 717 bp, Zea mays
  misc_feature: Ceres CLONE 1381358-F
  misc_feature: Encodes the peptide sequence at SEQ ID NO. 16913
  misc_feature (450)..(450): n is a, c, t, g, unknown, or other
  misc_feature (486)..(486): n is a, c, t, g, unknown, or other
ggagctccccgcggtggcggccgctctagaactagtggatcccccgggctgcaggaattcgcacgagaccattacctagaacatcctaatcgaaaacacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccgccctcccttcgcacgcgtcgacggcggtggacgagccggcgaagtataagcccagcagagcgccagcgccgtcccctgcatctgcatcatcctacgtccccgcccgcggtccagcccgtgatcgtcgtccagggcgtcatctactgcaagtcctgcaagctcaggggctancacagcggcatggacgcgtcccctcctcccaatgcnacgggaaagctggtgtgctacggcgacccggaaagcaagtaccgggtggtggaaccaaacgagaccgcccccgaaccgaaaggttaattcatcggggaggggggaccacggggggaattgttcacccgcccaaagtgggggttggccctccgttcccccccgaaaggggttttggggcgggccttttttccgaaaaaccacaagggtggctccccccgggggggggccggg

SEQ ID NO: 16913 - protein, 37 aa, Zea mays
  misc_feature: Ceres CLONE 1381358-F
MDASPPPNATGKLVCYGDPESKYRVVEPNETAPEPKG

SEQ ID NO: 16914 - DNA, 756 bp, Zea mays
  misc_feature: Ceres CLONE 1381359-F
  misc_feature: Encodes the peptide sequence at SEQ ID NO. 16915
  misc_feature (459)..(459): n is a, c, t, g, unknown, or other
  misc_feature (495)..(495): n is a, c, t, g, unknown, or other
  misc_feature (496)..(496): n is a, c, t, g, unknown, or other
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctgtgaaccacgnagtgccggaggagctgatgggcgcatgcctccgcgnngtgcgcagtaaaggacccccccccggggggggggaaaaaaaaaacagccctttctacttggggggacctcgttcggaaactgggttttcgcctccaacttcgaccttcttcaaggttgctgggcggcgaatggcgcgaacgctcttttgggggaggtggctccgaaaccgccgcccgggggaaggactgccgcaccactcaggaacgtggatgctgaagtaccgcggcgcggtgagaaaaattgggcggggttcgtgttc

SEQ ID NO: 16915 - protein, 101 aa, Zea mays
  misc_feature: Ceres CLONE 1381359-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWL

SEQ ID NO: 16916 - DNA, 685 bp, Zea mays
  misc_feature: Ceres CLONE 1381363-F
  misc_feature: Encodes the peptide sequence at SEQ ID NO. 16917
tccccgcggtggcggccgctctagaactagtggatcccccgggctgcaggaattcgcacgagaccattacctagaacatcctaatcgaaaagcattttggctcctcactgccgcgccgccaccccctacaggtaaggaagaggagggcaggatgtcacaccgtaggttcgagcacccgagggacggctccctcggcttccttcccaggaagcgctcctcccgtcgccgcggaaaggtgaagtcattccctagggatgaccccaagaagccttgccatctcactgccttccttggctacaaggctggcatgactcacattgtccgtgaggttgagaagccaggatccaaactccataagaaggaacttgtgaggctgttaccatcatagagacccctccctctgtcgatgtggggctcgtgacatatgtgaaactcctcgaggactcgcacactcaactctgttggggccaacctctaaaggacaagtgagggcaaggttctaccagactgggtgcaagacaaaaataaagtttcacaaaatatgccttcaaaaaaaaaaggggggggaaaaaagaaattccttgcccttgaaaaaaaaaaaaaataacctggggttcccggggcgggcccaacccaaaaaaaaaaaaaaggggtttaagaaaaaaaagcccccctggggaaaaaa

SEQ ID NO: 16917 - protein, 78 aa, Zea mays
  misc_feature: Ceres CLONE 1381363-F
MSHRRFEHPRDGSLGFLPRKRSSRRRGKVKSFPRDDPKKPCHLTAFLGYKAGMTHIVREVEKPGSKLHKKELVRLLPS

SEQ ID NO: 16918 - DNA, 717 bp, Zea mays
  misc_feature: Ceres CLONE 1381365-F
  misc_feature: Encodes the peptide sequence at SEQ ID NO. 16919
  misc_feature (451)..(451): n is a, c, t, g, unknown, or other
  misc_feature (555)..(555): n is a, c, t, g, unknown, or other
  misc_feature (572)..(572): n is a, c, t, g, unknown, or other
  misc_feature (622)..(622): n is a, c, t, g, unknown, or other
  misc_feature (695)..(695): n is a, c, t, g, unknown, or other
tccccgcggtggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgccggtcaagaccaacacgatcgtgaagccccagcctttgcaggctgcaagcattccaggactccttgggatttttcagaacgagtgggatgctctcatgctttctaattttgctttgnagcagcagcttcacacagcaagacaagaacttagtcatgcactctaccagcatgacgctgcctggccgtgtatagccagattaaagaaggaaaagatgacgctngagcacttttggctcangctgagagacagattcctgcgtcagttgcaggagctgctcctgcagctgntgtttccatggaaaaagagtattgaagaggaattggcctgaacggaaagaagatccgtctggtatcaccctgncatgattgatgaacttacggaa

SEQ ID NO: 16919 - protein, 114 aa, Zea mays
  misc_feature: Ceres CLONE 1381365-F
  misc_feature (18)..(87): Pfam Name: Prp19 Pfam Description: Prp19/Pso4-like
  misc_feature (45)..(45): Xaa is any aa, unknown, or other
  misc_feature (85)..(85): Xaa is any aa, unknown, or other
  misc_feature (102)..(102): Xaa is any aa, unknown, or other
MDDIVPVKTNTIVKPQPLQAASIPGLLGIFQNEWDALMLSNFALXQQLHTARQELSHALYQHDAAWPCIARLKKEKMTLEHFWLXLRDRFLRQLQELLLQLXFPWKKSIEEELA

SEQ ID NO: 16920 - DNA, 699 bp, Zea mays
  misc_feature: Ceres CLONE 1381368-F
  misc_feature: Encodes the peptide sequence at SEQ ID NO. 16921
  misc_feature (175)..(175): n is a, c, t, g, unknown, or other
  misc_feature (228)..(228): n is a, c, t, g, unknown, or other
  misc_feature (229)..(229): n is a, c, t, g, unknown, or other
  misc_feature (319)..(319): n is a, c, t, g, unknown, or other
  misc_feature (362)..(362): n is a, c, t, g, unknown, or other
  misc_feature (378)..(378): n is a, c, t, g, unknown, or other
  misc_feature (484)..(484): n is a, c, t, g, unknown, or other
  misc_feature (493)..(493): n is a, c, t, g, unknown, or other
  misc_feature (536)..(536): n is a, c, t, g, unknown, or other
  misc_feature (586)..(586): n is a, c, t, g, unknown, or other
  misc_feature (605)..(605): n is a, c, t, g, unknown, or other
  misc_feature (606)..(606): n is a, c, t, g, unknown, or other
ggagctccccgcggtggcggccgctctagaatagtggatcccccgggctgcaggaattcgcacgagaccattacctagaacatcctaatcgaaaaacctaggtcattcggtcattccacttccaccaatctgtctcccaatctttcttgctgctccaattcgctctctttactcnggccagcggaaggggagaggagggcgagatgacggtggagaaggtggacgcgnngctttccgacttcgacgcccacttcgatcgcctcttcgctttcccggacgccgcctcccgacgcaaggtgaagctgctgctcttcctggnccgacgcaaagctggctcctccctctcctggtgccccgactgncacgtggcggagccgntgatctacgagcggctggaggcactggagggcaaggacgcggtgctcctgcgcgcctacgtcgggacaagcccacttggcgcgaccccggcgcacccgtggaggtnggaccccanggtcgggctcagggcgtgccaacgctgatccggctggaagatngcgccgccgccgccgccctcgggacgacgaggcgacctcaaggacaaggntgacgccctctctgcctgnnggaactgatactgaaagatttgttttcccgttcggttcattttggggagagggcaaatacatgaacttggaaatcagtcatccaactgcgaca

SEQ ID NO: 16921 - protein, 105 aa, Zea mays
  misc_feature: Ceres CLONE 1381368-F
  misc_feature (9)..(9): Xaa is any aa, unknown, or other
  misc_feature (39)..(39): Xaa is any aa, unknown, or other
  misc_feature (53)..(53): Xaa is any aa, unknown, or other
  misc_feature (59)..(59): Xaa is any aa, unknown, or other
  misc_feature (94)..(94): Xaa is any aa, unknown, or other
  misc_feature (97)..(97): Xaa is any aa, unknown, or other
MTVEKVDAXLSDFDAHFDRLFAFPDAASRRKVKLLLFLXRRKAGSSLSWCPDXHVAEPXIYERLEALEGKDAVLLRAYVGTSPLGATPAHPWRXDPXVGLRACQR

SEQ ID NO: 16922 - DNA, 695 bp, Zea mays
  misc_feature: Ceres CLONE 1381369-F
  misc_feature: Encodes the peptide sequence at SEQ ID NO. 16923
  misc_feature (307)..(307): n is a, c, t, g, unknown, or other
  misc_feature (377)..(377): n is a, c, t, g, unknown, or other
  misc_feature (414)..(414): n is a, c, t, g, unknown, or other
  misc_feature (415)..(415): n is a, c, t, g, unknown, or other
  misc_feature (491)..(491): n is a, c, t, g, unknown, or other
  misc_feature (565)..(565): n is a, c, t, g, unknown, or other
  misc_feature (590)..(590): n is a, c, t, g, unknown, or other
  misc_feature (641)..(641): n is a, c, t, g, unknown, or other
ggagctccccgcggtggcggccgctctagaactagtggatcccccgggctgcaggaattcgcacgagaccattacctagaacatcctaatcgaaaactctatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcggnctgtacccctacgcggagtacctgaggcagccgcagtgcagcccgctggcggcggcgccctactacgccnggtgtgggcagccgagcgccatggtccagccgctccnngcacagtgctgccagcagcagatgaggatgatggacgtgcagtccgtcgcgcagcagctgcagatgatgatgcagncttgagcgtgccgctgcccgcagcagcagcctgtacgagccagctctgatgcagcagcagcagcagctgctggncagcccagggtctcacccccatggncatgatggatggcgcaaaacatcccgggcccaggggtggactctaccagtnacagttgccccagttacgcacaacccccctggggggtctccgttgccattccgc

SEQ ID NO: 16923 - protein, 109 aa, Zea mays
  misc_feature: Ceres CLONE 1381369-F
  misc_feature (72)..(72): Xaa is any aa, unknown, or other
  misc_feature (84)..(84): Xaa is any aa, unknown, or other
MKMVIVLVVCLALSAASASAMQMPCPCAGLQGLYGAGAGLTTMMGAGGLYPYAEYLRQPQCSPLAAAPYYAXCGQPSAMVQPLXAQCCQQQMRMMDVQSVAQQLQMMMQ

SEQ ID NO: 16924 - DNA, 714 bp, Zea mays
  misc_feature: Ceres CLONE 1381372-F
  misc_feature: Encodes the peptide sequence at SEQ ID NO. 16925
  misc_feature (314)..(314): n is a, c, t, g, unknown, or other
  misc_feature (387)..(387): n is a, c, t, g, unknown, or other
  misc_feature (409)..(409): n is a, c, t, g, unknown, or other
  misc_feature (410)..(410): n is a, c, t, g, unknown, or other
  misc_feature (519)..(519): n is a, c, t, g, unknown, or other
  misc_feature (531)..(531): n is a, c, t, g, unknown, or other
ggagctccccgcggtggcggccgctctagaactagtggatcccccgggctgcaggaattcgcacgagaccattacctagaacatcctaatcgaaaaaatcgatgagatttatcttgggatcggctagagaagatcgagtgagaagttgcgcgtgtgaagccatcacaccaattaaagatcatccatggctacttctctacttcagcagctgctgtctctgctgctgctcctgctgccctcacctcttcgtctccgggagcatctatcagggaaacatgctgtcagcgccaacaacttccaccccatctttctgntagctggggtgagctgcagcgacctggaggcacgcctcacccgagcgtaccggccgtcggtgccgcactgcgncgccatgaaggagagggggtgnnttcgtctgtggaagaaacagtcggagctgctgtctcatgactacgcgcagtgcttcgaggagcagatgagcctcgtctacgaccctggcatcaacgagtaccggaaccntcgccggcgtcnaagacgcgagtgcccaactttcgctccacaagagccttcaggcacagaaccctctcaggtcagactggtgcttcggaaagctgagagctgcactggaagaatgggaatacgagacggaaaccccttgttcggagcccctacactccgtttagcgccgcgccccccgcaaaaaaatttggaggg

SEQ ID NO: 16925 - protein, 176 aa, Zea mays
  misc_feature: Ceres CLONE 1381372-F
  misc_feature (44)..(44): Xaa is any aa, unknown, or other
  misc_feature (68)..(68): Xaa is any aa, unknown, or other
  misc_feature (75)..(75): Xaa is any aa, unknown, or other
  misc_feature (76)..(76): Xaa is any aa, unknown, or other
  misc_feature (112)..(112): Xaa is any aa, unknown, or other
  misc_feature (116)..(116): Xaa is any aa, unknown, or other
MATSLLQQLLSLLLLLLPSPLRLREHLSGKHAVSANNFHPIFLXAGVSCSDLEARLTRAYRPSVPHCXAMKERGXXRLWKKQSELLSHDYAQCFEEQMSLVYDPGINEYRNXRRRXRRECPTFAPQEPSGTEPSQVRLVLRKAESCTGRMGIRDGNPLFGAPTLRLAPRPPQKNLE

SEQ ID NO: 16926 - DNA, 715 bp, Zea mays
  misc_feature: Ceres CLONE 1381373-F
  misc_feature: Encodes the peptide sequence at SEQ ID NO. 16927
  misc_feature (433)..(433): n is a, c, t, g, unknown, or other
  misc_feature (463)..(463): n is a, c, t, g, unknown, or other
  misc_feature (541)..(541): n is a, c, t, g, unknown, or other
  misc_feature (589)..(589): n is a, c, t, g, unknown, or other
tggagctccccgcggtggcggccgctctagaactagtggatcccccgggctgcaggaattcgcacgagaccattacctagaacatcctaatcgaaaaccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgccttccccctcctcttctacccgggccaccgctgctcccggtccctgctgccgctttgacgcgctgcggagggcgtgcgncaggcacgccgccgacgccgcgcgagccgncgggtgggcgctcggcgcgctgctcacctgcgtcttcgccgtcgtgggctcactcgtcggaatcttcatgggtgcttncatggggatgtctacagaaaagcgcatggtccgcggggctggtgtcgnaacagtctcgggagcagtcttctccattggggtggtgagccctgcatcgagatttggagggccaggcctttcgggaaaaacagcattctctatgtgctggaaattctctctaagctcttcagggga

SEQ ID NO: 16927 - protein, 124 aa, Zea mays
  misc_feature: Ceres CLONE 1381373-F
  misc_feature (31)..(31): Xaa is any aa, unknown, or other
  misc_feature (41)..(41): Xaa is any aa, unknown, or other
  misc_feature (67)..(67): Xaa is any aa, unknown, or other
  misc_feature (83)..(83): Xaa is any aa, unknown, or other
MDSVPSPSSSTRATAAPGPCCRFDALRRACXRHAADAARAXGWALGALLTCVFAVVGSLVGIFMGAXMGMSTEKRMVRGAGVXTVSGAVFSIGVVSPASRFGGPGLSGKTAFSMCWKFSLSSSG

SEQ ID NO: 16928 - DNA, 704 bp, Zea mays
  misc_feature: Ceres CLONE 1381374-F
  misc_feature (548)..(548): n is a, c, t, g, unknown, or other
  misc_feature (549)..(549): n is a, c, t, g, unknown, or other
  misc_feature (609)..(609): n is a, c, t, g, unknown, or other
  misc_feature (610)..(610): n is a, c, t, g, unknown, or other
  misc_feature (613)..(613): n is a, c, t, g, unknown, or other
  misc_feature (637)..(637): n is a, c, t, g, unknown, or other
ggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtcgcgtcaaatagcaggtcaccagctctgcgatttgnngctagggacagcgatgcgcagtgcattggtcacgggaagctcttatcttccatggcacgnnccntgagatgtcagaatttgggaaaantcctcgtggaagcgataaaaaaaatgtggagccccaacaagggagcgggggtattacatggagctcg

SEQ ID NO: 16929 - DNA, 699 bp, Zea mays
  misc_feature: Ceres CLONE 1381375-F
  misc_feature: Translation starting site: 196
  misc_feature (323)..(323): n is a, c, t, g, unknown, or other
  misc_feature (516)..(516): n is a, c, t, g, unknown, or other
  misc_feature (524)..(524): n is a, c, t, g, unknown, or other
  misc_feature (609)..(609): n is a, c, t, g, unknown, or other
tggagctccccgcggtggcggccgctctagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgcccctcagggcggcgtcgctgagttcatctccaccctcatcttcgtcttcgccgggcagggctccggcatggncttcagcaagctgacccggcggcgcccgacgaccccggcgggcctgatcgcggcggcggtggcgcacgcgttcgcgctgttcgtggcggtgtctgtgggcggaaaatctccggcgggacgtgaaccctggcgtgaccttcggcgccttcgtgggcggaaacatcaccctgtgtccggggctcctgtactgggntggcgcanctgctggggtcaccgtggggtggttcctgctccgttctcgagggggggggaggccacgggcaccttcggttgacgggcgtgtccnggtgggaggcgctggggctagaaatatgatgaccttcgggtgggggacacggggacgccacggggtggaacccaagaggggacctggccc

SEQ ID NO: 16930 - DNA, 750 bp, Zea mays
  misc_feature: Ceres CLONE 1381378-F
  misc_feature: Encodes the peptide sequence at SEQ ID NO. 16931
aagctggagctccccgcggtggcggccgctctagaactagtggatcccccgggctgcaggaattcgcacgagaccattacctagaacatcctaatcgaaaaagcggcaactacacgccagagagagggaaggggaggttggccagagagccgagagcagccctgcagtcgagagcatccgactgctagctactagcaatagcataggcagataagctcgggccgggccggggcacgcgcacaatgaggtcgcggcggtggcacagcgtggtcgccgtagcgctggcagcggcggcgtggtggtggtgcgcggcggcgcaggcgcaggcgcaggcgcagctgagccagagctactacgcgtcgacgtgccccgacgtggagacgctggtccgcggcgccgtcacccagaagctgcaggagaccttcaacgcggcgccgggcacgctccgcctcttcttccacgactgcttcgtcaggggctgcgacgcgtccgtgctgctgtcggcccccgacgaccagcacagcgcgggcgccgacaccacgctgtccccggacgcgctccgacctggtcacccccgcccagggcggccgtggaccccccaaccggcgcttgggccaaaaaggggggccttggggcccgagattcttcgcccctcgccggccccggggaggtcctttccccacgaaagggggggggccgcgaactacacacggtggggaacctctggggcggcgattggaccacgcaaag

SEQ ID NO: 16931 - protein, 169 aa, Zea mays
  misc_feature: Ceres CLONE 1381378-F
  misc_feature: SWISSPROT Homolog: EC 1.11.1.7 Peroxidase
MRSRRWHSVVAVALAAAAWWWCAAAQAQAQAQLSQSYYASTCPDVETLVRGAVTQKLQETFNAAPGTLRLFFHDCFVRGCDASVLLSAPDDQHSAGADTTLSPDALRPGHPRPGRPWTPQPALGPKRGALGPEILRPSPAPGRSFPHERGGAANYTRWGTSGAAIGPRK

SEQ ID NO: 16932 - DNA, 740 bp, Zea mays
  misc_feature: Ceres CLONE 1381381-F
  misc_feature: Encodes the peptide sequence at SEQ ID NO. 16933
  misc_feature (471)..(471): n is a, c, t, g, unknown, or other
  misc_feature (495)..(495): n is a, c, t, g, unknown, or other
  misc_feature (521)..(521): n is a, c, t, g, unknown, or other
  misc_feature (560)..(560): n is a, c, t, g, unknown, or other
  misc_feature (595)..(595): n is a, c, t, g, unknown, or other
  misc_feature (669)..(669): n is a, c, t, g, unknown, or other
aaagctggagctccccgcggtggcggccgctctagaactagtggatcccccgggctgcaggaattcgcacgagaccattacctagaacatcctaatcgaaaaggatcggttccaacaccagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaagggccgcctcaaccgcctcccgtccgcctgtgtcggcgacatggtcatggccaccgtaaagaagggaaagcccgacctcaggaagaaagtgatgcccgccgtcatcgtccgccagcgcaagccgtggcgtcgcaaggacggtgtctacatgtacttcgaagataatgctggagtgattgtgaatccccagggtgagatgaaaggnttctgcatcactggacctatcggncaggagtgtgctgaccttttggctangatcgccagtgcagcaaatggcatcgtttgagagcttgntggaatgtgtttagacttgagtatgatcatctcanttggggggtgcaggtggtgtaagggtgctattggacttgatgctccttttatggttgggcactcattcctggangaacagaaatttctgggtgctccaggttgctgcctggaaagctaaattattatttggcccatgggggaaaa

SEQ ID NO: 16933 - protein, 140 aa, Zea mays
  misc_feature: Ceres CLONE 1381381-F
  misc_feature (19)..(140): Pfam Name: Ribosomal_L14 Pfam Description: Ribosomal protein L14p/L23e
  misc_feature (131)..(131): Xaa is any aa, unknown, or other
MSKRGRGGSAGNKFRMSLGLPVAATVNCADNTGAKNLYIISVKGIKGRLNRLPSACVGDMVMATVKKGKPDLRKKVMPAVIVRQRKPWRRKDGVYMYFEDNAGVIVNPQGEMKGFCITGPIGQECADLLAXIASAANGIV

SEQ ID NO: 16934 - DNA, 759 bp, Zea mays
  misc_feature: Ceres CLONE 1381396-F
  misc_feature: Encodes the peptide sequence at SEQ ID NO. 16935
  misc_feature (370)..(370): n is a, c, t, g, unknown, or other
  misc_feature (371)..(371): n is a, c, t, g, unknown, or other
  misc_feature (396)..(396): n is a, c, t, g, unknown, or other
  misc_feature (445)..(445): n is a, c, t, g, unknown, or other
  misc_feature (449)..(449): n is a, c, t, g, unknown, or other
  misc_feature (450)..(450): n is a, c, t, g, unknown, or other
aagctggagctccccgcggtggcggccgctctagaactagtggatcccccgggctgcaggaattcgcacgagaccattacctagaacatcctaatcgaaaaagccgcatcccttctttcattcgccgccgccgcctgctctctgctgccgtcgccatggggagaaggcctgcgagatgctatcgccagatcaagaacaagccataccccaagtccaggtactgccgtggtgtccctgaccccaagatcaggatctacgatgttggcatgaagagaaagggtgttgatgagttcccctactgtgtgcaccttgtctcttgggagaaggagaatgtctccagtgaggctcttgaggctgcccgtattgcctnngcacagtacatgaccaagtctgcangaaaggatgccttccaccttcgggtcccggttcacccccttcatgtccntcgnnatcaacagatgctttcgtggggctggggctgatagggctccgaactggaaatgaggggtggctttgggaaagcctcagggcaacctgggctaaggggggaacattggccagggccccccttttcttggtcaaaggaaaggaaaaaaatggcttgccattgccaggaaaaactctcgggtccccgccaagtttaaattcccctgggcccgcaaaaattttttttgagaccaaaaaagggggggtttccccaaatttcccccggggcccctcccctgaaaaaaaaagaggggggggaaaattgtccccccg

SEQ ID NO: 16935 - protein, 108 aa, Zea mays
  misc_feature: Ceres CLONE 1381396-F
  misc_feature (5)..(104): Pfam Name: Ribosomal_L16 Pfam Description: Ribosomal protein L16
  misc_feature (72)..(72): Xaa is any aa, unknown, or other
  misc_feature (81)..(81): Xaa is any aa, unknown, or other
  misc_feature (97)..(97): Xaa is any aa, unknown, or other
  misc_feature (99)..(99): Xaa is any aa, unknown, or other
MGRRPARCYRQIKNKPYPKSRYCRGVPDPKIRIYDVGMKRKGVDEFPYCVHLVSWEKENVSSEALEAARIAXAQYMTKSAXKDAFHLRVPVHPLHVXRXQQMLSWGWG

SEQ ID NO: 16936 - DNA, 716 bp, Zea mays
  misc_feature: Ceres CLONE 1381398-F
  misc_feature: Translation starting site: 263
  misc_feature (513)..(513): n is a, c, t, g, unknown, or other
aaagctggagctccccgcggtggcggccgctctagaactagtggatcccccgggctgcaggaattcgcacgagaccattacctagaacatcctaatcgaaaaaagagctccaattcctcgtgcctctgccaatccctccggccctccttccaggcttcaggaccttctcctgcgacgccagcaccgccccgagccgcggcccgaatctagggttcccctctcccgccgtcgacagccggatcgcacatagtgcacctccacgatgctgccgtgcgcgaggtcggtgcttcgaaggagggggctggcatcttccgtcccgcggaggtgcggcggggagggcgagtgctccacttgcgcgggggagctggtcgccaatgccaggtgttcgagcacgctggctgcgctcggcggcggcgggcgcgtgctcgagcatggcggccggtgggcatatccgcagaccggcgtgattggcgcggggcggatgacgcgcacgcagacgaggtgtttcttcgnttgcggcgacggggaggaaggggggcgtgctctccaaggtctatgaggagaggcgcgtgattgggtactcaccagaccagatgtttgctgttgtcgcgtcagtggacctctacgaggactttgtgccatggtgccagcggtccaggattattaggtgccatgaagatggctcatttgatgcagagctcgagattggattcaag

SEQ ID NO: 16937 - DNA, 670 bp, Zea mays
  misc_feature: Ceres CLONE 1381399-F
  misc_feature: Translation starting site: 164
  misc_feature: Pfam Name: DAO Pfam Description: FAD dependent oxidoreductase
  misc_feature: SWISSPROT Homolog: EC 1.5.3.1 Sarcosine oxidase
  misc_feature (445)..(445): n is a, c, t, g, unknown, or other
  misc_feature (643)..(643): n is a, c, t, g, unknown, or other
acccgcggtggcggccgctctagaactagtggatcccccgggctgcaggaattcgcacgagaccattacctagaacatcctaatcgaaaagaagtctatctttttctcctcctgccgtacgtccggtccgttccagcttgcaaagcgctcgcgagctgctgccatggccggcgccggtgcgcccgcagttccccaggccggtcgcccagcccccaacttcgacgtcatcgtggagggcgccggcatcatgggcaactgcacggcgcacgcggtggcgtctcgcggcgcccgcgtcctgctgctggagcgcttcgacctgctccacccgctgggctcctcgcacggtgactcccgcatcatccgcgacacctacgcacatccgcaggacctccgcatggtgcgcctcgcccgacggctctgtggcgacgacggaggccgaggccgncttatcgcgtgcacaacccgactgcgaacctctccatgcggcctgcgaagtagcgcctgcttctccaccgtgatcagctcatcaggggcagaggagatgccgctaacaattctcacgtgaggcagtacacaattgttaaggatattggtgacttgtgccttggaccgtatccgcaagcttgctgacaactgcaccggncctccagggcttcctggtctgtcatgg

SEQ ID NO: 16938 - DNA, 656 bp, Zea mays
  misc_feature: Ceres CLONE 1381407-F
  misc_feature: Encodes the peptide sequence at SEQ ID NO. 16939
cgcggtggcggccgctctagaactagtggatcccccgggctgcaggaattcgcacgagaccattaccagaacatcctaatcaaaaaaagagattaggagacggtcgaccgccctcccgatcggggaagaagacgcgatcgatcaccccggcccccatggaattgttcaacggggtgcggttcgtgcgcctgcggtgctgcgcgcggcgcggcaagtacctggctgccggctccgacggctccagcgtgtgcctgacggggcagcgcggcgtgcacaacgcggtgtgggcggtgcaccacgcggcggggcccgacggcgggccctgcgtgctcctccgcggcgcctacggccggtacctcctggccaccagcgcgcaggccggcacggggccctcgcacggcgtggtcacggcgcaggacgggctcggcggcgccacgccgccgcccgggatgctgtggcaggccatccccaggcggtccaccttcgtcatccgcagcggcacggggcggtacctccgcgccaacggccggtacctgcggtggcgcagggccgtcacctccgccggcgacaatggcagcaccatgatgcagtgggacattgagaacgtgcccatcagcatgacccgcccatgcattcttgatcccacctaccagctg

SEQ ID NO: 16939 - protein, 167 aa, Zea mays
  misc_feature: Ceres CLONE 1381407-F
  misc_feature (1)..(149): Pfam Name: DUF569 Pfam Description: Protein of unknown function (DUF569)
MELFNGVRFVRLRCCARRGKYLAAGSDGSSVCLTGQRGVHNAVWAVHHAAGPDGGPCVLLRGAYGRYLLATSAQAGTGPSHGVVTAQDGLGGATPPPGMLWQAIPRRSTFVIRSGTGRYLRANGRYLRWRRAVTSAGDNGSTMMQWDIENVPISMTRPCILDPTYQL

SEQ ID NO: 16940 - DNA, 693 bp, Zea mays
  misc_feature: Ceres CLONE 1381412-F
  misc_feature: Translation starting site: 177
  misc_feature: Pfam Name: GDI Pfam Description: GDP dissociation inhibitor
  misc_feature (1)..(1): n is a, c, t, g, unknown, or other
  misc_feature (426)..(426): n is a, c, t, g, unknown, or other
  misc_feature (662)..(662): n is a, c, t, g, unknown, or other
nggagctccccgcggtggcggccgctctagaactagtggatcccccgggctgcaggaattcgcacgagaccattacctaagaacatcctaatcgaaaactttttcgtcaactccactttctcttctccgcgtcacctcctcttcgccgccgccgacgcttcacccggcagccagccatggatgaggagtacgacgtgatcgtactaggcacggggctcaaggagtgcatcctcagcggtctccttctctgtagacggcctcaaggttttgcatatggacagaaatgactactatggaggagattccacctcactcaaccttaatcagctctggaagaggtttagaggggaagacaagcccccagcacattcttggtgcaagcagaagactacaatgtggacttggtgccaaagttttattgatggncaaatgggacattttggttcgaacccttcatttcacaccgacgtgacaaagtacttgtcatttcaaagcttgttgatgggagctatgttttcagcaaagggaagattttacaaggtccctgccactgatattgagggctcttgaatccccttttgatgggcctatttcgagaagcgcagagcaaggaacttctttcatttatgtccaaaattacaattgaagctgatccaaggacnccatcaaggattggacctttactagggtgac

SEQ ID NO: 16941 - DNA, 742 bp, Zea mays
  misc_feature: Ceres CLONE 1381416-F
  misc_feature: Encodes the peptide sequence at SEQ ID NO. 16942
aaagctggagctccccgcggtggcggccgctctagaactagtggatcccccgggctgcaggaattcgcacgagaccattacctagaacatcctaatcgaaaactccgctgccctcctcgcctccctcgattcaggattcagcgaattcggacagaacccggcgtgtccgtgtcgaccgacccctccccctgcgagtctgcgacgagtctcctgccgctcttcccggccgggcgaaatggacggtgtcgttgtcaggagggtcattccttcggataacagttgcctcttcaacgctgtgggctacgtgatggagcacaaccgaaataaggcttctgagctcagacaggtcatagcagcaacagtcgctggtgatcctgagaaatttcatgaggtgttttcttgcaaaccaaatgaagcgtattgtgcttggattttggatctggaaagtggggaggaggcattgacctcctattctatcccaatactacgggcgtggaatcccagaatatgacattcaacccaccgcttgggttctctatggccaggagaaaaaatttcggggaagggcccaggccctttaatgagggtttgatttaagaggccccccattgggccccgggggaagggggccccgaaaaattttacccaaaaaattttcccccaaaaataggggcggtctcttgggccccaaaaaaggcttcccccccccctttggggggggggcccaaaataaaaactcctc

SEQ ID NO: 16942 - protein, 91 aa, Zea mays
  misc_feature: Ceres CLONE 1381416-F
MDGVVVRRVIPSDNSCLFNAVGYVMEHNRNKASELRQVIAATVAGDPEKFHEVFSCKPNEAYCAWILDLESGEEALTSYSIPILRAWNPRI

SEQ ID NO: 16943 - DNA, 728 bp, Zea mays
  misc_feature: Ceres CLONE 1381417-F
  misc_feature: Encodes the peptide sequence at SEQ ID NO. 16944
aaagctggagctccccgcggtggcggccgctctagaactagtggatcccccgggctgcaggaattcgcacgagaccattacctagaacatcctaatcgaaaaatcttcttcctcgtgcgagtgcagacgccttgattgcagccctgcctctctcctctcctggtctcccaccggccacaggcacaggtcggcaccgaacgccgacatgccttaccaattccagctaccatggatcaagaagccaactacgaacgggggcacctccaaaatagacactaagcctagaccccgcttcaccaaccccttcctccctatgctagcccatgtcacctccatcttctcctccttgctcaggacgatatcgacaacgacagcctgtgcgcgtattagctcgtcagactgcacctctgagacctatctacatctgatatcgggagcgattcgccggtgggcccgggtactccgtagccatgacgacaggagttcagatcgagtatacaaagcttgcaggccacggggcgagaacttatttcaggcaggagttcgggtggttgctccctaggaaaatactacccgatgtgaaacccattgatggggattgccccccggccagggatgctacttgccgggaaaaccgggcttcaaaaaaaatcccggggggggggtttaaaaaccccccagaaaactccggggggaaaaccgaaaaagggggggaatcccaaaaacca

SEQ ID NO: 16944 - protein, 118 aa, Zea mays
  misc_feature: Ceres CLONE 1381417-F
MPYQFQLPWIKKPTTNGGTSKIDTKPRPRFTNPFLPMLAHVTSIFSSLLRTISTTTACARISSSDCTSETYLHLISGAIRRWARVLRSHDDRSSDRVYKACRPRGENLFQAGVRVVAP

SEQ ID NO: 16945 - DNA, 676 bp, Zea mays
  misc_feature: Ceres CLONE 1381417-R
cgattgggtaccgggccccccctcgaggtcgacggtatcgataagcttttttttttttttttttattaactaacgcctcaaaaaatgtagaaatttaagtggcataacaaaactgaatgctacccagattctacataagtttccagctaactaatgtcacactacatacatctaacacaggaactaacagtaattcgagttcatggcacagaatcacataaactgtgtaagaaataatgtgtatatataatggactactatcaaagtgtccagacagacaaatatgaggttggtgggaataacactggtaacaaccttctaaagaatgaactacttgcacagctgtgatggtgtcaagacagtagcaaggtcaaatccaggagagaataaatacaacatcgtcccattttgaggaggagctatccttcatagatttaatgatatcttccaaagaagaaacctgagtgtcaccaaacctaacagcaggattaggtttttgctgatcatgggaggtccggagcagggagttatccaagacctcctttctgaaaaaaactggacgatatctcttgttgtcactcatcaagaccaggctccttgactgagaaactggcactcctggaaatccctctccagcatacagaccttcatcttgcatcaaattaattgcattagc

SEQ ID NO: 16946 - DNA, 698 bp, Zea mays
  misc_feature: Ceres CLONE 1381418-F
  misc_feature: Encodes the peptide sequence at SEQ ID NO. 16947
  misc_feature (598)..(598): n is a, c, t, g, unknown, or other
ggagctccccgcggtggcggccgctctagaactagtggatcccccgggctgcaggaattcgcacgagaccattacctagaacatcctaatcgaaaaactgccgcatgagaagatagcagtatagcaccgcccgctgcaatgaaccgcgcttcttggttgctccttgttctggtgcagctctcttgcttgcactgctactcagccacccaccatggcggcggccggaagcacggacgcccactactacccgcgcccgccaacgtcgtcgtcggctccgttgtcgtcgtccactccggcagctccgaggctaccaccaccgccgtttcttcaggtgcgcatgcaactattgctgcttcgagcgtggtgtttactttgggcctcgattgtgtgcctgcctgcttcgaccgtgtacctagctaacacagtctcaggcacccctggtcggggtccgctgccacgacgggaaacggccggacggtgtccgaagggaaacgggggtcgtgacggaccgccagcggaaagggttccgcgtgcaccctcgcgcacggtgccaagcagcggcagcagcagagcaaccagggttcgggtccgcacgtanttggtttttggggggggggtgaactcccccccggaagggagttgccccgccggggcgtccccaccgccagttcccgggatgggggggcttcacacctcga

SEQ ID NO: 16947 - protein, 93 aa, Zea mays
  misc_feature: Ceres CLONE 1381418-F
MNRASWLLLVLVQLSCLHCYSATHHGGGRKHGRPLLPAPANVVVGSVVVVHSGSSEATTTAVSSGAHATIAASSVVFTLGLDCVPACFDRVPS

SEQ ID NO: 16948 - DNA, 648 bp, Zea mays
  misc_feature: Ceres CLONE 1381422-F
  misc_feature: Encodes the peptide sequence at SEQ ID NO. 16949
gctctagaactagtggatcccccgggctgcaggaattcgcacgagaccattacctagaacatcctaatcgaaaactgccttaaccattcctcccaacaccacctcgcctgcgatcttcctatcctccgtcgcgtcgagcatccatcatgcctccctactgcgcaaagtacaaggatgagctcatcaagaatgctgcctacattggaacccccggcaagggtatccttgctgctgatgagtccactggcaccattggcaagcgcctttccagcatctatgtcgagaacgttgaggagaaccgccgtgccctccgtgagctcctattctgctgccctggtgctctccagtacatcagcggtgagatcctcttcgaggagaccctgtaccagaacaccaaggatggcaagtcttttgttgatgtcctcaaggagggaggcgtcctccctggcatcaagggtgacaagggcacgcattgaggttgttggcactgataaggagaccaccacccaaggccatgacgaccttggcaagcgttgcgccaagtactacgaggcaggtgcccgctttgccaggtggcgcgctgttctcaagattggccctaatgaggcatcacagcttgccatcgactagaacgcctcaagggtctgg

SEQ ID NO: 16949 - protein, 109 aa, Zea mays
  misc_feature: Ceres CLONE 1381422-F
  misc_feature (11)..(110): Pfam Name: Glycolytic Pfam Description: Fructose-bisphosphate aldolase class-I
  misc_feature: SWISSPROT Homolog: EC 4.1.2.13 Fructose-bisphosphate aldolase
MPPYCAKYKDELIKNAAYIGTPGKGILAADESTGTIGKRLSSIYVENVEENRRALRELLFCCPGALQYISGEILFEETLYQNTKDGKSFVDVLKEGGVLPGIKGDKGTH

SEQ ID NO: 16950 - DNA, 685 bp, Zea mays
  misc_feature: Ceres CLONE 1381426-F
  misc_feature: Encodes the peptide sequence at SEQ ID NO. 16951
  misc_feature (582)..(582): n is a, c, t, g, unknown, or other
  misc_feature (634)..(634): n is a, c, t, g, unknown, or other
tccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccaggctggactgtgctgtccttatcattgatccaccaactggttggttttttgaggctggatcctccaaggatggccagacccgtgaaatggtnctccttgcgtcaaacccttggaagttgaaaccagatgatttgctgctgcaancaagatggatgcaaccactcccaaaactccagggacgtttaattgaagaga

SEQ ID NO: 16951 - protein, 116 aa, Zea mays
  misc_feature: Ceres CLONE 1381426-F
  misc_feature (5)..(116): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQAGLCCPYH

SEQ ID NO: 16952 - DNA, 656 bp, Zea mays
  misc_feature: Ceres CLONE 1381427-F
  misc_feature: Encodes the peptide sequence at SEQ ID NO. 16953
  misc_feature (334)..(334): n is a, c, t, g, unknown, or other
  misc_feature (499)..(499): n is a, c, t, g, unknown, or other
  misc_feature (526)..(526): n is a, c, t, g, unknown, or other
  misc_feature (594)..(594): n is a, c, t, g, unknown, or other
tccccgcggtggcggccgctctagaactagtggatcccccgggctgcaggaattcgcacgagaccgttacctagaacatcctaatcgaaaattcccttctgtcgctgctcccacctctagcccgacaggtgaagccgccgccgctgcagtgtccatagccaccgcaggagactgagatggggggttttgtcaagacccacaagaccaatgcgtacttcaagcgtttccaggtgaagttcaagagaaggcgcgctggcaagacagactacagggccaggataaggctgattaaccaagacaaaaacaagtacaatacacccaaatacagatttgnttgtgcgatttaccaacaaggacatcacagcacaaatcatctctgctagtatagcaggtgattatggttcttgcttctgcttactcgcatgagttgccacgatatggtcttgaaagttggtctgaccaactatgcagctgcctactgcactggccttctgttggnctcgccgtggctcaagaaacccgtggnttagataaggaatatgagggccaatgttgaggccactgggtgggggactttctctgttgagcagctgnatgagagaaggggctttccggttcctcccttgtggaaggtgggcctttataggactacactg

SEQ ID NO: 16953 - protein, 68 aa, Zea mays
  misc_feature: Ceres CLONE 1381427-F
  misc_feature (53)..(53): Xaa is any aa, unknown, or other
MGGFVKTHKTNAYFKRFQVKFKRRRAGKTDYRARIRLINQDKNKYNTPKYRFXCAIYQQGHHSTNHLC

SEQ ID NO: 16954 - DNA, 664 bp, Zea mays
  misc_feature: Ceres CLONE 1381428-F
  misc_feature (198)..(198): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (308)..(308): n is a, c, t, g, unknown, or other
  misc_feature (319)..(319): n is a, c, t, g, unknown, or other
  misc_feature (325)..(325): n is a, c, t, g, unknown, or other
  misc_feature (337)..(337): n is a, c, t, g, unknown, or other
  misc_feature (369)..(369): n is a, c, t, g, unknown, or other
tccccgcggtggcggccgctctagaactagtggatcccccgggctgcaggaattcgcacgagaccattacctagaacatcctaatcgaaaaatcacaattcactccactcatcttttctcgtttagaacctctaaaatttcccccactcgccagtcgcagcagcacctgtagcagtcatggacgccagcggagcccgngtnnnagcaaggggggaagaaaagggggcggccggggcgcaaggcaaggcggccccaggaagagtcggtgacgcggtcgtcaaggcgggctgcagttccccgtcggcggnatcggcgctanctccangaaagggcgggntaccccgcaaggggcgggggggaacttggggnggcccccccggggtaaacctttcgcccggcgggctgggagtaccccccccccccaaaggttcttggagtttggaaagggaaaacccgggcgaaaaaaaaaaaaccagaaaaaaaaaggggaaaaattccccccggaggaggaggggttcctggggggaccccaaaaaaaaagggagttcttggaaaaaatttttggggggggggggaccccttggggaaggggggggggggcccccccccaaaaaaaaccaccccgggggttccggccccaaaagaaggagggggggaaaaaaag

SEQ ID NO: 16955 - DNA, 615 bp, Zea mays
  misc_feature: Ceres CLONE 1381435-F
  misc_feature: Encodes the peptide sequence at SEQ ID NO. 16956
  misc_feature (378)..(378): n is a, c, t, g, unknown, or other
  misc_feature (402)..(402): n is a, c, t, g, unknown, or other
  misc_feature (436)..(436): n is a, c, t, g, unknown, or other
gctctagaactagtggatcccccgggctgcaggaattcgcacgagaccattacctagaacatcctaatcgaaaaaaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattggcgggaggtgatgatgctttcaacaccttcttcagtgagactggtgctgaggagcacgtgncccgtggctgtttttggtgacttngaacccactgtcatcgatggaggtgaggactggnaccctacggcagctcttccaccctgagcagctcatcagtggggaaaggaggatgcagccaacactttttgcccgggggcactacaccatgggaaggggaaattgggtgactaatggcctggatcggattaggaaaggttggcgacaaatggactggggcctcccggggcttcctcgcct

SEQ ID NO: 16956 - protein, 45 aa, Zea mays
  misc_feature: Ceres CLONE 1381435-F
MRECISIHIGQAGIQVGNACWELYCLEHGIQADGQMPGDKTIGGR

SEQ ID NO: 16957 - DNA, 720 bp, Zea mays
  misc_feature: Ceres CLONE 1381442-F
  misc_feature: Encodes the peptide sequence at SEQ ID NO. 16958
  misc_feature (375)..(375): n is a, c, t, g, unknown, or other
  misc_feature (407)..(407): n is a, c, t, g, unknown, or other
  misc_feature (444)..(444): n is a, c, t, g, unknown, or other
  misc_feature (445)..(445): n is a, c, t, g, unknown, or other
  misc_feature (476)..(476): n is a, c, t, g, unknown, or other
  misc_feature (497)..(497): n is a, c, t, g, unknown, or other
caaagctggagctccccgcggtggcggccgctctagaactagtggatcccccgggctgcaggaattcgcacgagaccatacctaaaacatcctaatcgaaaaaacccaatcccaatccagagcgaagatcgcgatcagagcaggagcaggcaacgcgcaccgaaatcttccaatccacaagactcgctacttcgcagttggcagactcgcccgcagcgagccgctagcaaccaagcagaaatgtcgctggtgaggcgcggcagcgtgttcgacccattctccgtggacctcttcgaccccttcgacagcgtgttccgctccatcgtgccgtcgtcgtcgtcgggcggcggcggcctccgagaccgccgccttcgnccagcgccgcatcgactggaaggagacgcccngagcgcacgtggtcaggccgacctccccggcgtgaannaagagaggtgaaggtggaggtggaggaacgnaacgtgctggtcatcagcggncaagcgcaccagggagaagggagaacaaggcgacaagtgggatccgggtgaaggcaaaaaaggggcaattcgggggggggtttccgccccccccaaaagcccaaaacgggaggagggaggggccccctttagaaaaggggggtttccccgggccccgggcccaggggcgggggtaaaaaaccccgggggaaaaaaccccccatctcccgggtgaaaaaaaacg

SEQ ID NO: 16958 - protein, 71 aa, Zea mays
  misc_feature: Ceres CLONE 1381442-F
  misc_feature (56)..(56): Xaa is any aa, unknown, or other
  misc_feature (68)..(68): Xaa is any aa, unknown, or other
  misc_feature (69)..(69): Xaa is any aa, unknown, or other
MSLVRRGSVFDPFSVDLFDPFDSVFRSIVPSSSSGGGGLRDRRLRPAPHRLEGDAXSARGQADLPGVXXER

SEQ ID NO: 16959 - DNA, 662 bp, Zea mays
  misc_feature: Ceres CLONE 1381443-F
  misc_feature: Encodes the peptide sequence at SEQ ID NO. 16960
  misc_feature (566)..(566): n is a, c, t, g, unknown, or other
  misc_feature (571)..(571): n is a, c, t, g, unknown, or other
ctccccgcggtggcggccgctctagaactagtggatcccccgggctgcaggaattcgcacgagaccattacctagaacatcctaatcgaaaaccccatttcgaagcccaccgaattccctgcgattcctctcccctcgcctcctcgtctccccctagggttagcacctcgctgcctccgattcaatcataatatggtctcttctccctttgatctgtagatttggggctttggctccgcctcgcgcgcccgatccgggccgtcctccttttttcccctcttatatttgatcggtttctttgcgtcgttcacgcagggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggnagccnggttgttgctggcagcaaccgggtagtagctgttgcccaagttgagttgcaaacaatgaacgtgcagcagcccgctgatgttgcggaccaa

SEQ ID NO: 16960 - protein, 75 aa, Zea mays
  misc_feature: Ceres CLONE 1381443-F
  misc_feature (14)..(38): Pfam Name: zf-A20 Pfam Description: A20-like zinc finger
  misc_feature (66)..(66): Xaa is any aa, unknown, or other
  misc_feature (68)..(68): Xaa is any aa, unknown, or other
MEHKEAGCQAPEGPILCINNCGFFGSAATMNMCSKCHKEMITKQDQAKLAASSIDSIVNGSDAVMXAXLLLAATG

SEQ ID NO: 16961 - DNA, 733 bp, Zea mays
  misc_feature: Ceres CLONE 1381445-F
  misc_feature: Encodes the peptide sequence at SEQ ID NO. 16962
tggagctccccgcggtggcggccgctctagaactagtggatcccccgggctgcaggaattcgcacgagaccattacctagaacatcctaatcgaacaattctaggatggaaggaaattcagaggccacgagcaccaaatccgctcgaagcgagccggaaatatcaaaatttccggaatccgccgccgccgccgccaggctgaccaatggacctctccgtcgtgccatccctctccctctccccgcgccgtgcccttccactcccggccaggagggctgcgcggcgtccggccttcgtctgccgctgcagttgctccctggacgcgtccccggtggccacccggcggttgttcgcctccctcctcgccaccgcagcagcggtgggggttggcgtggccggaggcggaggggaagccggcgcggtgtccacgagcaggagggcgctcagggcgtccaagattcctgagagcgaattcaccaccctgcccaatggcctcaagtactacgacatcaaggtaggaagtggggctgaagctgttaaaggatcccgtgttgcggtacattatgtggccaagtggaagggcatcacattcatgacaagtaggcagggtcttggtgttggtggtggaacgccatatgggtttgacgtaggcaattctgagagaggcaatgttttaaaaggattggatcttggggttgagggaatgaaagtcggaggccagaggttgataata

SEQ ID NO: 16962 - protein, 176 aa, Zea mays
  misc_feature: Ceres CLONE 1381445-F
  misc_feature (105)..(176): Pfam Name: FKBP_C Pfam Description: FKBP-type peptidyl-prolyl cis-trans isomerase
  misc_feature: SWISSPROT Homolog: EC 5.2.1.8 Peptidylprolyl isomerase
MDLSVVPSLSLSPRRALPLPARRAARRPAFVCRCSCSLDASPVATRRLFASLLATAAAVGVGVAGGGGEAGAVSTSRRALRASKIPESEFTTLPNGLKYYDIKVGSGAEAVKGSRVAVHYVAKWKGITFMTSRQGLGVGGGTPYGFDVGNSERGNVLKGLDLGVEGMKVGGQRLII

SEQ ID NO: 16963 - DNA, 685 bp, Zea mays
  misc_feature: Ceres CLONE 1381450-F
  misc_feature: Encodes the peptide sequence at SEQ ID NO. 16964
  misc_feature (537)..(537): n is a, c, t, g, unknown, or other
  misc_feature (557)..(557): n is a, c, t, g, unknown, or other
  misc_feature (573)..(573): n is a, c, t, g, unknown, or other
  misc_feature (574)..(574): n is a, c, t, g, unknown, or other
  misc_feature (632)..(632): n is a, c, t, g, unknown, or other
  misc_feature (638)..(638): n is a, c, t, g, unknown, or other
gcggtggcggccgctctagaactagtggatcccccgggctgcaggaattcgcacgagaccattacctagaacatcctaatcgaaaaatccgccgctgctcgagaaccgcggccagtccatctcctgccggtgaccggccgctctcctttgtcccggtctgcaagcggcggatgagcacgctggcgcatcccaggtttgcccctctccctacggagcaaactgaatcccaaacagatggcggggctgcacggtaccagttccggctggtctcttacaacatcttggcccaggtttatgttaagagtacgctttttcctcattccccatctgcgtgcctcaagtggaaatctcgatcgggagctattcttacagaactaaagagctttgatgctgacttcatgtgcatacaggagttggatgaatatgataccttctataagaaaaacatggaaaactctggatattcaagtatttaacattcagcgatctggagacaaaccgagatggcttgtggtatattctataaacctaaaagtngcagaactgggggcagaaangaagtaatactgtacnnatgatttagaaaaaaaaataatgttcctaagtgataaaagggaaataagtgctctggnaaaatnaattcttccagcagaaagaagacaagaatgcaaagcagatatagcca

SEQ ID NO: 16964 - protein, 157 aa, Zea mays
  misc_feature: Ceres CLONE 1381450-F
  misc_feature: SWISSPROT Homolog: EC 3.1.13.4 Poly(A)-specific ribonuclease
GGGRSRTSGSPGLQEFARDHYLEHPNRKIRRCSRTAASPSPAGDRPLSFVPVCKRRMSTLAHPRFAPLPTEQTESQTDGGAARYQFRLVSYNILAQVYVKSTLFPHSPSACLKWKSRSGAILTELKSFDADFMCIQELDEYDTFYKKNMENSGYSSI

SEQ ID NO: 16965 - DNA, 748 bp, Zea mays
  misc_feature: Ceres CLONE 1381451-F
  misc_feature: Encodes the peptide sequence at SEQ ID NO. 16966
  misc_feature (429)..(429): n is a, c, t, g, unknown, or other
  misc_feature (466)..(466): n is a, c, t, g, unknown, or other
  misc_feature (482)..(482): n is a, c, t, g, unknown, or other
  misc_feature (515)..(515): n is a, c, t, g, unknown, or other
  misc_feature (519)..(519): n is a, c, t, g, unknown, or other
  misc_feature (558)..(558): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttangggaggcatgcagatctttgtcaagaccttgactggncagacaatcacccttngagtggagtcctcagacaccatttgacatgtcnaggncaagatcccaggacagggagggcatcccacctgaccagnaacgtttcatctttgcccgcaagcaattgggaggatgggaagacccttgctgactacaacatccaaaggaaaagcccctccacttggggctgcgcttaagggggggatggcaaactttgggaaaacccttactggaaaaaccctcatctttgggggggagctttcaaaaacctttggaagggcaagggca

SEQ ID NO: 16966 - protein, 99 aa, Zea mays
  misc_feature: Ceres CLONE 1381451-F
  misc_feature (6)..(74): Pfam Name: ubiquitin Pfam Description: Ubiquitin family
  misc_feature: SWISSPROT Homolog: EC 3.1.2.15 Ubiquitin thiolesterase
  misc_feature (74)..(74): Xaa is any aa, unknown, or other
  misc_feature (92)..(92): Xaa is any aa, unknown, or other
MQIFVKTLTGKTITLEVESSDTIDNVKAKIQDKEGIPPDQQRLIFAGKQLEDGRTLADYNIQKESTLHLVLRLXGGMQIFVKTLTGQTITLXVESSDTI

SEQ ID NO: 16967 - DNA, 663 bp, Zea mays
  misc_feature: Ceres CLONE 1381452-F
  misc_feature: Encodes the peptide sequence at SEQ ID NO. 16968
  misc_feature (488)..(488): n is a, c, t, g, unknown, or other
aaagctggagctccccgcggtggcggccgctctagaactagtggatcccccgggctgcaggaattcgcacgagaccattacctagaacatcctaatcgaaaagttccgcaccccacggcaggcgcttgagagtacttgactactaccctcccacctgcgagactgcaacgccgttgcttcaactcgactccagcatccctcgtccccgcatcaccgcgccgccgacactccgctcgctttcgctcccgagacccgggcctgccgagccgccgccatggacgaggagtacgacgtgatcgttctgggcacggggctcaaggagtgcatcctcagcggtctcctctctgtcgacggcctcaaggttctacacatggatagaaatgattactacggaggagattccaccctccctaaacctgaaccagctctggaagaggtttagggggggaagacagccaccggcacatctaggtggaagcagagatacnatgtaaacatggttccaagtttatgatgggaaacgggactttgggtccaactctcattcccactgatgggaccaaaaattggcatttcaaggttgtggaggaaagttatgcttccggaccggaaaattcccagggtccctgccccgaattggggggcctaaaatcccttggaggt

SEQ ID NO: 16968 - protein, 55 aa, Zea mays
  misc_feature: Ceres CLONE 1381452-F
MDEEYDVIVLGTGLKECILSGLLSVDGLKVLHMDRNDYYGGDSTLPKPEPALEEV

SEQ ID NO: 16969 - DNA, 673 bp, Zea mays
  misc_feature: Ceres CLONE 1381453-F
ccccgcggtggcggccgctctagaactagtggatcccccgggctgcaggaattcgcacgagaccattacctagaacatcctaatcgaaaaacacatattattgagaccaactagcatcatagaaagcacaatagtgtaccaactatggcagccaaaatattttgcttccttatgctccttggtctttctgcaagagctgctaccgaaaccattttcccacaatgctcacaagctcctatagcttcctttcttcccccatacctctcaccagcggtgtcttcagtatgtgacaacccaattcttcaaccctacaggatccaacaggcaatcgcaccaggcatcttacctttatcacccttgttcctccaacaaccgtcagccctattacagcagttacctttggtgcatttgctgtcacaaaacatcaaggcactacaactaacaacaacttgtgctaggaaaccttgctgcctactctcagcaccagcagtttcttccattcaaccaactggctgcattgaactctgctgcttatttgcaacacaactaccatttcagtcagctagctgctgcctacccccagcaatttcttccattcaaccaactgggagcattgaactctgctgcttaattttacaacagcaacagctaccaccattcagccaggctagct

SEQ ID NO: 16970 - DNA, 702 bp, Zea mays
  misc_feature: Ceres CLONE 1381454-F
  misc_feature: Encodes the peptide sequence at SEQ ID NO. 16971
  misc_feature (610)..(610): n is a, c, t, g, unknown, or other
  misc_feature (635)..(635): n is a, c, t, g, unknown, or other
  misc_feature (669)..(669): n is a, c, t, g, unknown, or other
  misc_feature (672)..(672): n is a, c, t, g, unknown, or other
aaagctggagctccccgcggtggcggccgctctagaactagtggatcccccgggctgcaggaattcgcacgagaccattacctagaacatcctaatcgaaaatttctcaagccgattagttcaatagttccctggaacaaaatcacgtacacgcctggtcttctgcttgcttgtgcccaggtggctaccagaggtccagagccgttgcttgttcttggcgcttgccccagcaccagcctcgcgcttccttggctcgcccaggtcgccgccgtcgctcagctcggcgcccatctatctgctcagcctccagcggcggccttcccctgccggtgcccagcccagcggcccctcctctctctccctcaagctctctgcgcgccgtgaagcccctgcgcgtcgcagtctcccaagctcgccatggctgccggacgagtctctcccgtctctgcttgtcctcttcgagcttggttcctgcgcgcgcgctcctctgctcccatggcgtgttcctgcgcccgcctggatttccctgctgagctcggtctcatggccggcatacggcttcgtgttcgccggagcttcctggtgctcgcccatggccgccggtgctcgncctcttgcgtcgcgcccgacccagncgtgtgctcgcccgaccgtacgctcgctctgctncgncatgccgcctgctgcgcgtgcgtctgctcc

SEQ ID NO: 16971 - protein, 95 aa, Zea mays
  misc_feature: Ceres CLONE 1381454-F
  misc_feature (65)..(65): Xaa is any aa, unknown, or other
  misc_feature (73)..(73): Xaa is any aa, unknown, or other
MAAGRVSPVSACPLRAWFLRARSSAPMACSCARLDFPAELGLMAGIRLRVRRSFLVLAHGRRCSXSCVAPDPXVCSPDRTLALLRHAACCACVCS

SEQ ID NO: 16972 - DNA, 669 bp, Zea mays
  misc_feature: Ceres CLONE 1381455-F
  misc_feature: Encodes the peptide sequence at SEQ ID NO. 16973
  misc_feature (493)..(493): n is a, c, t, g, unknown, or other
  misc_feature (494)..(494): n is a, c, t, g, unknown, or other
  misc_feature (564)..(564): n is a, c, t, g, unknown, or other
  misc_feature (572)..(572): n is a, c, t, g, unknown, or other
  misc_feature (575)..(575): n is a, c, t, g, unknown, or other
  misc_feature (650)..(650): n is a, c, t, g, unknown, or other
tccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggnncgtcatggggttcctcacgtcgggcgcgctggggggctccgggggcctgtccctcgctcacgtgcctcgncacacggnggngggcaggcggttccagcgcacccgggaatataaggggaaggaggcgcaccgcaggaaaggggggaaggcccgcgncgcacgcggggccacaaaa

SEQ ID NO: 16973 - protein, 137 aa, Zea mays
  misc_feature: Ceres CLONE 1381455-F
  misc_feature (44)..(131): Pfam Name: Oleosin Pfam Description: Oleosin
  misc_feature (100)..(100): Xaa is any aa, unknown, or other
  misc_feature (124)..(124): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTXRHGVPHVGRAGGLRGPVPRSRASXHGGGQAVPAHPGI

SEQ ID NO: 16974 - DNA, 687 bp, Zea mays
  misc_feature: Ceres CLONE 1381459-F
  misc_feature (517)..(517): n is a, c, t, g, unknown, or other
ggaactccccgcggtggcggccgctctagaaaagtggaacccccgggctgcaggaattcgcacgagaccattacctaaaacacctaatcgaaaaatctatcgcacttcgtagtcgtagcttcaagcattcagcggcaggagctttgggcagcgtgcgcacgtggggtaacttaagcttcgctcttgctaacctaccattggctgaatcaccaccggggtgcgacgggaggtggcgggggctaacggcgaccttccagcgcgggggcggcattgcacggcgaggcgcagcagcagcagaagcagggcgccattgatgacggcgcttcaaggccgcgacggccgcgaccttccgcgggtcgattgcttggtgcttgtccgggctgatcctggccggcaccgtgattcgcgctcacggtggcacccccgtgctgtgacacccccttttttttgtttgtgccccccccccctttttcttgttgtttttttgggggggccggtttttgtcccccttcggggntcctcgcggtccttggcgttgtccgtgttcctcctgggttgtacaagtacttgacgggcaagcacccgcccgggcgcccgaccagctggaccacgccaagggggaggctgggcggtccaaggcccgcgaccatcaaggatgcagcacagcaccgcatcgacaaggggggt

SEQ ID NO: 16975 - DNA, 678 bp, Zea mays
  misc_feature: Ceres CLONE 1381461-F
  misc_feature: Encodes the peptide sequence at SEQ ID NO. 16976
  misc_feature (657)..(657): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
aaactggaactccccgcggtggcggccgcttttgaacttagtggatcccccgggctgcaggatttcgcacgagacctttacctaaaacttcctaatccaaaaatcttcgcaaagtcgcaataactttgttttttcgaatcggcttgcaactttactttaaaacttactgctgctgccgctagggttttggggtgaggattccccatgtcgacggctcccaggcgtccctttccgaggccgcggcgccatgcccttcgggcaccggctacgtccgccgcggccccgccccaggctccgccgacgccgccaagcccctgcgcaagcccgtcttcaccaccgtcgaccagctttcgcccccagacacacggtcacacttttacagcccgcgtcatttccgtccgcaccgtcctcgacaagccctccacgcacctcggccgcaccccggtcgccgagtgcctcgtcggagacagcaccggcaccgtcctcgtcaccgcccgcaacgaacaggttgacctttttaaccagatacaacagtgatcttcccaatgccaagattgatatgttcaaggcaccttaagactgcggtggaccaatggggccccgattttgagtgatgaattctttctgtttttcaggtgaatgaagacacacatgtcnacttgtggatacannnttttt

SEQ ID NO: 16976 - protein, 110 aa, Zea mays
  misc_feature: Ceres CLONE 1381461-F
MSTAPRRPFPRPRRHALRAPATSAAAPPQAPPTPPSPCASPSSPPSTSFRPQTHGHTFTARVISVRTVLDKPSTHLGRTPVAECLVGDSTGTVLVTARNEQVDLFNQIQQ

SEQ ID NO: 16977 - DNA, 738 bp, Zea mays
  misc_feature: Ceres CLONE 1381462-F
  misc_feature: Encodes the peptide sequence at SEQ ID NO. 16978
agagctggagctccccgcggtggcggccgctctagaactagtggatcccccgggctgcaggaattcgcacgagaccattacctagaacatcctaatcgaaaataaataaaatgccctcgcggcctcacctccattattgccatccatcacatcctctcccaccttactcaagctagtgcgagcatagcaatggggttcgcccggaagagtggagttgcagcagtaggggtttggtggctcctcctgctcgccggcgtgctgttgcctttggcggcggcatttggccggcacgccgatgccggcaacgacatgtgcgacatcaagtgccagcatcacagcgacccggccaggaggcagcagtgcgtggatgagtgccatagccgggagcaccatcaccctagcagagagttttgcgagatgaagtgccagcaccaccaggaccctgcaaggaaagagatctgcgtacagcagtgcatgagctatggtctcagccaccgtgcgagtgccagtgttgttgatgagggtgaaaagcgcttccatggctgggaaacgacggtggccggaggaatcctcgaggcggtgtgacgacgtacgacgttatataacagtacgtcataattaataaaataagctacacccgcgtttcccttatatatatgtcttgctatgcatagagatatcatggcaaaggcataggaataaagtgcgtgcgatatgcatgtacgtgcatggtcgtaa

SEQ ID NO: 16978 - protein, 131 aa, Zea mays
  misc_feature: Ceres CLONE 1381462-F
MGFARKSGVAAVGVWWLLLLAGVLLPLAAAFGRHADAGNDMCDIKCQHHSDPARRQQCVDECHSREHHHPSREFCEMKCQHHQDPARKEICVQQCMSYGLSHRASASVVDEGEKRFHGWETTVAGGILEAV

SEQ ID NO: 16979 - DNA, 568 bp, Zea mays
  misc_feature: Ceres CLONE 1381465-F
  misc_feature (229)..(229): n is a, c, t, g, unknown, or other
  misc_feature (259)..(259): n is a, c, t, g, unknown, or other
  misc_feature (328)..(328): n is a, c, t, g, unknown, or other
  misc_feature (397)..(397): n is a, c, t, g, unknown, or other
ggagctccccgcggtggcggccgctctagaactagtggatcccccgggctgcaggaattcgcacgagaccattacctagaacatcctaatcaaaaactatcctaccaggcaccactcgcatcgtgtgctcagtcagatccccgtcccgcatttcctaaggccaggttagttggcattgaagacgatgactgcttctgcagctgctggtgtgcagatggtggctgcacgncccttgcattttcggcctcgccaggaaatnttctttacgcacggtttctagactgattgctgtcagtacactgctacatccccaaacagctgctctggnctctagggtaagcgaatgatgtgttgaggagcaatcggagaggggggcgaaggcgtttcaatgatttcnaaggaaaggcttccttggctggattctgagaaaagggggatggaggggaattgggaaaggccttgggggcggggggggggaaaatttttgggggaaagggggggccgcccttttaattttttaaaaaactttggggggggggaaatttttgataaaaccccgaaagtgccc

SEQ ID NO: 16980 - DNA, 661 bp, Zea mays
  misc_feature: Ceres CLONE 1381480-F
  misc_feature: Encodes the peptide sequence at SEQ ID NO. 16981
  misc_feature (419)..(419): n is a, c, t, g, unknown, or other
  misc_feature (661)..(661): n is a, c, t, g, unknown, or other
tccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgactcacggggntttgggggggggggccgcccgccatcgcgctgggctcatgggcggccccgggttcgtcacctccggggggcctcggcgtcgctgcggctgtccgtgtccctctggaatgtacaggtacctgacgggcaagcacccgccgggcgccgaccagctggaccacgccaaggcggaggctggcgtccaaggcccgcgaacatcaaggatgcagcacagcaccgcatcgacaaggcggcagggggtcn

SEQ ID NO: 16981 - protein, 160 aa, Zea mays
  misc_feature: Ceres CLONE 1381480-F
  misc_feature (36)..(152): Pfam Name: Oleosin Pfam Description: Oleosin
  misc_feature (80)..(80): Xaa is any aa, unknown, or other
MADHHRGATGGGGGYGDLQRGGGMHGEAQQQQKQGAMMTALKAATAATFGGSMLVLSGLILAGTVIALTVATPVLVTHGXLGGGAARHRAGLMGGPGFVTSGGPRRRCGCPCPSGMYRYLTGKHPPGADQLDHAKAEAGVQGPRTSRMQHSTASTRRQGV

SEQ ID NO: 16982 - DNA, 679 bp, Zea mays
  misc_feature: Ceres CLONE 1381482-F
  misc_feature: Translation starting site: 200
  misc_feature: Pfam Name: PP-binding Pfam Description: Phosphopantetheine attachment site
  misc_feature (364)..(364): n is a, c, t, g, unknown, or other
  misc_feature (477)..(477): n is a, c, t, g, unknown, or other
  misc_feature (512)..(512): n is a, c, t, g, unknown, or other
  misc_feature (513)..(513): n is a, c, t, g, unknown, or other
  misc_feature (540)..(540): n is a, c, t, g, unknown, or other
  misc_feature (581)..(581): n is a, c, t, g, unknown, or other
  misc_feature (582)..(582): n is a, c, t, g, unknown, or other
  misc_feature (640)..(640): n is a, c, t, g, unknown, or other
tccccgcggtggcggccgctctagaactagtggatcccccgggctgcaggaattcgcacgagaccattacctagaacatcctaatcgaaaaaactccaacctacccagcctcggccagccacctccccgtcgctctcacgctcttcgtgcccgccgcctcccctcttcccctccacctcactcctcccgtctgacgcacatggcatccatcgccggatcttccgctctctccttcgccatgcctgtcaaggcaatcaactcaaattctctagccttctccccggtgaggaagggtaacacattcctccgcctgcaaccagtgcctatgagatctgtttcctgcgctgccaagaaggatacggtnggacaaggttttgtgaaattgtgaagaagcagcttgctcttcctgccacactgaaagtttgtggtgaatcgaaattctctgaacttggtgcggattcgctggacacggttgangattgtgatgggccttgaggagcacttcgacattnnccgtaagaggagtccagcgcgcagacnattgcccaccgttgaaagacgccgctgacctcattgacagnncttgtttgctgtggaaggcataggccgcatctcttctatcattgctacccacctcttngggtttccattgggctgaaaaaactttgtgatttctccc

SEQ ID NO: 16983 - DNA, 662 bp, Zea mays
  misc_feature: Ceres CLONE 1381488-F
  misc_feature: Translation starting site: 286
  misc_feature: SWISSPROT Homolog: EC 5.3.4.1 Protein disulfide-isomerase
  misc_feature (445)..(445): n is a, c, t, g, unknown, or other
  misc_feature (446)..(446): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
tccccgcggtggcggccgctctagaactagtggatcccccgggctgcaggaattcgcacgagaccattacctagaacatcctaatcgaaaagtggattgtactgttctcagtggattaatagaattggacgctggagatagacccgccggagaagatggcctgcccactgctcacagtagtctagtccctgcccaccaagtacggatctcatctcaccagctgcctgtgcagcagtccaattcctcttgctggagcataccagaagcagaatcgggtgagaggaaatgggatcaacaagaacgtctcatccatctttcccggtcctcctgctcttcctcctcgctaccgccgccgccgccggaagcaacaaggctgaggaggtggacgacctccagtaccttattgacaactccgaagacatcccacccaacgaccctgacgggnnctnnngggagggggggggnnnnnnnnnnaaactacaacgacgaccttctcttccaagatcaggaccaggacctcccagactacgagccgcagatcgacgagacccacgtcgtggtcctcaccgccgccaacttctcctccttcctcgccgccacccgccatggtcatggttgagttctacgccccctggtgtggccactgccgcgagctcgccccg

SEQ ID NO: 16984 - DNA, 665 bp, Zea mays
  misc_feature: Ceres CLONE 1381489-F
  misc_feature: Translation starting site: 317
  misc_feature (483)..(483): n is a, c, t, g, unknown, or other
  misc_feature (590)..(590): n is a, c, t, g, unknown, or other
  misc_feature (601)..(601): n is a, c, t, g, unknown, or other
  misc_feature (644)..(644): n is a, c, t, g, unknown, or other
cgcggtggcggccgctctagaactagtggatcccccgggctgcaggaattcgcacgagaccattacctagaacatcctaatcgaaaaccgtcaggctgtcactgtccccctcaccgccgccgtcctcgtcaccacacctcacccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctgctgcaagaaggtaacagcgcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccgncatcgtccgagttcgtcgccaccttcctcttcctctacatctccatcctcaccgatcatgaacgtctccaagtccacctccaagtgcgccaccgtcggcatccgggncatcgcctggntctttcggaggaatgatcttcgccctcgttaactgaccggcgnaatctacggcggacatttaaa

SEQ ID NO: 16985 - DNA, 612 bp, Zea mays
  misc_feature: Ceres CLONE 1381493-F
  misc_feature: Encodes the peptide sequence at SEQ ID NO. 16986
tccccgcggtggcggccgctctagaactagtggatcccccgggctgcaggaattcgcacgagaccattacctagaacatcctaatcgaaaaatctccctgactcgcctcgtcctccagatatcgggcgccagcttcacctccaccggcccggggtacctgtgcgtctccatcgtcgccgcctctcctccttcggacacgactgaccttccactggcgccgacgaacaaaacacataggaagaagctcaccgccaaacctcatccagatccagtcgctgccctccgaaggccgcatacggaacgtctcgtctcttcctttggatccggaggtcaactccatcacccccagcttcacctcccttagtccccctccgtccgctctcacccaccgcttctatatcgccacctctctcgttgtacaagaagacactgaggatctgcaggctttctggaatcacatgtcttgaggactatctgctggagaactaaactaggctcttgctcatactatgcatccagcagctaggaatgatggctgaatctctggaaccaactgtactcttagatgggaaccatagccggggggggtacaaaaagggctattatggtggg

SEQ ID NO: 16986 - protein, 28 aa, Zea mays
  misc_feature: Ceres CLONE 1381493-F
MMAESLEPTVLLDGNHSRGGYKKGYYGG

SEQ ID NO: 16987 - DNA, 662 bp, Zea mays
  misc_feature: Ceres CLONE 1381502-F
  misc_feature: Translation starting site: 229
  misc_feature: SWISSPROT Homolog: EC 2.4.1.207 Xyloglucan:xyloglucosyl transferase
  misc_feature (598)..(598): n is a, c, t, g, unknown, or other
  misc_feature (619)..(619): n is a, c, t, g, unknown, or other
tccccgcggtggcggccgctctagaactagtggatcccccgggctgcaggaattcgcacgagaccattacctagaacatcctaatcgaaaaaagttccttatccaccccccacaccaagcgcttcctcgcacctgacactagataatagctctactcacacgacgtgatatagagctgcctgattccccgcgctgaaagggcaacatgatacctgacgatgacggacgatgctcctgtctatcggcccgtgcgcgtggcctgccagcaagctggcggtgaccgcccacatctcgcacttctaccaggacacagagatgacctgggactacgaccgccagaagctagtggacggcctgcgccgcctggagctgacgctggaccgcacgtacgcgtccgggtctcccgtatgagagcgagtacctgttccccaagatcgacatgtcgatcaagctggtgtcagaccactctcgtgctacggtcaccacctctatacctgtcgtcccagcgctgacgcgcacgacgagatccgacttcgagttcctgctcaacgctgaagcaggtgagccctacacgctgcagccaccaacgtggttcacngcgcggacagtggccaggggngaagcagcagtttcccgccctctggggttcgacccctaccact

SEQ ID NO: 16988 - DNA, 693 bp, Zea mays
  misc_feature: Ceres CLONE 1381507-F
  misc_feature: Translation starting site: 453
  misc_feature (526)..(526): n is a, c, t, g, unknown, or other
  misc_feature (527)..(527): n is a, c, t, g, unknown, or other
  misc_feature (542)..(542): n is a, c, t, g, unknown, or other
  misc_feature (556)..(556): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (613)..(613): n is a, c, t, g, unknown, or other
  misc_feature (614)..(614): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
ggagctccccgcggtggcggccgctctagaactagtggatcccccgggctgcaggaattcgcacgagaccatttcctagaacatcctaatggaaaaaaggctttgctggtagttgtagcacacacggcacaccacacggtttcgtcctcgtccaccatgctatcgtcctcgcacctcgttaagcttgccccttcctgccgcgcggcctccttctcgtacctccccgcatccattcctcccgagcgggcgcgagagcaccgcggacgcagcaccctccacgccgccttcttccaagaagatgtcgtcgtccgcgcagcagcagcagcagcagcaagcgggcagcagcaaggcggagtcggcggagcttggcgcgcgtgttcgagctgttcgacaaagacggcgacgggcgcatcacgcgggaggagctggcggagtcgctgcgcaagctgggcatgggcgtgccgggcgacgacgagctggcgtccatgatggcgcgcgtggacccaacggcgacgggtgctacccnncggaaggagttcggngagtctaccgtctnaannnncccnnnnnnnnnnnnnnnnnnnnnnnnnnnnnnnnnnnnnnnnnnnnnccnnccccccccccttttnnnngaaggcccttcctccttgtggttcaacccccaacgcgggggacgggtacttttccaccgcc

SEQ ID NO: 16989 - DNA, 613 bp, Zea mays
  misc_feature: Ceres CLONE 1381510-F
  misc_feature: Translation starting site: 171
  misc_feature (613)..(613): n is a, c, t, g, unknown, or other
gagggaattcgcacgagaccattacctagaacatcctaatcgaaaaacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcgggcaggctggtatccaggtcggaaacgcgtgctgggagctgtactgcctcgagcatggcattcaggctgatggccagatgcccggtgacaagaccattgggggaggtgatgatgctttcaacaccttcttcagtgagactggcgctggggaagcacgtcccccgtgctggttttgttgaccttgagcccactggcatcgatgaggtgaggactggtacctaccgccagctcttccatcctgagcaggtcatcagtgggaagggaggatgcagccaacaacttcgctcgtggtcactacaccattggcaaggagattggttgacctgtgccttgaccgcatcaggaagcttgcagataattgcactggtctccagggcttcctcgtcttccaagctggtggagggaggaaaggccn

SEQ ID NO: 16990 - DNA, 647 bp, Zea mays
  misc_feature: Ceres CLONE 1381512-F
tccccgcggtggcggccgctctagaactagtggatcccccgggctgcaggaattcgcacgagaccattacctagaacatcctaatcgaaaaatttcgtcatcgctctgttcgggatcgtcaggagctcgcctggctgccgcgtcaccgatacccatgatccgcccgagggggaagcacgccgacgccgtcgctgtcgtctagggttccgataccttcctcatggattcgctgccgcggaagcgcaagggcgtgcgcgccttgtgctccctggacggatcccgcctcgatgcgcctggcgcccgcatgcgcacctgtcgcgagtcccgagcgcgctgcacccgagaagaagaatccctcttccgtacgatgagggctccgtcgtccgctcggcgaggtgtttaatttgcacggggaacccaatcttgccgcccgatccttcgcaaaatccaccgtacgtgcttgctgcccctgttccagtccagactctagacaatgctgtctgcgccgtggaatccgagcgttgccagctaattccgctcgggaacacgcacgaggagatccgccagttcgcaagaagcgatatccatccacggcgttgccctggctgctcgcgctccgccagcttccatgtcgaacacggagctgc

SEQ ID NO: 16991 - DNA, 656 bp, Zea mays
  misc_feature: Ceres CLONE 1381514-F
  misc_feature: Encodes the peptide sequence at SEQ ID NO. 16992
  misc_feature (1)..(1): n is a, c, t, g, unknown, or other
  misc_feature (515)..(515): n is a, c, t, g, unknown, or other
  misc_feature (518)..(518): n is a, c, t, g, unknown, or other
  misc_feature (608)..(608): n is a, c, t, g, unknown, or other
  misc_feature (614)..(614): n is a, c, t, g, unknown, or other
  misc_feature (630)..(630): n is a, c, t, g, unknown, or other
nggcggccgctctagaactagtggatcccccgggctgcaggaattcgcacgagaccattacctagaacatcctaatcgaaaagttttccaacacagcgaggcccacgttgtagggttttttgcttgcttcgcccggcggtaaagctgagcgcggcgagagccggagaccgaagaagcgccgcccgccgcgcgcccggtcatggagatcggacagtaccccgcgagcggctgctccaaggagcaccagaagatctaccaggagtggttcgcgctcgcggacgcagatggggatggccgcatcacgggccccgatgcgatcaagttttttggcatgtccaagctctcccgccctgacctcaagcaggtctgggctatcgcggacaccagaaggaggggtaatctgggtttctctgaattcgtcacggcgatgcagctagtctctctggcacaagcaggcaacgagattactcaagatagccttaagcgagatggattttgagcagtttgaaccctgntgnatggggaaaagggtttggatgccctacttgcgaaatctaagatttgggtgaaaaacgggtgttgatccaaaaatgggaatgggatatccntcaggnaacaatctcctttacnaaaaccaaaatggtttttagctcaaa

SEQ ID NO: 16992 - protein, 99 aa, Zea mays
  misc_feature: Ceres CLONE 1381514-F
  misc_feature: SWISSPROT Homolog: EC 2.7.11.1 Non-specific serine/threonine protein kinase
MEIGQYPASGCSKEHQKIYQEWFALADADGDGRITGPDAIKFFGMSKLSRPDLKQVWAIADTRRRGNLGFSEFVTAMQLVSLAQAGNEITQDSLKRDGF

SEQ ID NO: 16993 - DNA, 673 bp, Zea mays
  misc_feature: Ceres CLONE 1381521-F
  misc_feature: Translation starting site: 181
  misc_feature (544)..(544): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaacttagccgcgcggacgcccaccagcagctgccccttgctgtcgccgcctctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggccaaccctaggcagttcaaggtgccggactggttcctcaacaggaagaaggattacaaggatggaaggttctccacaggtcgtgtccaacgccctcgacatgaagctcagggacgacctcgagaggctcaagaagatcagaaaccaccgntggtctgcgtcactatgggggccttcccgtgttcgtggccagcacaccaagacactgggcaggcgtgaaaaaaaatttggttggtgtctccaagaagcgataagctacatatctatcgcnaattagatg

SEQ ID NO: 16994 - DNA, 733 bp, Zea mays
  misc_feature: Ceres CLONE 1381524-F
  misc_feature (1)..(1): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nccccccccccccccccccctcccccccccccccnttnnnnntttannnnaccaaaactggagctccaccgcggtggcggccgctctagaactagtggatcccccgggctgcaggaattcgcacgagaccattacctagaacatcctaatcgaaaattctcgatccctctacctctcgcatccggtgcctggctgccagccccagcgctcgccaacctcatcttccccggcgtttcctcctagctccctccaccatgccgctgccatggaactcactgctcggccgcgccctggccatgctccctgcgctcgccagccgtgcgcatctccctctgcgcgcgctcctacgtcctgcgccgcgaaccccgctgtggagcttccccgagctcgccccatggcgcccggccgagctcctccctgccgtgttcttgctcggcgtccagttttcctgtgtgccgcggtcttcctccccgagctcaccccagccccttgtattccccatggccggagcttcttccagctccagctcggctccctctcccatggctctctgcgcgctagccgctgtgcgcccatctatctctcgtggatctccctccccagctcctctctgctcgcgccgtcgcccagcctgttggcacacgcactcctctgtcgcacgctcctccaagtcagagctccctctgcccgttcccatggtcgcccctctctcagctccatcttcagctgctcc

SEQ ID NO: 16995 - DNA, 678 bp, Zea mays
  misc_feature: Ceres CLONE 1381526-F
  misc_feature: Encodes the peptide sequence at SEQ ID NO. 16996
  misc_feature (317)..(317): n is a, c, t, g, unknown, or other
  misc_feature (483)..(483): n is a, c, t, g, unknown, or other
cgcggtggcggccgctctataactagtggatcccccgggctgcaggaattcgcacgagaccattacctagaacatcctaatcgaaaaacagcgccaagggcaccaccagcaaggaccaagacagagcacagcgcagctcgtcggcctctcgacgccggttgctgcaaccaccgcctttattgcccacgcgggccgtgcggaagaagcaagaagacacgccaatggaggtcgccgcagcatcggcagcgggctacggattcaaggccgacgacgacgttgacagcctcagggcgacggagctcaggcttggcctgccnggcacggaggaggaggaggccgaggagtcccataacaaggcgccgccgccgtcgccgtcaacgcccagaggcaagaagcgcgacgtcgtcgccagaagcgggcccgaggatgcgccccaagaagcgggactgcgaaaccgaccccgaatgcccggccgccccccgnccgcccagggtcaactggtgggaatgccccgccgtggaggtcccaaaagaaaaaacttgttccacgagaaggggggggggccaagaaaaaacccggggaaaggcttgggggaaaaaaggccccgcccccccgcggggttttttttgggaaaggtgaaaatggcacgccccccccctccccccgggagggggggcc

SEQ ID NO: 16996 - protein, 152 aa, Zea mays
  misc_feature: Ceres CLONE 1381526-F
  misc_feature (88)..(88): Xaa is any aa, unknown, or other
MEVAAASAAGYGFKADDDVDSLRATELRLGLPGTEEEEAEESHNKAPPPSPSTPRGKKRDVVARSGPEDAPQEAGLRNRPRMPGRPPXAQGQLVGMPRRGGPKRKNLFHEKGGGPRKNPGKGLGEKRPRPPAGFFLGKVKMARPPPPPGRGG

SEQ ID NO: 16997 - DNA, 726 bp, Zea mays
  misc_feature: Ceres CLONE 1381529-F
  misc_feature: Encodes the peptide sequence at SEQ ID NO. 16998
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgccacgccacctacgggcagcagcagcagcagggaggaggcgggcgcccgatgggtgagcaggtgaagggcatgctccacgacaagggggccgacgggcgtcgcaaggcgctgaacggggggcgaagctttttcccccttggggcggcttggtgctggtggctttccggggtttgggccttaacggccccccgggggggggggttggcccgggcccaccccggggggtcccggaatcttcaacccccggggtggggccccgcccgggcgtggtaatcggggaacggcccggcatggggggttccccccccctccggggcgggctggggggttccggggggcctggccccccccaacagggggctccccaaaaaacggggggggggagggggttttcccggggcccccccgggaaataaaggggggaagggcgccccccccccgagaggggggggggaggcgcggggggccaacacggggacaaaa

SEQ ID NO: 16998 - protein, 33 aa, Zea mays
  misc_feature: Ceres CLONE 1381529-F
MADRDRSGIYGGATPPTGSSSSREEAGARWVSR

SEQ ID NO: 16999 - DNA, 684 bp, Zea mays
  misc_feature: Ceres CLONE 1381531-F
  misc_feature: Encodes the peptide sequence at SEQ ID NO. 17000
aagctggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcacgagggccccgtgaaggcgaagcaggcgctctactcgagggacctcgctcgcaacctgcgcttcgcctccaacttcgacctcttcaaggctgctgcgggcgactggcgcgacacgctcttcctgcgaggtggctccgaacccgcccgccgcgggaggagctgccggagccactc

SEQ ID NO: 17000 - protein, 125 aa, Zea mays
  misc_feature: Ceres CLONE 1381531-F
  misc_feature: SWISSPROT Homolog: EC 1.14.11.20 Desacetoxyvindoline 4-hydroxylase
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFTRAP

SEQ ID NO: 17001 - DNA, 665 bp, Zea mays
  misc_feature: Ceres CLONE 1381532-F
  misc_feature: Encodes the peptide sequence at SEQ ID NO. 17002
  misc_feature (561)..(561): n is a, c, t, g, unknown, or other
agagctggagctccccgcggtggcggccgctctagaactagtggatcccccgggctgcaggaattcgcacgagaccattacctagaacatcctaatcgaaaagaatcaaacacctcaagctcaacacacatggctgacaatgccggtctagtaggcctgctcttggagcagcaccagctgcgcccaccaccaccagcagcagcagcatcagcatcaagagcaccagctcaaatcacaagcaaggccactcgtcccctcctcctcgccaccgccaagaacgacgtcgtcgacgtccagaagggcgccagctccgccgccgcttccttcagccgcttttcttcttcttcttcccgtgcaccggcgccgacggtgtcgctgacgaccgcctgcccgttcctgcagcggtgcttcttctgccacggggagctctccgacggcagggacatatacatgtacagaggcgagaaggcgttctgcagcgaggagtgccgctgcccgcatatcctggcagaggaggacgatgacgacactactacctccgtccggggtcggggaaagggnaaggggattggttccacccagttccgccattagggcccttggtggccaagtttcacgtttttgaagggggggccccggcccaaagggcgggggggggataaaaa

SEQ ID NO: 17002 - protein, 154 aa, Zea mays
  misc_feature: Ceres CLONE 1381532-F
  misc_feature (75)..(132): Pfam Name: DUF581 Pfam Description: Protein of unknown function (DUF581)
MADNAGLVGLLLEQHQLRPPPPAAAASASRAPAQITSKATRPLLLATAKNDVVDVQKGASSAAASFSRFSSSSSRAPAPTVSLTTACPFLQRCFFCHGELSDGRDIYMYRGEKAFCSEECRCPHILAEEDDDDTTTSVRGRGKGKGIGSTQFRH

SEQ ID NO: 17003 - DNA, 768 bp, Zea mays
  misc_feature: Ceres CLONE 1381533-F
  misc_feature: Translation starting site: 250
  misc_feature (1)..(1): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (26)..(26): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nttccccccccccccccccnnnnngngggggggnnntntcccannnnnnnccaatgctggagctccccgcggtggcggccgctctagaactagtggatcccccgggctgcaggaattcgcacgagaccattacctagaacatcctaatcgaaaacttgccgccagccagcccattaaccctcgttcctgtcgcgcagccacgacctccacttccgcatcttccccggcggcggcgcggtcagttgaaccatggcggactccaaggccacctcggcggtcaccctccgcacccgcaagttcatgaccaaccgcctcctggcccgcaagcaattcgtgcttgaggtgatccacccccggccgcgccaacgtctccaaggcggagttgaagggagaggcttgccaagccgtacgaggtgaaggacccccaacaccatctttggcttcaagttccggacccacttcggaggaggaaagtccactggttttcgggcctcatctacgacaacctccaggctgccaagaagttcgagcccaaaataccgccctcatcaggaagggccttggctactagggtggagaaagcccgccaagcaaatgaaaggagcggaaaaacagggcccaaaaagatcccgggggggcaagaaaaaccaaaggctggtgacgcccaagaaagaaagtaaaccgtcccgcctaaactttttgcaatcactgggtcccggggggcccgggggggggggccaaacctggcaagaggtccataaatgtatc

SEQ ID NO: 17004 - DNA, 696 bp, Zea mays
  misc_feature: Ceres CLONE 1381534-F
tggagctccccgcggtggcggccgctctagaactagtggatcccccgggctgcaggaattcgcacgagaccattacctagaacatcctaatcgaaaaccaggcgtcgctctgtatttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctcctccatgaaccgtcttctccctcatccctgctcacctaacttttgcgggccgtcctccggaatcgtggaacgaaggtccttcgttgaggccccctggaattcggcagcccccaggaaccccgggacttgggggcggccgggcccggtcgtctttcctttccaggggggggtcaacgggccggtacatccatccggggggctccccctccggggttcatggtcccccccttgggggggattggggatcaatcctccccccaacctcccccgggaaaccggcccgaaggcccccggagcccccccggggtctccgttggggaaccgcccgcgcgcaacccccccggttgtcaatcccccaacgcccaggggccatggctctttcctcg

SEQ ID NO: 17005 - DNA, 705 bp, Zea mays
  misc_feature: Ceres CLONE 1381536-F
  misc_feature: Encodes the peptide sequence at SEQ ID NO. 17006
  misc_feature (350)..(350): n is a, c, t, g, unknown, or other
  misc_feature (381)..(381): n is a, c, t, g, unknown, or other
  misc_feature (705)..(705): n is a, c, t, g, unknown, or other
tccccgcggtggcggccgctctagaactagtggatcccccgggctgcaggaattcgcacgagaccattacctagaacatcctaatagaaaaaaagtaggaatggcgtcggcgagcatgctcgcgcgctcccttctccgcaccccagaccctacccaaacgagccacccgaaccgccggagcgccgctgtcgtctccttcccccgccgccaccgccgcctgtccgtgcgcgcctccgtctccacggcctccccttccccaccgccacagcccgcggcggcggctgccggcgtgccgaagcactgcttccggcgcggggccgatggctacctgtactgcgagggagtgcggntggaggacgcgatgacggctgccgagcgcanccccttctacctctacagcaagccacagatcctccgcaacttcgccgcctaccgcgatgctctccaggggctccgctccatcatcgggtatgccgtgaaggccaacaacaacctccccgtgctacgcgtcctgcgtgagcttggctgcggcgccgtcctcgtcagcgggaacgagctccgactcgccctccaggcgggattcgaccccggcaggtgcatatttaacggagatggggagaccctccgacatccttaaatagctgctgaggagggagggattggaaatggggatagcggatttgatttggagaatattggcagacn

SEQ ID NO: 17006 - protein, 178 aa, Zea mays
  misc_feature: Ceres CLONE 1381536-F
  misc_feature: SWISSPROT Homolog: EC 4.1.1.20 Diaminopimelate decarboxylase
  misc_feature (84)..(84): Xaa is any aa, unknown, or other
  misc_feature (94)..(94): Xaa is any aa, unknown, or other
MASASMLARSLLRTPDPTQTSHPNRRSAAVVSFPRRHRRLSVRASVSTASPSPPPQPAAAAAGVPKHCFRRGADGYLYCEGVRXEDAMTAAERXPFYLYSKPQILRNFAAYRDALQGLRSIIGYAVKANNNLPVLRVLRELGCGAVLVSGNELRLALQAGFDPGRCIFNGDGETLRHP

SEQ ID NO: 17007 - DNA, 733 bp, Zea mays
  misc_feature: Ceres CLONE 1381538-F
aagctggagctccccgcggtggcggccgctctagaactagtggatcccccgggctgcaggaattcgcacgagaccattacctagaacatcctaatcgaaaagttctctctccctccccctttcctctggtcatcgcacccgtctccccgctctgactccgcccgcgccgccgactcccggcacggccccccaggcttcatctccgccgccgccgtcgccgccgcctcgctccgatcgacccccgaaacgccggaaaccgtgggcttcgcgaggttgcctctcttcgtccagcggtagataacatacagtgcgacaggtgattgcagagagaaggggggggcatttggtcgctgcatggagggggcagggccccaatttcgctgggcatgattggtgggccatgacatgggggggatttcctggacatggcatactaccgggaagcctgggggagggctcaaaccatgtcgggagaacaacccttaatagaatggccgaccccgcacccatgggggggttccattggcaatgggctgggggaacaacaggaggcggtaggggtcctggggactccccatactaaggatggttcaaatcacccctgggccttcaaggggccctggccctttgggaaatttactccgggggggggggggaacaaaattttttccccccctggggaacggggtggttccacgccctttgaaaagaaacgaattcgccttgggcacaa

SEQ ID NO: 17008 - DNA, 730 bp, Zea mays
  misc_feature: Ceres CLONE 1381546-F
  misc_feature: Encodes the peptide sequence at SEQ ID NO. 17009
  misc_feature (451)..(451): n is a, c, t, g, unknown, or other
  misc_feature (452)..(452): n is a, c, t, g, unknown, or other
  misc_feature (466)..(466): n is a, c, t, g, unknown, or other
  misc_feature (472)..(472): n is a, c, t, g, unknown, or other
  misc_feature (478)..(478): n is a, c, t, g, unknown, or other
ggagctccccgcggtggcggccgctctagaactagtggatcccccgggctgcaggaattcgcacgagaccattacctagaacatcctaatcgaaaagtggattgtactgttctcagtggattaatagaattggacgctggagatagacccgccgtagaatatggcctgcccactgctcagagaagtctagtccctgcccaccaagtacggatctcatctcaccagctgcctgtgcagcagtccaattcctcttgctggagcataccataaccagaatcgtatgagaggaaatgtgatcaacaataacgtctcatccatctttcccggtcctcctgctcttcctcctcgctaccgccgccgccgccggaagcaacaaggctgaggaggaggactacctccagtaccttattgacaactccgaagacatcccacccaacgacgctgacggggnncctgggggggtcgntggtgntcaacntctactactaactatcttctcgttccgatgatccggacgagtacctcgccagaataggaagcctgatatcgctgggtccccccggcgtgggaccgttacgggccgggaacttctccttctgtcctccctccccatgcgtctatgcctggggggttgggccttacgccccccctggaagtggcccacccgcccaggggttccgcccccgggttacccccgggggggttgggggggaaatggggtggccccccc

SEQ ID NO: 17009 - protein, 37 aa, Zea mays
  misc_feature: Ceres CLONE 1381546-F
MPGGLGLTPPLEVAHPPRGSAPGLPPGGLGGKWGGPP

SEQ ID NO: 17010 - DNA, 673 bp, Zea mays
  misc_feature: Ceres CLONE 1381548-F
  misc_feature: Encodes the peptide sequence at SEQ ID NO. 17011
  misc_feature (389)..(389): n is a, c, t, g, unknown, or other
  misc_feature (514)..(514): n is a, c, t, g, unknown, or other
  misc_feature (673)..(673): n is a, c, t, g, unknown, or other
cgctctagaactagtggatcccccgggctgcaggaattcgcacgagaccattacctagaacatcctaatcgaaaaatcaaccatattattgagaccaacaagcaacatagaaggtggaatccagtaccaacaatagagcaacaatggcgaccaagatattttaccctccttatgcgtccttgctctgttctacatgtgttgctaacgcgacaattttccctcaatgctcacaagctcctatagcttcccttcttcccccataccttccatcaattatagcttacatatgtgaaaacccagctcttcaaccatataggcttcaacaagcaatcgcagcaagcaacatacctttatcgcccttgttgtttcaacaatcgacagccctatcnttggtgcagtcattggtacaaaccatcagggcacaacagctgcagcaactcgtgctacctctgatcacccagtagctctggcaaacctttctccctactctcagcagcaaacattttcttcattncaacccactggctaccctgaaccgtggcctgctatttgcaccaacaactattaccattttaccccgcttaggtaactggctaccccccacaaaaaaaaaatgcttccctttttaaccaattggcccccccttaaacccccgtttgtttaattggaagan

SEQ ID NO: 17011 - protein, 106 aa, Zea mays
  misc_feature: Ceres CLONE 1381548-F
MATKIFYPPYASLLCSTCVANATIFPQCSQAPIASLLPPYLPSIIAYICENPALQPYRLQQAIAASNIPLSPLLFQQSTALSLVQSLVQTIRAQQLQQLVLPLITQ

SEQ ID NO: 17012 - DNA, 722 bp, Zea mays
  misc_feature: Ceres CLONE 1381553-F
  misc_feature: Encodes the peptide sequence at SEQ ID NO. 17013
  misc_feature (202)..(202): n is a, c, t, g, unknown, or other
  misc_feature (543)..(543): n is a, c, t, g, unknown, or other
  misc_feature (657)..(657): n is a, c, t, g, unknown, or other
  misc_feature (686)..(686): n is a, c, t, g, unknown, or other
  misc_feature (717)..(717): n is a, c, t, g, unknown, or other
  misc_feature (718)..(718): n is a, c, t, g, unknown, or other
aagctggagctccccgcggtggcggccgctctagaactagtggatcccccgggctgcaggaattcgcacgagaccattacctagaacatcctaatcgaaaaagatcttgatccgttcctgttcctgttcctgctgctaactgctggttgctggggccgtgtacgtacgcgttgatgaagggaccgtgcgaaagggagcgcancaatgccggaccgtgaccgcagaggcatctagggcggcgtccacgccacctaagggcagcagtagaagtagggaggaggcgggcgcccgatgggtgaacaggtgaagagcatgctccactacaaggggtcgatggcgtctcacgcgctgacggtggtgacgctgttcccgctgcgcgggatgctgctggtgctgtctgagatgacgctgacggcctccgtgatgagactgggcgtggccacgacgctgttcctgatcttcagccgcgtgctcggtcccgtcgagctgctcatcgggacggacgtcatggggttcctcacgtcgggcgcgctggtgctcggngggctgtcctcgctcacgtgcctcggcaacaatgcgtgggaggagttccagcgcaccccggactacctggaagatgctcaccgcatgatggcggaggccgttactacctctgcnctcaacaacttctaggttctgccttgacnctccaattggcctattgtatgaatgagccgnncccg

SEQ ID NO: 17013 - protein, 126 aa, Zea mays
  misc_feature: Ceres CLONE 1381553-F
  misc_feature (15)..(126): Pfam Name: Oleosin Pfam Description: Oleosin
MGEQVKSMLHYKGSMASHALTVVTLFPLRGMLLVLSEMTLTASVMRLGVATTLFLIFSRVLGPVELLIGTDVMGFLTSGALVLGGLSSLTCLGNNAWEEFQRTPDYLEDAHRMMAEAVTTSALNNF

SEQ ID NO: 17014 - DNA, 734 bp, Zea mays
  misc_feature: Ceres CLONE 1381558-F
  misc_feature: SWISSPROT Homolog: EC 3.1.3.16 Phosphoprotein phosphatase
tggagctccccgcggtggcggccgctctagaactagtggatcccccgggctgcaggaattcgcacgagaccattacctagaacatcctaatcgaaaaaaaagatcgcgaagcgagagggaatgatggaggcataggcactaggacctcctcgcctccacctccgtcctcttcgatcccgtccaatcccccgcgccccggagcccctctccgccggaggctttgatgggtcccgggctcctcctcctcctaggctgttctggttggggctgcggcgcagggaactagggaaggtgaaggaaaggcgaggtttgaggtagagcgcagcggctgcgacagcagcgatgccatcacacgcgtatctgcaccgccagatctcgcagctgcgagagtgcaagttcctgcctgagggcgtaggacaaaacgctatgggagcaggcctaggctcatctcatgggaggagggaacgtgcagcccgtgcgctagcccgtcactggctgcgggggacctccacgggcagttccacggacctcatcgaggtcccttcggatgggggggcgaagctcccagaaccaattaccttctttagggggggagtaccttgagcgggggcttaacaggcaggaggggaggggggccccttatggggggttcctaaaatacggggccaagggagggaaacccaaattttgggggggggaaatgggggggaaaccaataatctcggggggggggg

SEQ ID NO: 17015 - DNA, 716 bp, Zea mays
  misc_feature: Ceres CLONE 1381559-F
  misc_feature: Encodes the peptide sequence at SEQ ID NO. 17016
  misc_feature (429)..(429): n is a, c, t, g, unknown, or other
ggagctccccgcggtggcggccgctctagaactagtggatcccccgggctgcaggaattcgcacgagaccattacctagaacatcctaatcgaaaaatcgcttcagctcggagtcttcacaaacgccggcgcaaactctcgcccgaggccgacagatctctaattccccataccggccaccggtcgaccttcacgccagtctcggtctcttccgaaggcgtcgcgcgcgcttgtttgacaggagaggaggaagatgagggagtgcatctccgtccacatcgggcagggcggcatccaagacggcaacgcgtgctgggaactttactgcctcgagcacggcatccagcctgatggccaagtgcctggagataagaccgcgggacatcacgatgatgccttcagcaccttcttcagccagactggtgtggntaagcacgttccccgtgcaatcttcgttgatctagaacccactgtgatcgatgaggtgcgcactggcacgtaccgccagctcttccaccctgagcagctcatcagtggcaaggaggatgccgctaacaatttcgcccgtggccactacacaattggcaaggagattgttgatctgtggcttgaccgtatccgcaagcttgctgacaactgcaccggcctccagggcttcctggtcttcaatgccggtggtggtggcactggctctgggcttgggtctctcctccttg

SEQ ID NO: 17016 - protein, 154 aa, Zea mays
  misc_feature: Ceres CLONE 1381559-F
  misc_feature (49)..(154): Pfam Name: Tubulin Pfam Description: Tubulin/FtsZ family, GTPase domain
  misc_feature (59)..(59): Xaa is any aa, unknown, or other
MRECISVHIGQGGIQDGNACWELYCLEHGIQPDGQVPGDKTAGHHDDAFSTFFSQTGVXKHVPRAIFVDLEPTVIDEVRTGTYRQLFHPEQLISGKEDAANNFARGHYTIGKEIVDLWLDRIRKLADNCTGLQGFLVFNAGGGGTGSGLGSLLL

SEQ ID NO: 17017 - DNA, 702 bp, Zea mays
  misc_feature: Ceres CLONE 1381561-F
  misc_feature: Encodes the peptide sequence at SEQ ID NO. 17018
tccccgcggtggcggccgctctagaactagtggatcccccgggctgcaggaattcgcacgagaccattacctagaacatcctaatcgaaaactcttctccaaaccccactcaccgcaacgagccgccggatccatggccggcaaagacggctccgtcccttccccgcctcctccccggctcccatcctaccctgagatgatcgtggaggcaatccgggcgctgggactcgagaacggctgcaacaagactgcgatctcggactacatcaagggcagctacggctccgacctccctgcccagcacaacggcgtcctcacgggccacctcgcccgcatgaaggctaccggtgagctcgccttcctcaggaggaacgatctcctccccaacgaggacgaagcctccccgctgagcaccggtgggcacaagggccccggcgccgccgaggagtctactggcgtgttggacgttggtgacgatgatgtgcttgcttcccctctcgtcatcgacgctgacgccgtcgacagtgacgtggctgctccagctcccgttggcacggctgatgtcgacgacgttgacgtgcttgctccagcttcccgtgtcagcgctgatggcaaccctggtcataccagggggggatccggacggcccccgaggccaagggaccccggtgctgagggctacgggggtaaggccggtacggg

SEQ ID NO: 17018 - protein, 189 aa, Zea mays
  misc_feature: Ceres CLONE 1381561-F
  misc_feature (15)..(85): Pfam Name: Linker_histone Pfam Description: linker histone H1 and H5 family
MAGKDGSVPSPPPPRLPSYPEMIVEAIRALGLENGCNKTAISDYIKGSYGSDLPAQHNGVLTGHLARMKATGELAFLRRNDLLPNEDEASPLSTGGHKGPGAAEESTGVLDVGDDDVLASPLVIDADAVDSDVAAPAPVGTADVDDVDVLAPASRVSADGNPGHTRGGSGRPPRPRDPGAEGYGGKAGT

SEQ ID NO: 17019 - DNA, 721 bp, Zea mays
  misc_feature: Ceres CLONE 1381563-F
  misc_feature: Encodes the peptide sequence at SEQ ID NO. 17020
  misc_feature (586)..(586): n is a, c, t, g, unknown, or other
  misc_feature (619)..(619): n is a, c, t, g, unknown, or other
tccccgcggtggcggccgctctagaactagtggatcccccgggctgcaggaattcgcacgagaccattacctagaacatcctaatcgaaaactctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctgttgcattctactttggagctcgttttggatttgacaaagatgccaggagaaggctcttcnacatgattaacaacctgcccactgtttatgaangtgtgacgggggttgctaagaagcaatcgagagcccccaacggcagcagcaaaagcagcaaggctaactctaaaccatcaaactggaccaatctaccagtag

SEQ ID NO: 17020 - protein, 175 aa, Zea mays
  misc_feature: Ceres CLONE 1381563-F
  misc_feature (131)..(131): Xaa is any aa, unknown, or other
  misc_feature (142)..(142): Xaa is any aa, unknown, or other
MDGDGGGAGALHHHTRSPEDVFRDFRARRAGIVKALTTDVEKFYQQCDPEKENLCLYGLPNETWEVTLPAEEVPPELPEPALGINFARDGMVEKDWLSLVAVHSDAWLLSVAFYFGARFGFDKDARRRLFXMINNLPTVYEXVTGVAKKQSRAPNGSSKSSKANSKPSNWTNLPV

SEQ ID NO: 17021 - DNA, 641 bp, Zea mays
  misc_feature: Ceres CLONE 1381565-F
  misc_feature: Encodes the peptide sequence at SEQ ID NO. 17022
tggagctccccgcggtggcggccgctctagaactagtggatcccccgggctgcaggaattcgcacgagaccattacctagaacatcctaatcgaaaaaatcacgaatcaccaacaccctctcctccaccttccatcccgatcaccgccgccaccgctttcgttccacgtgccgatggcaccggtagatctaacccccaggcagtcccggaaggcgtatggtggggacgccggcgcctactacgagtggagcccagacgacctgcccatgctcggcgtcgcctccatcggagcagccaagctctccctcgccgccggagggctctcgctccccagctactccgactcttccaaggtcgcgtactttcttgaaggcactggcacctgcgtcatcgtcctgccggaggcgaccaaggagaaggtgctggacgtgaaggagggcgacgtcctcgcgctccccttcggcgtggtcacgtggtggcacaacgggcccgccgcgccgacccagctcacggtcctcttcctcggcgacacctccaagggacacaggccggggcagctcaccaactttcagctgacgggcgcgaacggtatcttcacgggcttctccaccgagttcgggtctcgcgcgtgggaactgccg

SEQ ID NO: 17022 - protein, 156 aa, Zea mays
  misc_feature: Ceres CLONE 1381565-F
  misc_feature (6)..(140): Pfam Name: Cupin_1 Pfam Description: Cupin
MAPVDLTPRQSRKAYGGDAGAYYEWSPDDLPMLGVASIGAAKLSLAAGGLSLPSYSDSSKVAYFLEGTGTCVIVLPEATKEKVLDVKEGDVLALPFGVVTWWHNGPAAPTQLTVLFLGDTSKGHRPGQLTNFQLTGANGIFTGFSTEFGSRAWELP

SEQ ID NO: 17023 - DNA, 714 bp, Zea mays
  misc_feature: Ceres CLONE 1381568-F
  misc_feature: Encodes the peptide sequence at SEQ ID NO. 17024
  misc_feature (624)..(624): n is a, c, t, g, unknown, or other
  misc_feature (660)..(660): n is a, c, t, g, unknown, or other
  misc_feature (673)..(673): n is a, c, t, g, unknown, or other
cgctctagaactagtggatcccccgggctgcaggaattcgcacgagaccattacctagaacatcataatcgaaaaacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcaaacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaaaaccaatgatctagctggagatgggacaaccacctctgtggtccttgctcaggggctgatcgctgagggtgttaaggttgtggcagctggtgctaatcctgttcagattacntcgtgtatcgagaaacagcgaaagcactaggtgagnaactacggaggtngtctaaggaggtctaagaagtgagcttgcagatgttgctgc

SEQ ID NO: 17024 - protein, 160 aa, Zea mays
  misc_feature: Ceres CLONE 1381568-F
MASTFGATSTVGLMAAPTGKNVRLQRRVNFRVRAAKELYFNKDGSAIKKLQTGVNKLANLVGVTLGPKGRNVVLESKYGSPKIVNDGVTVAREVELEDPVENIGAKLVRQAAAKTNDLAGDGTTTSVVLAQGLIAEGVKVVAAGANPVQITSCIEKQRKH

SEQ ID NO: 17025 - DNA, 722 bp, Zea mays
  misc_feature: Ceres CLONE 1381574-F
  misc_feature: Encodes the peptide sequence at SEQ ID NO. 17026
  misc_feature (616)..(616): n is a, c, t, g, unknown, or other
tccccgcggtggcggccgctctagaactagtggatcccccgggctgcaggaattcgcacgagaccattacctagaacatcctaatcgaaaaattttccactttccactctgcctccgctgccgatcgccgtccccgaccgcagcgcaggactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaacggggggggttagggttgatcgagtcctttactcatcagttgtataccctcacaattatggtttcattccaaggactctttgtgaagacaatgacccaatggatgtgttggtcctgatgcaggagcctgttgttcctggttcgttcctgagagctagagcaattggccttatgcccatgattgaccagggtgaaaaggatgacaagataatagcagtatgtgctgatgatcctgaataccgtcactacnacgacatcagcgagctgtctcctccacgcctgcaggagatcaggcgcttctttgaggatacaggaaaacgagaaccaagaagcgcagttgatgcattcttgcccgc

SEQ ID NO: 17026 - protein, 188 aa, Zea mays
  misc_feature: Ceres CLONE 1381574-F
  misc_feature (52)..(188): Pfam Name: Pyrophosphatase Pfam Description: Inorganic pyrophosphatase
  misc_feature: SWISSPROT Homolog: EC 3.6.1.1 Inorganic diphosphatase
  misc_feature (154)..(154): Xaa is any aa, unknown, or other
MSEEDKAAASAEQPKRAPKLNERILSSLSRRSVAAHPWHDLEIGPGAPAVFNVVVEITKGSKVKYELDKKTGGVRVDRVLYSSVVYPHNYGFIPRTLCEDNDPMDVLVLMQEPVVPGSFLRARAIGLMPMIDQGEKDDKIIAVCADDPEYRHYXDISELSPPRLQEIRRFFEDTGKREPRSAVDAFLP

SEQ ID NO: 17027 - DNA, 723 bp, Zea mays
  misc_feature: Ceres CLONE 1381577-F
  misc_feature: Encodes the peptide sequence at SEQ ID NO. 17028
  misc_feature (326)..(326): n is a, c, t, g, unknown, or other
  misc_feature (327)..(327): n is a, c, t, g, unknown, or other
  misc_feature (351)..(351): n is a, c, t, g, unknown, or other
  misc_feature (356)..(356): n is a, c, t, g, unknown, or other
  misc_feature (396)..(396): n is a, c, t, g, unknown, or other
tggagctccccgcggtggcggccgctctagaactagtggatcccccgggctgcaggaattcgcacgagaccattacctagaacatcctaatcgaaaaacggccaatgcaattgcagttgcagttgcaattgcacggcacccatttccagagccgtcctcaattagctagacaaatctcgctatcctttccccaccatccagatcttccctttcatggacgccgtcgtctccaccctcaccgctctcgccatcttcgcgagcaccgtcgagcacgccgcctacaggagcgtgcaggggtatagggtgatcgtgaggaaaggcggcgnntggctccgttggaagagtaggtgnagcgntagttcgtcctctccctctccttcccacgggcgtctaggntgccctgcccgccgtcgctgcgagaatatgtcagtgggtggcacagcccggcggggttccgccagggacaaacgtcgacacttggcgtggatgggggaattccatccgaggcggcgggggtcggtcttccggggggggcggggtttccccccttggggaacaaaaggggggaattggcaaaactgaaaagaggccggcgaagagggttcccttccccaaaaaaaaagggccccaaccttgtttttaaaaaaccccccctctttgggggaaaagggaaaaattttttttgtgggggcccccccaccccctattggggggggggggccc

SEQ ID NO: 17028 - protein, 122 aa, Zea mays
  misc_feature: Ceres CLONE 1381577-F
  misc_feature (38)..(38): Xaa is any aa, unknown, or other
  misc_feature (46)..(46): Xaa is any aa, unknown, or other
  misc_feature (48)..(48): Xaa is any aa, unknown, or other
MDAVVSTLTALAIFASTVEHAAYRSVQGYRVIVRKGGXWLRWKSRXSXSSSSPSPSHGRLGCPARRRCENMSVGGTARRGSARDKRRHLAWMGEFHPRRRGSVFRGGRGFPPWGTKGGNWQN

SEQ ID NO: 17029 - DNA, 668 bp, Zea mays
  misc_feature: Ceres CLONE 1381578-F
  misc_feature: Encodes the peptide sequence at SEQ ID NO. 17030
  misc_feature (287)..(287): n is a, c, t, g, unknown, or other
  misc_feature (555)..(555): n is a, c, t, g, unknown, or other
  misc_feature (622)..(622): n is a, c, t, g, unknown, or other
  misc_feature (624)..(624): n is a, c, t, g, unknown, or other
aagctggagctccccgcggtggcggccgctctagaactagtggatcccccgggctgcaggaattcgcacgagaccattacctagaacatcctaatcgaaaatttgcacttctcgccttctctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaaggacgtcnttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctagttgcagttcatagtgatgcatggctcctgtctngtgcattctactttggagctcgttttggatttgacaaagatgccaggagaaagctcttcaccatgantnaacacctgccccactgttatgaaagtgtgacgggggttgctaaa

SEQ ID NO: 17030 - protein, 58 aa, Zea mays
  misc_feature: Ceres CLONE 1381578-F
  misc_feature (21)..(21): Xaa is any aa, unknown, or other
  misc_feature (43)..(43): Xaa is any aa, unknown, or other
  misc_feature (44)..(44): Xaa is any aa, unknown, or other
MVEKDWLSLVAVHSDAWLLSXAFYFGARFGFDKDARRKLFTMXXHLPHCYESVTGVAK

SEQ ID NO: 17031 - DNA, 736 bp, Zea mays
  misc_feature: Ceres CLONE 1381581-F
  misc_feature: Translation starting site: 193
  misc_feature (303)..(303): n is a, c, t, g, unknown, or other
  misc_feature (320)..(320): n is a, c, t, g, unknown, or other
  misc_feature (409)..(409): n is a, c, t, g, unknown, or other
  misc_feature (465)..(465): n is a, c, t, g, unknown, or other
  misc_feature (478)..(478): n is a, c, t, g, unknown, or other
  misc_feature (595)..(595): n is a, c, t, g, unknown, or other
  misc_feature (596)..(596): n is a, c, t, g, unknown, or other
tggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggncagggctccggcatggncttcagcaagctgaccggcggcggcccgacgaccccggcgggcctgatcgcggcggcggtggcgcacgcgttcgcgctggtcgtggcgntgtctgtgggcgcgaacatctcgggcaggcacgtgaaacctggcggtgacttcggnggccttcgtgggngggaacatcaccctggtccggggcctctgaactgggtggggccaatttctggggtccaccgggggggggtttctggtcccctttcccaaggggggggaagggccagggcacctttcnnttttaaggggttgcctttgtggaaaggcctttggtctgaaaaaccaaaaaacccttccgggtgggggaaacccgggaaaccccccgggggggggccccaaaaaaaggggactgggggggcccatcccccccttttgttgt

SEQ ID NO: 17032 - DNA, 711 bp, Zea mays
  misc_feature: Ceres CLONE 1381586-F
  misc_feature (174)..(174): n is a, c, t, g, unknown, or other
  misc_feature (208)..(208): n is a, c, t, g, unknown, or other
  misc_feature (272)..(272): n is a, c, t, g, unknown, or other
  misc_feature (399)..(399): n is a, c, t, g, unknown, or other
  misc_feature (400)..(400): n is a, c, t, g, unknown, or other
  misc_feature (402)..(402): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (471)..(471): n is a, c, t, g, unknown, or other
  misc_feature (682)..(682): n is a, c, t, g, unknown, or other
  misc_feature (711)..(711): n is a, c, t, g, unknown, or other
aaagctggagctccccgcggtggcggccgctctagaactagtggatcccccgggctgcaggaattcgcacgagaccattacctagaacatcctaatcgaaaaatcttgccccactccgcagtgaccttgggtggttcttatttttagacgacacccctacccgacccgatgggngggagagcacgagacgccagcgccatccatcgcnggaaaagccgagacgacccaggaatctcggcaccgtcgtccccctttctctctcgctcaaaagntgctgctgggagccctcctcccctctctgccgagcacgaaccatggatgaaggtttagtttgtggagtcaaaggatggaaccctctctttttttttcccccccccccggggggaaagaaagggggtnnanacnnnnnttcccaaatttttgcccaacccatggagaaaaacattatcccggcgggggggggggggacgnaggtcccttcggaggaattgcccgcctggaagagccaaaaaaaaatccgccgcccaccccgggggtcgaaggggcccggccccaccggggcagggtggaaaaaattgcgggcataagaggcctgccaacgcactggggaaaggaggaggggtcgcacggcggagagctacgcccgccaccggcgcgcgggggcgcgcggggcgcttctaanattttcccccccccccaccccgacaaaan

SEQ ID NO: 17033 - DNA, 687 bp, Zea mays
  misc_feature: Ceres CLONE 1381589-F
  misc_feature: Translation starting site: 210
  misc_feature (499)..(499): n is a, c, t, g, unknown, or other
ggagctccccgcggtggcggccgctctagaatagtggatcccccgggctgcaggaattcgcacgagaccattacctagaacatcctaatcgaaaaaactcctacctacgcagcagaggccagccacctccccgtcgctctcacgctcttcgtggccgccgcctctcctccgtctctgcctctctccctctcccctcccgtctgacgcacatgggctccatcgccggatcttcggtcctctccttcgccagggccgtcaaggcaatcaacacaaattctctagctttctccccggcgaggaagggcaacacattcctccgcctgcaaccaatgcctatgagatctgtttcctgcgctgccaagaaggatactacagacgaggttttgtgagattgtgaagaagcagcttgctcttcctgagcatactgaagtttgcgtgaatccaaattctctgaactcggcgcaattcactggaacgggtgaaaaggtgatgagtctcnagagcacttcgaattagggggggaggatgcagcgcacaaacaatcgcacagttgaagacgccggcggactcatcaacaagcttgtgcctggcaagcggtaatctggacctcttccatccgtggctaccatctagggctatccctggagctaagttccatgggctaaagattgggatttcccccccatg

SEQ ID NO: 17034 - DNA, 687 bp, Zea mays
  misc_feature: Ceres CLONE 1381590-F
  misc_feature (426)..(426): n is a, c, t, g, unknown, or other
  misc_feature (454)..(454): n is a, c, t, g, unknown, or other
aaagctggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcaggtaccctttggtgcatttattgncacaaaacatcagggcacaacaactacnacaacttgtgctagcaaaacttgctggctactctcacgaacaggagtttcttccatttaaccaactaagtggattgaactctggttcttatttggaacaaaaaaaataccattcagccggttacctgttggcaacccccagaatttcttccatttaacaattgggaaattgaaacccccccggttttttccgggggaaaaaaatataacctttcccccctttattggggggac

SEQ ID NO: 17035 - DNA, 706 bp, Zea mays
  misc_feature: Ceres CLONE 1381592-F
  misc_feature: Encodes the peptide sequence at SEQ ID NO. 17036
tggagctccccgcggtggggggcggtctagaactagtgggtcccccggggtggagggaattcgcaggagacctttaccaaaaacttcctaatcgaaaagttggtggattcctcatgcataatgaacttgactaccttgttggagctgttgccaacccaaagaagccatttgccgctattgttggaggatccgaggtctcaagtaagattggtgtcattgagtcgttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagccgatgctgagagcaagattgtccctgccactgctatccctgatgactggatgggtcttgatgttggccctgatgccacgaaaaccttcaacgaagcattggacaccaccaagactgttattttgaacggcccatgggagtgtttgagttcgagaagtttgcagctggaactgaggcgattgccagaagctagctgagctttacaccacgagggtgtcactaccatcatcggcggcggcgactctgtcgctgctgtcgagaagggctggctggcgacagatga

SEQ ID NO: 17036 - protein, 205 aa, Zea mays
  misc_feature: Ceres CLONE 1381592-F
  misc_feature (1)..(205): Pfam Name: PGK Pfam Description: Phosphoglycerate kinase
  misc_feature: SWISSPROT Homolog: EC 2.7.2.3 Phosphoglycerate kinase
ELPAVGGGLELVGPPGWREFAGDLYQKLPNRKVGGFLMHNELDYLVGAVANPKKPFAAIVGGSEVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVILNGPWECLSSRSLQLELRRLPEAS

SEQ ID NO: 17037 - DNA, 710 bp, Zea mays
  misc_feature: Ceres CLONE 1381593-F
  misc_feature: Encodes the peptide sequence at SEQ ID NO. 17038
ggagctccccgcggtggcggccgctctagaactagtggatcccccgggctgcaggaattcgcacgagaccattacctagaacatcctaatcgaaaaatcgcttgtttgctgctgccttttcctttccgccgcggcaaaagtgaggagcgcgcgggcgagttgggggagacgaacccgtcataactccttcgcttaatcgcgtctcgtgctcctgcctcctgcgtatataaacgcgccaatcgcgacgcccggggaggcgttcgttctccttctccatcccacgcggcgcgcagtccaagggccggatcggcggcctctcagatctcgccggccgccgtgagacagagaccgaaaggggggttgaccggtgctccggaggaagatggttaccgggacccaccaaaagtgcaaggggtgccccaagacggtggaccccgatggaccagctctcccccgaggggggcgtctttccaccgctccctgcttcaaggggccagcaactggaaggtctacccctccccctgagcaaactattccctcggttccgaaggggggcccgtacttgaaagacccattttcaagcaggttggttccaggaagacccgggaaggtaaaaacaagaagctttccaaattcacgggccccccggcaaaggaatacactcccggaaaaagggggggccccttggaggttggacaaaaataccccaa

SEQ ID NO: 17038 - protein, 109 aa, Zea mays
  misc_feature: Ceres CLONE 1381593-F
MVTGTHQKCKGCPKTVDPDGPALPRGGRLSTAPCFKGPATGRSTPPPEQTIPSVPKGGPYLKDPFSSRLVPGRPGKVKTRSFPNSRAPRQRNTLPEKGGAPWRLDKNTP

SEQ ID NO: 17039 - DNA, 527 bp, Zea mays
  misc_feature: Ceres CLONE 1381594-F
  misc_feature (527)..(527): n is a, c, t, g, unknown, or other
aaagctggagctccccgcggtggcggccgctctagaactagtggatcccccgggctgcaggaattcgcacgagaccattacctagaacatcctaatcgaaaaaaccgcacacgcacgcacgaacgcgctcccaccccctcccgccgcaaacgccggcaaaaccccggtccgactcggcgacctccgcaacctcctcctgggcagcgccggcggggtgatatggcatcggaggacgtgggggcaagagcaggggcgaacgtcggcacacatcgtcaactggagaagagccagctcggggggaggggtcaggggccgggcacaaatctcacatctggagccctccccccgaggccacaaggggggggccccactgcggtgcccccttgacggttgaaaattgttccgggtcaaaacccggcaccctaagaaacaagggaggggtcagggcccccaaagaatttggggaaaaaaagggccccccgggatttttttagggggggggagcccaaggggggaggagatttttn

SEQ ID NO: 17040 - DNA, 759 bp, Zea mays
  misc_feature: Ceres CLONE 1381599-F
  misc_feature: Encodes the peptide sequence at SEQ ID NO. 17041
  misc_feature (361)..(361): n is a, c, t, g, unknown, or other
  misc_feature (740)..(740): n is a, c, t, g, unknown, or other
  misc_feature (743)..(743): n is a, c, t, g, unknown, or other
  misc_feature (748)..(748): n is a, c, t, g, unknown, or other
  misc_feature (749)..(749): n is a, c, t, g, unknown, or other
ggagctccccgcggtggcggccgctctagaactagtggatcccccgggctgcaggaattcgcacgagaccattacctagaacatcctaatcgaaaaactgcgactgtgagcttcgttcgttcagttcatccgtgttcttgtttgcgaggtccagagagagaggatgtcgtgctgcggaggcaactgtgggtgcggctccggctgcaagtgcggcaacggctgcggagggtgcagcaagatgtacccggacatggctgagcaggtgaccaccaccacccaggctctcatcatgggtgtcgcaccatccaaggggcacgccgagggcgggttcgaggcggccacgggagctgaaaacgcccgntgcaaatgcggcgggaactggcagtgcgacccctgcactggggaagggagctaggtgttcaccctgcagggcgggcggagggaactagctaattattataggctaaataaggataagcggcccccttgggggggtttccaggcaaccccccgtttaattcggggccagggtgggatggctttgatcctgaaataataataacccctaggggggggcccggggccggaaacccccccctgccccccggggctttttgggggaagaaaaggtggttttttattttttgtgtggggaaaaacaaaaaaaaaaaaacaccggggccccgtgggggggttggccccccccccccataaaactttttttttctaaaaaagggaanganagaanncggcgggggg

SEQ ID NO: 17041 - protein, 83 aa, Zea mays
  misc_feature: Ceres CLONE 1381599-F
  misc_feature (1)..(80): Pfam Name: Metallothio_2 Pfam Description: Metallothionein
MSCCGGNCGCGSGCKCGNGCGGCSKMYPDMAEQVTTTTQALIMGVAPSKGHAEGGFEAATGAENARCKCGGNWQCDPCTGEGS

SEQ ID NO: 17042 - DNA, 716 bp, Zea mays
  misc_feature: Ceres CLONE 1381600-F
  misc_feature: Encodes the peptide sequence at SEQ ID NO. 17043
  misc_feature (367)..(367): n is a, c, t, g, unknown, or other
  misc_feature (392)..(392): n is a, c, t, g, unknown, or other
tggagctccccgcggtggcggccgctctagaactagtggatcccccgggctgcaggaattcgcacgagaccattacctagaacatcctaatcgaagaatcttctctttctccgtcccctcccaacacgcgttccccaaattctcccaccctactagaaatccccatatccgcggcggcgccgtccatcggattcgatcctcctagcgagtcgactccatctgatcggcggagccggggcaccagccaccatgtgggcggcatcgtgcctggcgtcgtgctgcgcggcgtgcgcgtgcgaggcgtgccggacggcggtcgggagcatcggacgccgctccgcccgcatcgcctactgtggtctcttcncgctctccctcttcgcatcctgggngctccgcgaggtcgacgcgcccctcctccagtcgatcccatggattacacacttccacaagacccccgaccgcgagtggttcgagaccgacgcggtgctcagggtcagcctcggcaacttcctcttcttcagcatcctcgccgtcatcatggtcgggataaggaccagaaggacccccgtgacagcatcacacggcggatgtatggccagatcatctgctgggcatcatcgtctcctcatgtttctcgtgcccaacgtgggcgcagctctatgatctatatcaagttgggtctggctggtcttctcgtcagatgtctgctgtgg

SEQ ID NO: 17043 - protein, 138 aa, Zea mays
  misc_feature: Ceres CLONE 1381600-F
  misc_feature (40)..(40): Xaa is any aa, unknown, or other
  misc_feature (48)..(48): Xaa is any aa, unknown, or other
MWAASCLASCCAACACEACRTAVGSIGRRSARIAYCGLFXLSLFASWXLREVDAPLLQSIPWITHFHKTPDREWFETDAVLRVSLGNFLFFSILAVIMVGIRTRRTPVTASHGGCMARSSAGHHRLLMFLVPNVGAAL

SEQ ID NO: 17044 - DNA, 667 bp, Zea mays
  misc_feature: Ceres CLONE 1381603-F
  misc_feature (329)..(329): n is a, c, t, g, unknown, or other
  misc_feature (330)..(330): n is a, c, t, g, unknown, or other
  misc_feature (431)..(431): n is a, c, t, g, unknown, or other
aagctggagctccccgcggtggcggccgctctagaactagtggatcccccgggctgcaggaattcgcacgagaccattacctagaacatcctaatcgaagaattcactcctccctctgcctgtattcttcgtttcgcccctgggatcctcgtcacgactcacgccatccgcccccaccgccaccaccagccacaccatctctgttctccagtcacgccagacggccagaacccaaattttcatcacaccaaaccatccactcctcacctttccccccaaacagtccaatctttacacgacattgtcgcaactacaaccccctttccttnnctggtgctcaccagattacccactcaaaatcagcttaccaagcacaaaagctgcgggatttgccatactggttcatccgcggacccaaatcttgccggccngatcttcgcaaatccaccgtacgtgcttgcttgccctggtccagtccagactctaaacaatgctgtctggcgcgggaattccgagcggttgcagctaatcccgctcggaacccgcacgaggagatcccgcagttcccaagaacgatatccatccacgggttgccctgggtggtccggctccggcaggttcaatggtggaaacgggaactgtccaaaacaccgggggggttggggct

SEQ ID NO: 17045 - DNA, 723 bp, Zea mays
  misc_feature: Ceres CLONE 1381605-F
  misc_feature: Encodes the peptide sequence at SEQ ID NO. 17046
  misc_feature (480)..(480): n is a, c, t, g, unknown, or other
  misc_feature (512)..(512): n is a, c, t, g, unknown, or other
aagctggagctccccgcggtggcggccgctctagaactagtggatcccccgggctgcaggaattcgcacgagaccattacctagaacatcctaatcgaaaaactactctctctctctctgcctgcaaagctgcttgatccatcatcgatcacatcactccaccagccgcagcgcacgaacgtacgactcatggcagatcgcgaccgcagcggcatctacggcggcggcgcctacgggcagcagcaggggggcggccacccgatgggtgagcaggtgaagggcatgatccacgacaaggggccgacggcgtcccaggcgctgacggtggcgacgctgttccctctgggcggactgctcctggtgctgtcgggcctggcgctgggcggctccacggtggggctggacctggccacgcccgtgttcctgctcttcagccccgtgctcgtccccgccgcgctgctcatcggcacggccgtcgcngggtttctcacgtcgggcgcgctggggctcgncggcctgtcctcgctcacgtgcctcgccaacacggggcgggagggtttcccagcggcaccccggactacgtcaaggaggcgcgccacaagatggcggaggccgcggggcacgcggtcccacaagaccgcgcaggccgggcacggcatccagaacaaggcgcaggaaggcggtgttggaactggcccccgagggggaaggacttcccccaaa

SEQ ID NO: 17046 - protein, 178 aa, Zea mays
  misc_feature: Ceres CLONE 1381605-F
  misc_feature (39)..(157): Pfam Name: Oleosin Pfam Description: Oleosin
  misc_feature (108)..(108): Xaa is any aa, unknown, or other
MADRDRSGIYGGGAYGQQQGGGHPMGEQVKGMIHDKGPTASQALTVATLFPLGGLLLVLSGLALGGSTVGLDLATPVFLLFSPVLVPAALLIGTAVAGFLTSGALGLXGLSSLTCLANTGREGFPAAPRTTSRRRATRWRRPRGTRSHKTAQAGHGIQNKAQEGGVGTGPRGGRTSPK

SEQ ID NO: 17047 - DNA, 683 bp, Zea mays
  misc_feature: Ceres CLONE 1381608-F
  misc_feature: Encodes the peptide sequence at SEQ ID NO. 17048
  misc_feature (683)..(683): n is a, c, t, g, unknown, or other
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaccgggaccgcagggagacctgcggtggtgcaagccaggcttgcgagtggcaatacgggaagggacaccccccccggaagagggaatgcgaaaagccaattggccccgaaggggaaccaacaaattttacccgggtcaaagaacggcaacgggggggtggacccctaactttccccgcttccggaaggggcgagggccgggccccaggccttggccccccccagggccccccccgggggaaaccccggaggggtttgggggggggcccccccccccggaatgtggccccaaattggaaaaaaaaataccgccccgcgaaaaagaaaggcgcgaaaaagtccccggaaaggtgggagggcccccacccccgggatgtttggggaaaaagcccccn

SEQ ID NO: 17048 - protein, 165 aa, Zea mays
  misc_feature: Ceres CLONE 1381608-F
MGKGSVGASWWAFLLLAGVLLVVAATAGAEDGVVDRDRRETCGGASQACEWQYGKGHPPRKRECEKPIGPEGEPTNFTRVKERQRGGGPLTFPASGRGEGRAPGLGPPQGPPRGKPRRGLGGGPPPRNVAPNWKKKYRPAKKKGAKKSPERWEGPHPRDVWGKSP

SEQ ID NO: 17049 - DNA, 677 bp, Zea mays
  misc_feature: Ceres CLONE 1381609-F
  misc_feature: Translation starting site: 292
  misc_feature: SWISSPROT Homolog: EC 3.1.3.16 Phosphoprotein phosphatase
  misc_feature (361)..(361): n is a, c, t, g, unknown, or other
  misc_feature (362)..(362): n is a, c, t, g, unknown, or other
  misc_feature (419)..(419): n is a, c, t, g, unknown, or other
  misc_feature (450)..(450): n is a, c, t, g, unknown, or other
aaagctggagctccccgcggtggcggccgctctagaactagtggatcccccgggctgcaggaattcgcacgagaccattacctagaacatcctaatcgaaaaagacaaaacagcgtccccctccctctactaaaaaaaaaatggaggcatgagctccgcctcctcctcgtctctcgccgatctccccaaaccctagccccgacctgaccgccggcgggcccgccggccggagaaggagtcgctcccacccacccaacttctgcggcggaaggggagcgggcggcggacgagatgccgtcgcacggggatctggaccggcagatcgcgcagctgcgcgactgcaagtacctgccccgagcgnnagtcaaggcgctctgcgagcaggccaaggccatccttatggaggagtggaacgtgcnagccgtgcgctgtcctgtcacggtctgtgcnacatccagggccagttctatgacctcatcgagttcttccgaatggggggggaggtccccaaaccaactaccttctcatgggggattaccgcgatggggggtacaattcagccgaacaagtttcctgggtaggggttttgaaaggccggtcaccgagaaaatattccataccttagagggaattctgggggccaaacaacccccccgggattgggtttccaagaaaag

SEQ ID NO: 17050 - DNA, 673 bp, Zea mays
  misc_feature: Ceres CLONE 1381610-F
  misc_feature: Encodes the peptide sequence at SEQ ID NO. 17051
  misc_feature (485)..(485): n is a, c, t, g, unknown, or other
  misc_feature (568)..(568): n is a, c, t, g, unknown, or other
  misc_feature (610)..(610): n is a, c, t, g, unknown, or other
  misc_feature (673)..(673): n is a, c, t, g, unknown, or other
aagctggagctccccgcggtggcggccgctctagaactagtggatcccccgggctgcaggaattcgcacgagaccattacctagaacatcctaatcgaaaactcacactcccatccagccgccaccaggtgcagagtctttcgtcatctcttctccggcgaagaacccccagtcgcccaccagatcacttgttaaactttgttgaggggtgatggcggtttctttcgcaaacctcaactccgaggcagggcttaaaaagcttgatgagtaccttctcactcgcagctacatcactggctaccaagcttccaaggatgacttggctgtctacacttcgttttcggctgctccctcgtccaagtatatcaacgtagcagggtggtttaaccacattgatgcgctcgtgaggctgagcggaattactgcagagggccaaggtgtgaaggttgaatcctcagcagttccttcagccccaactccagatngtgctgaagcacaggccctagttgctgaggaggacgacgacgatgatgttgaccttttttgtgaggagaccgaagatgacaanaaggctgctgaagagcgtgctgcagctgcccaggcttctggncagaagaaagaatctggggagtcatcagttctacttgatgtgaaagcatgggacgatgatacn

SEQ ID NO: 17051 - protein, 154 aa, Zea mays
  misc_feature: Ceres CLONE 1381610-F
  misc_feature: SWISSPROT Homolog: EC 6.1.1.16 Cysteine--tRNA ligase
  misc_feature (92)..(92): Xaa is any aa, unknown, or other
  misc_feature (119)..(119): Xaa is any aa, unknown, or other
MAVSFANLNSEAGLKKLDEYLLTRSYITGYQASKDDLAVYTSFSAAPSSKYINVAGWFNHIDALVRLSGITAEGQGVKVESSAVPSAPTPDXAEAQALVAEEDDDDDVDLFCEETEDDXKAAEERAAAAQASGQKKESGESSVLLDVKAWDDDT

SEQ ID NO: 17052 - DNA, 719 bp, Zea mays
  misc_feature: Ceres CLONE 1381612-F
  misc_feature: Encodes the peptide sequence at SEQ ID NO. 17053
  misc_feature (681)..(681): n is a, c, t, g, unknown, or other
aaagctggagctccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgttgaccttgaacccactgtcatcgatgaggtgagaactggcacctaccgccagctcttccaccctgagcagctcatcagtgggaaggaggatgcagccaacaactttgcccgtggtcactacaccattggcaaggagattgttgacctgtgccttgatcgcatcaggaagcttgccgactactgcactggtctccagggcttcctcgtcttcaacgctgttggtggaggaacgggctctgggcttgagtccctcctctagnacgcgctgtctgtgactacggcagaaatccagcttggg

SEQ ID NO: 17053 - protein, 153 aa, Zea mays
  misc_feature: Ceres CLONE 1381612-F
  misc_feature (49)..(154): Pfam Name: Tubulin Pfam Description: Tubulin/FtsZ family, GTPase domain
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADYCTGLQGFLVFNAVGGGTGSGLESLL

SEQ ID NO: 17054 - DNA, 660 bp, Zea mays
  misc_feature: Ceres CLONE 1381617-F
  misc_feature: Encodes the peptide sequence at SEQ ID NO. 17055
  misc_feature (395)..(395): n is a, c, t, g, unknown, or other
  misc_feature (580)..(580): n is a, c, t, g, unknown, or other
  misc_feature (626)..(626): n is a, c, t, g, unknown, or other
ggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggaagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtggncgcagcggggccgctcctcgccatcgtcggcttccttgtcctccccgtcatctggagcatcccggaggcgctgattaccgcggagctgggcaccatggtcccggagaacggcgggtacgtcgtgtgggtcgcctcggcgctcggcccctactggggataccagcagggtgggtggaggtgctcantgggtcatcgacaatgcctgtaccccgtcctcttctggactactcnaggtcggctggctggcctggggggggcccccccg

SEQ ID NO: 17055 - protein, 142 aa, Zea mays
  misc_feature: Ceres CLONE 1381617-F
  misc_feature (54)..(54): Xaa is any aa, unknown, or other
  misc_feature (116)..(116): Xaa is any aa, unknown, or other
  misc_feature (131)..(131): Xaa is any aa, unknown, or other
MGECRTEYRGLPDANGEDAGTVPAALRKVSIVPLVFLIFYEVSGGPFGIEDSVXAAGPLLAIVGFLVLPVIWSIPEALITAELGTMVPENGGYVVWVASALGPYWGYQQGGWRCSXGHRQCLYPVLFWTTXGRLAGLGGAPP

SEQ ID NO: 17056 - DNA, 622 bp, Zea mays
  misc_feature: Ceres CLONE 1381622-F
  misc_feature: Translation starting site: 162
  misc_feature (298)..(298): n is a, c, t, g, unknown, or other
  misc_feature (313)..(313): n is a, c, t, g, unknown, or other
  misc_feature (437)..(437): n is a, c, t, g, unknown, or other
  misc_feature (527)..(527): n is a, c, t, g, unknown, or other
ggagctccccgcggtggcggccgctctagaactagtggatcccccgggctgcaggaattcgcacgagaccattacctagaacatcctaatcgaaaaacccatattattgataccaactagcaacatacatagtgaagtacactagcaacatcttagcaccaatggcagccaagatttttgccatccttgccctccttgctctttcagcaagcgttgctaccgcgactataattccacaatgctcacaacaatacctctctccggtgacagccgcgagatttgaatacccaactatacnatcctacaggctacnagagggcatcgcagcaagcatcttacggtcgttaacatttgaccgtccacaaccatatgccctatttgcaacaaccatccttaatgaatctatatctcccaagaatcgcagcacaacaactacnacaacagttgcttccaacaatcaatcaagtagttgcagcgaaccttgctgcttacctccagcaacaacaatttcttccattcaatcaacntagctggggtgaaccctgctgcttacttgcaggcacaacagctactaccattcaaccaacttgtcaggagccctgctgccttcttactgcagcaa

SEQ ID NO: 17057 - DNA, 821 bp, Zea mays
  misc_feature: Ceres CLONE 1381624-R2
ctttcttgctacgtgcataatcggggaatcatctgactggtcactgatcggtcccatccagactgatgtccttatacatgagtgaaactggcagctggtgaacatcacgctcgttcgggagaataccaaaacaaatgctgccttattcatccatcatcattattctaccgactgcctagactagatgcatcgctggatatttgagaaactgaaaaggtcgagcttagaacaaattgaattacatgatggtgtccttcaccatctcccgctaaagcagcttgaaataaatcaaaccccactttcaggtgatatcatggtgcacctcgtacacaagaatctccttggggaacatgtatacttgatggaacaccgcgcccaccagaacggaggtacttatgctgctcttagaggccacgaagcagggctggaatcatgtaaaaagcgacttgagttgctatatctgatcgactgactttagaactctcacttgtcaggggactacttctacgattagcaattgctgcttctaccggactgaacgccacaacttttggtgtggcttcatcacttaatatctcgtgtctcatactgtttcatttcaccacctgacttgtatgtctcagagatctgtgacttctgcacctgagatctattggatgctagagatgagcaaccacgaggtaatacttgtggtccactgaggcgacatgttggttcatatcccacaaccttgccaagaccatgttgcgactgcgctcacggatacgatggcaaggacgacagcgacgcagctcaggcccatgagcttgccgctctgtcac

SEQ ID NO: 17058 - DNA, 639 bp, Zea mays
  misc_feature: Ceres CLONE 1381624-F
  misc_feature: Encodes the peptide sequence at SEQ ID NO. 17059
tggagctccccgcggtggcggccgctctagaactagtggatcccccgggctgcaggaattcgcacgagaccattacctagaacatcctaatcgaaaaatactacgggatcgtgagccgatccctcttcccagctacctccacttctctcccaatgaggaaccccaatgcctcgccatggcgtggtggatcctgctgcgatccgagtcccttcacctcttatccgccctcactcctgtcgttgtcaaagtaacaacgtctatcgccgtaagcccgcgcgctctcgtacctgccccgactacccgtctgccccgtagccccatggacttcgtgaggctctgaaagatgaaccatcatctcaactcggtggaccacatgctgtagctcgatgtctttcctctctacaatccatagatctcaggagctgaaatctgagatctctgatcacatacgagtaacgtgtacgcaaatgaaagagcctgagacacgcaaatctatagttgaagccgcatcacatcctgtggcgttcagtgcgctacgaagacctatctgtaaacctagaaccacgcgcctgactggtgacagttctaactggacgccatcagagatagcaagcccagtcactgtttacatgatgccag

SEQ ID NO: 17059 - protein, 84 aa, Zea mays
  misc_feature: Ceres CLONE 1381624-F
MSFLSTIHRSQELKSEISDHIRVTCTQMKEPETRKSIVEAASHPVAFSALRRPICKPRTTRLTGDSSNWTPSEIASPVTVYMMP

SEQ ID NO: 17060 - DNA, 832 bp, Zea mays
  misc_feature: Ceres CLONE 1381624-R
  misc_feature (763)..(763): n is a, c, t, g, unknown, or other
tttccgattgggtaccgggccccccctcgaggtcgacggtatcgataagcttttttttttttttttttgcaccttgaccttaatccttatttctcacgtgcactaatcgggggatatcatctgactggtcactgatcagtcccatcctgactgatgtccttatacaatagtgaaactggcacctggtaaaaatacgctcgttcgggagaaaccaaaacaaatgctgccttgttcatccgtcatcattattctacgactgcctagactgatgcattgctcgatatttgaaaaactgaaaaggcgaccctaaaacaaattgtatttcatgatggtgcccttcaccatctcccactaaagcagcttgaaataaatcaaaccccactttcaggtgatatcatggtacacctcatacacaagaatctccctggggaacatgtatacttgatggaacaccgcgcccaccagaacggaggtacttatgctgctcttggaggcccaagcagggctgggatcatgtaaaaagcgacttgagttgctatatctgatcgacttactttagaactctcacttgtcaggggactacttctacgattagcaattgctgcttctaccggactgaacgccacaacttttggtgtggcttcctcacttgatatccgtgtctcatactgtttcatttcagcacctgacttgtatgtctcagagatctgtgacttctgcacctgagatctattggatgctcgagaggacacccacgaggtantacttgtggtccactgagctgacatcgtcggtcatatcccacaaccctgccgagcccatggtgcgacgc

SEQ ID NO: 17061 - DNA, 617 bp, Zea mays
  misc_feature: Ceres CLONE 1381630-F
  misc_feature: Encodes the peptide sequence at SEQ ID NO. 17062
ggagctccccgcggtggcggccgctctagaactagtggatcccccgggctgcaggaattcgcacgagaccattacctagaacatcctaatcgaaaaagcgtggatcgtagtgcggagggggacaaacgactatcccatgtcccgcgacagagggtcaataagacggcagctgcgcaggggaccgcctgcactgtctccaccaggcgacgaagctattccgcctgttactgcagatcaccatgtcggcacaagtctgcgtctagacgtcctcctccatcttcaccgacgaactcctcccgccatcccctacctcccctcactcctcccaccaggcggagcccgatacggcccgccgtgcccccttctgaccgtgacagctccaacggacgccgacgacaggcgctcgtccactcatctgattttactcctcgcccgacatgaatccacatgtggttgctgaggctctgaaagcatctggagatggcttgcctgctgctatatactatgtggatttggtacacttagactcggcagagactatctggccatctactggtctcgaagctgacaaaggacatcctactgcgagtcaagcgcctgtgtgacccatgcctgga

SEQ ID NO: 17062 - protein, 55 aa, Zea mays
  misc_feature: Ceres CLONE 1381630-F
MNPHVVAEALKASGDGLPAAIYYVDLVHLDSAETIWPSTGLEADKGHPTASQAPV

SEQ ID NO: 17063 - DNA, 624 bp, Zea mays
  misc_feature: Ceres CLONE 1381632-F
  misc_feature (462)..(462): n is a, c, t, g, unknown, or other
  misc_feature (463)..(463): n is a, c, t, g, unknown, or other
  misc_feature (472)..(472): n is a, c, t, g, unknown, or other
  misc_feature (569)..(569): n is a, c, t, g, unknown, or other
tggagctccccgcggtggcggccgctctagaactagtggatcccccgggctgcaggaattcgcacgagaccattacctagaacatcctaatcgaaaaaagatgttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgaatgccggattcttcgtcttacggcttgaatcgagctgggaggctgtggatctgagcacgggaggtacaacaaatccgcgtgtatgacgagttggatcggcaccggttagtctctgacccgcagattttgttgttgtgttgggctgatctgcccgcgtgttttgcttcaggttctagagctagcgaaatcgcagggctattannggtcctttncggagcgcgtctgaagcgatgatggctgaatgtcgcggtgggatcgggatcttctctgccctgcttcaactcggatgatgaacctgctgcgctgatnataattggatgaatttcgataattattagatctaaaaaatggcccgacttgaaaa

SEQ ID NO: 17064 - DNA, 623 bp, Zea mays
  misc_feature: Ceres CLONE 1381661-F
  misc_feature: Encodes the peptide sequence at SEQ ID NO. 17065
  misc_feature (620)..(620): n is a, c, t, g, unknown, or other
tccccgcggtggcggccgctctagaactagtggatcccccgggctgcaggaattcgcacgagaccattacctagaacatcctaatcgaaaaaggagcagcttcacctcggaagctcagactcagtaggatgcaacaagaacatgcccaaccttcagtaactctctctctctctctgcgtgtgatcgtacgaaacatttgtgctgctgtgtgactgcgttttggcagatggttggtgcgaaggggtgtgagagatgcagggactggcaggagcactactactgggagcatatggatgtgagcaagatccgcttcttcaggcgcatgacaggagactttgctcatcgcattagcgtgccggagaagttcgcaaagaacttcaaggggcagatcaccgaagagtttcacctgaaatcacctagcggcgctgagacatggcacgtcggtgtagagaagcatggcgacgaactattcctcgcgtcagggtgggaggatttcgccaaggctcatgagctggaggagaacgatctcctgctcttcgcttgctctggaaactcttcctttgaggtcctagtcttcggagcaagtggctggtgagaaagtgtcatccctgtttggcaantgg

SEQ ID NO: 17065 - protein, 122 aa, Zea mays
  misc_feature: Ceres CLONE 1381661-F
  misc_feature (28)..(122): Pfam Name: B3 Pfam Description: B3 DNA binding domain
MVGAKGCERCRDWQEHYYWEHMDVSKIRFFRRMTGDFAHRISVPEKFAKNFKGQITEEFHLKSPSGAETWHVGVEKHGDELFLASGWEDFAKAHELEENDLLLFACSGNSSFEVLVFGASGW

SEQ ID NO: 17066 - DNA, 665 bp, Zea mays
  misc_feature: Ceres CLONE 1381661-R
cgattgggtaccgggccccccctcgaggtcgacggtatcgataagcttttttttttttttttttagccagggtaacattttcctagaaacttgtatattacacacaagctacaccttgttctacttgccatgctgctgatcaggaagctaccttacatgacacaaaaccgcagttgcattccttgcaagcatcactaggcacttccagtttgcaatgctacccctgcatagtacccctacacactacacactgcataaactacaacagtacaggtgcactgcgtcagatcagactaccagaatgaaccggccattggcctttctgacgacatggacggtcatcgtcactctcctctcgcctttcatcagttcgaagacgcagatgtcgccctcgtgaagcttgttctcgcgcgtgaacttgaacagcgctaagttctggaaacaccggcgtgagtagtagtagttgacaagccatttctccctcctgtttggcctacgaagtatgatgtcgtgcgctctttccccgagatggtcagcagcaaacttgcttgggatggtcagatagttgtttctgcgctgaacatggtttttcctcagaagggtcacaaatacaggattgttcggtcggatgggagccaaacctattatttcttccttttcctcgt

SEQ ID NO: 17067 - DNA, 671 bp, Zea mays
  misc_feature: Ceres CLONE 1381666-F
  misc_feature: Translation starting site: 357
  misc_feature: SWISSPROT Homolog: EC 3.4.25.1 Proteasome endopeptidase complex
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaagatcttctttctccttcttttcagattctagtacaaatctaatgcattccaaagctgtccattttcgcataaggactcaatccactacgcacgttccgccaaagatcgcgttcacatgcaatctgaggaatagatccgatatgctaatacaaaaggtccattaaagcttccctccttttctgaagacaattaccaccatcttgcacgcctgatcttcaaggatgatgctgatactatgtgccgatacacgagccaatgaaggtcctatatgctcctgatagacatctgcgacaatatcactacatggctcctatatcattcatcgctgtggtgctcgaacgctctgctgacactgaaactgcactgatttgccagctcacagctgcggtgcatatctaccagattggactagagtctcagcatatcagtagcttcgacccgtctcagaaaaggacttttcagatatcaggagatgactgcactgctactcgtccttgntgaaggtgctatcacggggctgcatgtgaatctaaatatgacatccgttgaggagtcactgctgctttcaca

SEQ ID NO: 17068 - DNA, 797 bp, Zea mays
  misc_feature: Ceres CLONE 1381668-F
  misc_feature (51)..(51): n is a, c, t, g, unknown, or other
  misc_feature (797)..(797): n is a, c, t, g, unknown, or other
ggggggggccggctggggctcccccccctgtccggcggggccaccaaaggnggggggtggggggtccccgcggtggcggagcagtctagaactagtggaggccccgcccctgcaggagttcgtacgagaccattacctacaacatcctaatcgaaaagcgtgtcgcgcgaagaatccgcatttccccttgcccgcaccgcacccaacccccgtcggagagagagagagagacatggcatcggcggcggagatgcagcccctcgcgccggcggggcaccgccgcgcgccggagatgaagtagaagctggagccggccctgctgcacctgggaggcgggaccgggaagacggtgtaaccggggatatcgcggggggagagcgccctccgagggagcttcggtggcaaggtctacgggagcgtcggagcggatgtggtccacaccaggcgccgggccccggctctgcgcgttttacgagcccacgccggggcggggacgtcctgctccgacgtcgccgggggggcgccggtcggtgtgccgccgggggctgccgcgttcactcctggggggggccctatgcctggcgggggatccctcgcgaggccctccgcggccccggcaacttcctcggggggcccacggcacacgttaggacgccttggaagcgccactccggccgggccatcaggcggccggacagccccgcgccaggccggggggcggggggtccggggcggcctccggttcggcggggggcgggcggggtcgagcccgcgcgggcatccggcccccgcggcan

SEQ ID NO: 17069 - DNA, 660 bp, Zea mays
  misc_feature: Ceres CLONE 1381670-F
  misc_feature: Encodes the peptide sequence at SEQ ID NO. 17070
tggagctccccgcggtggcggccgctctagaactagtggatcccccgggctgcaggaattcgcacgagaccattacctagaacatcctaatcgaaaaacacaaacaagaagcttgcattgttcgttgctcgatcgttgcaggtaatggagaaccctgctccgagtatcgtagtgccccccatcgccgcacctgtatcagcgaacttcagcagactcgccttccgcaacctgtacatccgacggacgggtccagacagcagggagatggtgactgtggagggaagaagaggctctagtgatcagacaggcgacatgaggtacgtgagtgacttccccgtctacgatggccgtggctccgacgccgtcctggtggctcgcgtgcagggcgtcacaaccacgttcgggaactccaaccagttcttcaccgtcgccttcgaggctggcaggctaaagggctccacgctccttaccgaaggagtggtgacgagatggatccgatgaatgggcaatctacggcggcaccggagagtttgctatgagcgagaggtgtcgtcaaaagaaggtaccttgccgatagaggacggcgccgggaacactgacgagctcagcatgcaggttttcttgcccggtgtttgggctcatcacagcaaccaaacaaga

SEQ ID NO: 17070 - protein, 118 aa, Zea mays
  misc_feature: Ceres CLONE 1381670-F
MENPAPSIVVPPIAAPVSANFSRLAFRNLYIRRTGPDSREMVTVEGRRGSSDQTGDMRYVSDFPVYDGRGSDAVLVARVQGVTTTFGNSNQFFTVAFEAGRLKGSTLLTEGVVTRWIR

SEQ ID NO: 17071 - DNA, 659 bp, Zea mays
  misc_feature: Ceres CLONE 1381672-F
  misc_feature: Encodes the peptide sequence at SEQ ID NO. 17072
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (485)..(485): n is a, c, t, g, unknown, or other
  misc_feature (542)..(542): n is a, c, t, g, unknown, or other
tccccgcggtggcggccgctctagaactagtggatcccccgggctgcaggaattcgcacgagaccattacctagaacatcctaatcgaaaaactcgtagctcaagcatcagcggcaggagctctgggcagcgtgcgcacgtggggtacctagctcgctctgctagcctaccatggctgatcaccaccggggcgcgacgggaggtggcgggggctacagcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctgtgactcacggnnnnnnnnnngggggcggccccccccactctcgggtgggcgtcttggggggggccgggtttccggcccctccggggggncttcggcgtcgctgggcgtggtccgggtctccctggatggaacagggaacctggacnggcaagcaccccgcccgggcggccgacccagctggaccacgccaagggcggaggttgggcggtccaaggcccgcgaacatcaaaggatgcagcacagcaccgcatcgaccagggggg

SEQ ID NO: 17072 - protein, 75 aa, Zea mays
  misc_feature: Ceres CLONE 1381672-F
MADHHRGATGGGGGYSDLQRGGGMHGEAQQQQKQGAMMTALKAATAATFGGSMLVLSGLILAGTVIALTVATPVL

SEQ ID NO: 17073 - DNA, 633 bp, Zea mays
  misc_feature: Ceres CLONE 1381677-F
  misc_feature: Encodes the peptide sequence at SEQ ID NO. 17074
tccccgcggtggcggccgctctagaactagtggatcccccgggctgcaggaattcgcacgagaccattacctagaacatcctaatcgaaaaattgctctacagccaaacctcgtatcgtcttctctccgctagcaccaccactgatcgctatacagagaccgcaaggaaccaaacgcctttccgccccgggccggcgctacgcaagcccaggaaccaccactcgtgtgtcgtggactactaagggcaaaaaaggcgtcctgttctttttatttgaccacgccgccgcgcgccgagtacggcaaggacaggactggcgacgaggacgagccccacggtcacagaatccggaagccgaggactaccaaggacagactagagcatgacgcctgtgacggagctgatcctcctcgcaaactgcttcatgatcaagagagtggtgcctctcaagcagctcaagtctggcctgctgcttatctctgggcctttgaagatcaatgtagtagcgatccgctgtgtgaacgagaacgatgtgattgttacatcaaccaaagttgacatctctgatggttatgtcgccaatgttgatgagcactactttgccagcgagaagaagtcaaggtgactaagacggc

SEQ ID NO: 17074 - protein, 80 aa, Zea mays
  misc_feature: Ceres CLONE 1381677-F
MTPVTELILLANCFMIKRVVPLKQLKSGLLLISGPLKINVVAIRCVNENDVIVTSTKVDISDGYVANVDEHYFASEKKSR

SEQ ID NO: 17075 - DNA, 628 bp, Zea mays
  misc_feature: Ceres CLONE 1381684-F
  misc_feature: SWISSPROT Homolog: EC 2.5.1.6 Methionine adenosyltransferase
  misc_feature (523)..(523): n is a, c, t, g, unknown, or other
gctctagaactagtggatcccccgggctgcaggaattcgcacgagaccattacctagaacatcctaatcgaaaaagtggcacacatccttccctgttcgcctcttctcctccctcctgcctggcccttaatatggagcagccggccctgaggttggtacaccgagccataagaacagaatggctggcggagagcttcctgttcacctcggagtccttgaaggaggggcacccagacaagctgtgggaccagctgtcggacgtgcgcgctggacgcctggctggcgcgggaccccgacatcaaggtggccttgggagatctgcagctagaccaacatcctgattgtcttcggcctggatcgggaccaatgcagaccgtgtactactagaaggagtgtgcccggacccctcccgccaggatgggggttcaccggccgaccgacgtggttgctctgcgcccgaccccttgcttgggggtggggaaccttcgaggggcggtcgccccctagtcgcgcaatgcttgtnccgaccacttgcccaaggggccccggagaggatgggcctcgcgcaagcggggcccagtggttcggggagcgccccggacggggagcccggaatgtgtgcccggtg

SEQ ID NO: 17076 - DNA, 676 bp, Zea mays
  misc_feature: Ceres CLONE 1381687-F
  misc_feature: Encodes the peptide sequence at SEQ ID NO. 17077
  misc_feature (431)..(431): n is a, c, t, g, unknown, or other
  misc_feature (508)..(508): n is a, c, t, g, unknown, or other
  misc_feature (570)..(570): n is a, c, t, g, unknown, or other
  misc_feature (578)..(578): n is a, c, t, g, unknown, or other
  misc_feature (579)..(579): n is a, c, t, g, unknown, or other
ggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctggtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttccctccagtgcgccgtctatgactccgacnaagccgacgcgcgctcatcgggcgtggagtacatcgtgggtcgaggaagatcttcgactcgctggccggcggaggancagcggctgtgggcactcgcacgcgcacgaaaatcagggtcaggccttgtggacgaagcggnaccggggnncgggcttgtctggaaaaagggcggagctgaaccacttggcccgcaagcgtttgggaaaaggtctggggcccccttggggaagggggaacccggggga

SEQ ID NO: 17077 - protein, 52 aa, Zea mays
  misc_feature: Ceres CLONE 1381687-F
  misc_feature (1)..(52): Pfam Name: DUF1264 Pfam Description: Protein of unknown function (DUF1264)
MGAAAMQSLRPVKQAKQHMCTFALYAHDPKRQVETHHYVSRLNQDFPPVRRL

SEQ ID NO: 17078 - DNA, 650 bp, Zea mays
  misc_feature: Ceres CLONE 1381693-F
  misc_feature: Translation starting site: 184
  misc_feature (504)..(504): n is a, c, t, g, unknown, or other
  misc_feature (505)..(505): n is a, c, t, g, unknown, or other
  misc_feature (530)..(530): n is a, c, t, g, unknown, or other
tggagctccccgcggtggcggccgctctagaactagtggatcccccgggctgcaggaattcgcacgagaccattacctagaacatcctaatcgaaaactcgcgggctttcccgcagcaagatcaacgtcgtcgttcaagccagcggtagtagagactacgaccgaggctagctaagctaagagatggcggatcaccagtactcggcgtggacgacttccgctgctcgtcatcgggtcttctcctgtgcgctcatggctcttgttagttttgtggctgcaggacgacccatggtgctcgccgacgccatcgtctttcacgtggcgaacaggtggcccgttcccggtggtggccggcgtccgcccctaacaccggccacccagtgctcgccggcggcggcttctacgtcccgcagggcaaggtcgaggcgcgtcgtcgcgccggccaactggaacgggcgcttctgggccccgcaccggttgcaacttcaccgcgaacggctgggnnccgtagcgggctgcctcaccggggnactggcgagggccggctcgcctgttaaagggggttcggtgggcgccccgcccgccacggctaagtcgaaggtgagcctggcacgaggacgcccccgaaagggagctcctacgacgggagg

SEQ ID NO: 17079 - DNA, 658 bp, Zea mays
  misc_feature: Ceres CLONE 1381712-F
  misc_feature: Translation starting site: 202
  misc_feature: SWISSPROT Homolog: EC 3.4.11.18 Methionyl aminopeptidase
aaagctggagctccccgcggtggcggccgctctagaactagtggatcccccgggctgcaggaattcgcacgagaccattacctagaacatcctaatcgaaaaaaacctaagcctctcacccggcgccgccgccgccgccgccaccgccgccgccccgaggcccgatcccagcgaaaccgacttccgcctcgcattgaagcaatgtcgtcccacgaccaggtcacggaggataaggagctcgacctctcctccaacgatgtcgtcaccaagtacaagactgccgccgaaatcctgaacaacgctctgaagctgtctgtgtctgagtgcaaggcaaaagcaaagattgttgacctttgtgagaacggtgactctttcataagagagcaaactcgggaatgtctacaagaatgcaaagaggaagattgaaaggggcattgctttcccaacctgtgttgcggtgaacaacacagtctgccacttctccccgcttaccacagatgatgcagttctggcagaaaatgacatgcttaacatcgacatggggtgtcatattgatggctttattgctgtggtggcacatacacatgtaattgcaaatgggcctgtcacaggaagagcagctgatggtcttgctgctggcaacacagcagcagagttg

SEQ ID NO: 17080 - DNA, 628 bp, Zea mays
  misc_feature: Ceres CLONE 1381713-F
  misc_feature: Encodes the peptide sequence at SEQ ID NO. 17081
  misc_feature (490)..(490): n is a, c, t, g, unknown, or other
tggagctccccgcggtggcggccgctctagaactagtggatcccccgggctgcaggaattcgcacgagaccattacctagaacatcctaatcgaaaaactccgtcactttgtttgaaaagctcctcctcgatccatcgatcactgcaccggccgggggcaccgcgctcgcatgggctatccaacgagacggcatcaatggcggaccgtgaccgcagcgcaatctacggcggtgcccacgccacctacgggcatcactatcaccacggaagaggtggccgcccgatgcgtgagcatgtgaagggcatgctccacgacaaggggccgacggagtcgcaagcgctgacggtgtcgaagctgttcccgctgtgcgccctgctgctgcagctgtcctatctggcgctgacgctctccgggatgtatttgcacgtgaccacgccggagttcctgatcttcaaccccgggttggaccccgtcgtgctgatcatcggnacgggcgtcatgttcttcctcacgtcgtacgtgctgtggattctggttctgatctcgatcacgtgcctctaccatacggcgaggtaggtgttgcatagcaccccggactacgttcatgacgcgcactgcaggatgtcg

SEQ ID NO: 17081 - protein, 126 aa, Zea mays
  misc_feature: Ceres CLONE 1381713-F
MADRDRSAIYGGAHATYGHHYHHGRGGRPMREHVKGMLHDKGPTESQALTVSKLFPLCALLLQLSYLALTLSGMYLHVTTPEFLIFNPGLDPVVLIIGTGVMFFLTSYVLWILVLISITCLYHTAR

SEQ ID NO: 17082 - DNA, 654 bp, Zea mays
  misc_feature: Ceres CLONE 1381714-F
  misc_feature: Encodes the peptide sequence at SEQ ID NO. 17083
aagctggagctccccgcggtggcggccgctctagaactagtggatcccccgggctgcaggaattcgcacgagaccattacctagaacatcctaatcaaaaaaacaccatccgccacgaccacgactccacgagagagcggaggacgagggagagcaatggcagaggcgggccagcagttgctgcggtcgatcgtggaggggtcagcgggctcgcacttccctatccagaacctgcccttcggggccttccgccggcgggggtcgccaccgcaggctccgcgccccggggtggccatcgggtacttcgcgctcgacctctccaccgtcgccgacacgagtctcttcaacgggcccgcgctctccggatcctcgtgcttccaccaggagacgctcaacatgttcttggcgatgggccgaccggtgtggagggaggcgcgcgccacgctactaaaaatcctctcagccgacgagacagtcttgcgtgacaacgaagtcctgatgaataaatgtcttattccaatgagtgatatcgagatggctctaccaatcacggttgtggggtacacagatttcttttgctctgtgcatcatgcaaggaactgcggattcatcttccgagggccgcacactccagttaatccacattggttttat

SEQ ID NO: 17083 - protein, 166 aa, Zea mays
  misc_feature: Ceres CLONE 1381714-F
  misc_feature (11)..(130): Pfam Name: DUF1969 Pfam Description: Domain of unknown function (DUF1969)
  misc_feature: SWISSPROT Homolog: EC 3.7.1.2 Fumarylacetoacetase
MAEAGQQLLRSIVEGSAGSHFPIQNLPFGAFRRRGSPPQAPRPGVAIGYFALDLSTVADTSLFNGPALSGSSCFHQETLNMFLAMGRPVWREARATLLKILSADETVLRDNEVLMNKCLIPMSDIEMALPITVVGYTDFFCSVHHARNCGFIFRGPHTPVNPHWFY

SEQ ID NO: 17084 - DNA, 636 bp, Zea mays
  misc_feature: Ceres CLONE 1381719-F
  misc_feature: Encodes the peptide sequence at SEQ ID NO. 17085
  misc_feature (455)..(455): n is a, c, t, g, unknown, or other
  misc_feature (512)..(512): n is a, c, t, g, unknown, or other
aaagctggagctccccgcggtggcggccgctctagaactagtggatcccccgggctgcaggaattcgcacgagaccattacctagaacatcctaatcgaaaaatcgaacgcacactcgcactcgcacgtacaccacactagttaccacagacgacgggcgccatgaaagtcccggtgcttctcctcctggtctccctgtgcttctcgctcgcgctcgcgtggcaaacggacacggaatcgggctcaggcaggccgtaccactacggcgaggagagtttccggcactggacgcgctcccggcagggccggttcagggtgctggaacggttcacccacgagctgctggaggacgccgtcggcaactaccgcgtcgccgagctggaggccgcgccgcgcgcgttcctgcagcccagccactacgatgccgacgaagtgatgttcgtgaaggaaggcgnaggcgtcatcgtgctgctccgcggcgggaagaggaagtcgttctgcgtcagggaggncgacgtcatggtcatccccggcgggcgccgtcgtgtactcggccaacacgcaccagtccgaggggttccgcgtcgtcatgctcctcaagcccggtcgtctcacgtttggaagcttccaggagtc

SEQ ID NO: 17085 - protein, 158 aa, Zea mays
  misc_feature: Ceres CLONE 1381719-F
  misc_feature (98)..(98): Xaa is any aa, unknown, or other
  misc_feature (117)..(117): Xaa is any aa, unknown, or other
MKVPVLLLLVSLCFSLALAWQTDTESGSGRPYHYGEESFRHWTRSRQGRFRVLERFTHELLEDAVGNYRVAELEAAPRAFLQPSHYDADEVMFVKEGXGVIVLLRGGKRKSFCVREXDVMVIPGGRRRVLGQHAPVRGVPRRHAPQARSSHVWKLPGV

SEQ ID NO: 17086 - DNA, 515 bp, Zea mays
  misc_feature: Ceres CLONE 1381720-F
  misc_feature: Encodes the peptide sequence at SEQ ID NO. 17087
  misc_feature (6)..(6): n is a, c, t, g, unknown, or other
  misc_feature (8)..(8): n is a, c, t, g, unknown, or other
  misc_feature (9)..(9): n is a, c, t, g, unknown, or other
  misc_feature (26)..(26): n is a, c, t, g, unknown, or other
  misc_feature (40)..(40): n is a, c, t, g, unknown, or other
  misc_feature (154)..(154): n is a, c, t, g, unknown, or other
  misc_feature (158)..(158): n is a, c, t, g, unknown, or other
  misc_feature (199)..(199): n is a, c, t, g, unknown, or other
  misc_feature (227)..(227): n is a, c, t, g, unknown, or other
ggggtntnntttcccccgggggggcnccggggggggcccntagtggggggtcggggggccccgccggggccgtgcccaaaggggcccccgtatcgagaatcgggttaggcagacccgctggagccgcccgcggtaacacaatcccccaaaaacnaaanaaaaggctgggggctcccgggggggggcgggccggctctanaacagtgggatcccccggggctgcaggnaattcgcacgagaaccattacctagaacatcctaatcgaaaaatcgcacatattatttagaccaactagcaacatagaaagcacaatagtgtaccaacaatggcagccaaaatattttgcctccttatgctcttggaatttctgcaagtgctgctacggggaacatttttccgcaatgctcaaaggtcctataggttcccttcctttccggtaacctctcaccagcgggggccttcggaatgggaaaaacaaattctttcaacccaaggggatccacggggaaattgc

SEQ ID NO: 17087 - protein, 63 aa, Zea mays
  misc_feature: Ceres CLONE 1381720-F
MAAKIFCLLMLLEFLQVLLRGTFFRNAQRSYRFPSFPVTSHQRGPSEWEKQILSTQGDPRGNC

SEQ ID NO: 17088 - DNA, 668 bp, Zea mays
  misc_feature: Ceres CLONE 1381727-F
  misc_feature: Encodes the peptide sequence at SEQ ID NO. 17089
  misc_feature (611)..(611): n is a, c, t, g, unknown, or other
  misc_feature (612)..(612): n is a, c, t, g, unknown, or other
  misc_feature (668)..(668): n is a, c, t, g, unknown, or other
aagctggagctccccgcggtggcggccgctctagaactagtggatcccccgggctgcaggaattcgcacgagaccattacctagaacatcctaatcgaaaaagatcttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcggtccattcggcacgatgaatcatcagtctgaattggctcacggcgctaacgcggagctggacatcgcggtgcggctgctcgagcccatcaaggaggagttcccaatcctctcttacgccgatttctaccagctctgcgcgagttgtggccgtgagaggtcaccggtgggccctgagattcccttccaccccggtaggggagacaagcctcagcccccaccctgaggccgccttcctgatggcccctaaggggctctgaggagcagcgggnnagtttttggcaagcagatgcggcttgagcgatcaggacattggtgcccctctctgn

SEQ ID NO: 17089 - protein, 128 aa, Zea mays
  misc_feature: Ceres CLONE 1381727-F
  misc_feature: SWISSPROT Homolog: EC 1.11.1.11 L-ascorbate peroxidase
MAKNYPTVSAEYSEAVDKARRKLRALIAEKSCAPLMLRLAWHSAGTFDVSSRTGGPFGTMNHQSELAHGANAELDIAVRLLEPIKEEFPILSYADFYQLCASCGRERSPVGPEIPFHPGRGDKPQPPP

SEQ ID NO: 17090 - DNA, 644 bp, Zea mays
  misc_feature: Ceres CLONE 1381729-F
  misc_feature (520)..(520): n is a, c, t, g, unknown, or other
aagctggagctccccgcggtggcggccgctctagaactagtggatcccccgggctgcaggaattcgcacgagaccattacctagaacatcctaatcgaaaaactcacaaagaagccggtgacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcgaacaccatccgcacggacatcggggtcatcggtgggtagtactcaatacctgcttagcaatgggaccgccctagtgctcttcctctccccggtgcctacgttcatccgcatctggaagaaggggtcggtggagcagtactcgccgatcccgtacgtggagacactgctgaactgcatgatgtgtgtgttgtacggnctgccgctggtgcacccgcacagcatgctggtgatcaccatcatcggcacgagatgctcatccagctgacctacgtggggctcttcctcgtctactccggcgggggggcgcggcagcaggtgtt

SEQ ID NO: 17091 - DNA, 661 bp, Zea mays
  misc_feature: Ceres CLONE 1381730-F
  misc_feature: Pfam Name: FAD_binding_4 Pfam Description: FAD binding domain
  misc_feature (251)..(251): n is a, c, t, g, unknown, or other
  misc_feature (268)..(268): n is a, c, t, g, unknown, or other
  misc_feature (517)..(517): n is a, c, t, g, unknown, or other
  misc_feature (567)..(567): n is a, c, t, g, unknown, or other
aaagctggagctccccgcggtggcggccgctctagaactagtggatcccccgggctgcaggaattcgcacgagaccattacctagaacatcctaatcgaaaaactcctaagcgccgtcgcgatctgctgcggtggccgctgccgtcgccgtccatccccaccgcctcgaccacgccaccgacgccgcctctcgctccccctcgccgcgccgcccgaacgccacgatgcgtcacctcctcctctcccgctcncttccgcgcgcggtggnggtagcggcatccccaacggccactaccaccacctccccctcctccgagacctctcgtcatccccctctccgggctcctcggaggcagagctccgcaagtacgcgggatacggggtgcttcttctcggctgcgtcggcgtgacctactactgattcccgatccccgccgacgcgctgcacaagaaggccgtgccattccggtacgcgccgctgccggaggacctccacgccgtctccaactgtagcggnacgcacgaggtccacgcccgcgtcctgctccagacggagtcgctccgggncctcgagggcgcgctcgccgccgcgcacaaggagcgtcgcaagctcaggcccctcggctccgggctgtcccccaatgggatcgcgctctcccgt

SEQ ID NO: 17092 - DNA, 664 bp, Zea mays
  misc_feature: Ceres CLONE 1381734-F
  misc_feature: Encodes the peptide sequence at SEQ ID NO. 17093
tccccgcggtggcggccgctctagaactagtggatcccccgggctgcaggaattcgcacgagaccattacctagaacatcctaatcgaaaaaaacacacacgggcaatcaattagcagaacccgcgccaccccccttcctcggagtcggagcgagtcgaggaacggctcgtctgcctctcccgttctccttcctctcctccccagaagatccgatccatcatcgaggactcgccgggaagaatcacgggtatatagataatatacaagacaaaggttcctccagagcccagagcaggagggaagtcaccggccgtcggcggggaggacatgtcggacggcgcggactcccgggacggcgtcactgacgcgctgggcctctcgatcacctacgcgatggccatcgtcatctgcaacaagtacctcatcagcactctaggcttcgtcatcgcgacgacgctgacgagctggcacctcatggtgagcttcttcacgctggacggtgcgcagcgcctgcgccttcttcaagccaaaggcgatcgaaggggggaacggcattctctttcggccgggtcaaggggttctcatttgggcctctccacccccggcctcgggttcaacctgggtgggtttcaaccaaaggcaaaggtggcccttctaaccttt

SEQ ID NO: 17093 - protein, 112 aa, Zea mays
  misc_feature: Ceres CLONE 1381734-F
MSDGADSRDGVTDALGLSITYAMAIVICNKYLISTLGFVIATTLTSWHLMVSFFTLDGAQRLRLLQAKGDRRGERHSLSAGSRGSHLGLSTPGLGFNLGGFQPKAKVALLTF

SEQ ID NO: 17094 - DNA, 528 bp, Zea mays
  misc_feature: Ceres CLONE 1381741-F
  misc_feature: Encodes the peptide sequence at SEQ ID NO. 17095
  misc_feature (334)..(334): n is a, c, t, g, unknown, or other
  misc_feature (336)..(336): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttcccctcatgctcacaagctccctataggttttccccttttttccccccaaaaacctttccaaaaaaattaaagcgctccacaagaggggggaaacccncnccccccccttccccaaaagggtttaaaaaaacggggaagaaaaaccttttgggggggggggggccaaccccccccccccttttttggggggggggttggaaacaaaaagggggaaaaagggggggaaattgtgtttcttttttttaaaaaaaaagggggggggaaattttttcccccctccaaaaaaaaaaa

SEQ ID NO: 17095 - protein, 105 aa, Zea mays
  misc_feature: Ceres CLONE 1381741-F
  misc_feature (57)..(57): Xaa is any aa, unknown, or other
MATKIFSLLMLLALSTCVANATIFPSCSQAPYRFSPFFPPKTFPKKLKRSTRGGKPXPPPSPKGFKKTGKKNLLGGGGPTPPPLFWGGGWKQKGGKRGGNCVSFF

SEQ ID NO: 17096 - DNA, 645 bp, Zea mays
  misc_feature: Ceres CLONE 1381746-F
  misc_feature: Encodes the peptide sequence at SEQ ID NO. 17097
tggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagctggcaaacctttctccctactctcagcaacaacaatttcttccattcaaccaactgtctacactgaaccctgct

SEQ ID NO: 17097 - protein, 160 aa, Zea mays
  misc_feature: Ceres CLONE 1381746-F
MAAKIFCLLMLLGLSASAATATIFPQCSQAPIASLLPPYLSPAVSSVCENPILQPYRIQQAITAGILPLSPLFLQQSSALLHQLPLVHLLAQNIRAQQLQQLVLANLAAYSQQQQFLPFNQLAALNSASYLQQQQLPFSWQTFLPTLSNNNFFHSTNCLH

SEQ ID NO: 17098 - DNA, 473 bp, Zea mays
  misc_feature: Ceres CLONE 1381750-F
  misc_feature (241)..(241): n is a, c, t, g, unknown, or other
  misc_feature (263)..(263): n is a, c, t, g, unknown, or other
aagctggagctccccgcggtggcggccgctctagaactagtggatcccccggggctgcaggaattcgcacgagaccattacctagaacatcctaatcgaaaaccgttgcagtgcagctgcaggttctcgccgactccccttctccttcgacctccgccgctcgccgccgtttcccgtccgcggaggagcctcctcccctcccactcttcctcgatgtcgatctcgtatcgggtaccatggnaagatcactctccacggccctngtgaaggggacttatggaaatcgtcccggggatcgacatcacctggtggggtcacgaccagttttccggcgggttaaaaacttattcttcgggcctaaattgcccccccaaaggaaatgggggttcccgggggaaaaccaaaaaatttgtgttcccccccccccccccccccaattttttccccccccaaaaaaaaaaaaagtggggaat

SEQ ID NO: 17099 - DNA, 627 bp, Zea mays
  misc_feature: Ceres CLONE 1381752-F
  misc_feature: Encodes the peptide sequence at SEQ ID NO. 17100
  misc_feature (550)..(550): n is a, c, t, g, unknown, or other
  misc_feature (553)..(553): n is a, c, t, g, unknown, or other
aaagctggagctccccgcggtggcggccgctctagaactagtggatcccccgggctgcaggaattcgcacgagaccattacctagaacatcctaatcgaaaaataggaatcatccatcgcgtctgtgctccccctcgcgcaatcctaccgcactcgcctcccgaaatcggccgccacggcgcctcacgccatggctcctgcccagcagctgcagctccctccgcctccggtggtctggcacgccgcctcctcgcccagatccgtccgtggtccgcccctccggcctcgcccagctccaaagctccctcctgctcgcgggcacgcgatctcgccctgggggccatgccctaggccgtcgtctcggctcgcgtccacctcgtccagcgtcacaagtggcgccgccgccggtgtcggctacttcgatctcccgcccgccgtcgactcgtccagcagtacctacgctctgaatccgatcccctcgccggtggcgacggcgtcggctgacccatccccaaactcggcgcgggagcccaagcggaagcgaactggnccngtgcgtcccccgcatcaactcgaaccgaagggacgaccaagcggagtctagactcaagagcaaccgcgacctcc

SEQ ID NO: 17100 - protein, 137 aa, Zea mays
  misc_feature: Ceres CLONE 1381752-F
MAPAQQLQLPPPPVVWHAASSPRSVRGPPLRPRPAPKLPPARGHAISPWGPCPRPSSRLASTSSSVTSGAAAGVGYFDLPPAVDSSSSTYALNPIPSPVATASADPSPNSAREPKRKRTGPVRPPHQLEPKGRPSGV

SEQ ID NO: 17101 - DNA, 652 bp, Zea mays
  misc_feature: Ceres CLONE 1381760-F
  misc_feature: Encodes the peptide sequence at SEQ ID NO. 17102
  misc_feature (429)..(429): n is a, c, t, g, unknown, or other
  misc_feature (652)..(652): n is a, c, t, g, unknown, or other
aagctggagtccccgcggtggcggcgctctagaactagtggatcccccgggctgcaggaattccacgagaccattacctagaacatcctaatcgaaaaacacatcctccgatgcgtccctgatcgtacaccaactggaccccaactcgaatctccattcttgaccaactcaccgatgccccactccgctcccgtcgcttaggaatgccaatatttgctaagaccctcaccgggaagactatcaccatcgaggcgcagcctactgacctatgtgtcaatgtcaagtctatcgatccaggacaaggtagtgcgatccctcctgagcagcagtcgcttatcttcactgcgaatcagcttgaggacgcacgcacacttgctgactacaacattgagaaggagtcaaccctccacttggtgctgcgacttaggngaggcatgaagatctttgacaagatcttgattgcctagacaatcacccttgagggggagacgtcacacaccatggacaatgacaaggcaaagatctaggacaaggagggcttccccacttgaccagaaacggctcattctttgccggcaagtaatgggaggcagggaaggacccttgggtggcctacacaccccaaaaggggaagcccccctccatttggggn

SEQ ID NO: 17102 - protein, 87 aa, Zea mays
  misc_feature: Ceres CLONE 1381760-F
  misc_feature (6)..(75): Pfam Name: ubiquitin Pfam Description: Ubiquitin family
  misc_feature (76)..(76): Xaa is any aa, unknown, or other
MPIFAKTLTGKTITIEAQPTDLCVNVKSIDPGQGSAIPPEQQSLIFTANQLEDARTLADYNIEKESTLHLVLRLRXGMKIFDKILIA

SEQ ID NO: 17103 - DNA, 715 bp, Zea mays
  misc_feature: Ceres CLONE 1381764-F
  misc_feature: Encodes the peptide sequence at SEQ ID NO. 17104
cccgctggagctccacgcggtggcggccgctcatacatagtggatcccccgggctgcaggaattcccacgagaccattacctagaacatcctaatcgaaaaaaagccgtcccttcccaaccctcccttcgatccctggggcggcggtcgggaccatgacgaccggatccaacggcgacggaggcgacacccctacctgttcccttcgcgggcccccgcactactcccaccgccctctccctccctaaccaccccaaccccccgctacccccacacaccaggaggtcacagttatttttattccccgccccggccgtcggggctggcccctgcccccgcctcccccccccccccccccgtcaatatattccatcacaaccactaaaaagaaaaaaaacttcgacggcacagatttactcttgcgccaccccccgagcgaggagaacaccagaaaatagtactcccccccaccgccgatattacagaccgccatgtatggtttcagcaccatcacctaccaccccactacgatcaggtacacgacaccccccctcggttccacctctggtacccctcccgcactcccccccccccacctcctcccgtcttcctccgccgccggaaacagtgccccctccccccacgcccccccaccccccccgccctccctcaatatttctttaccactcaagcattaaatcaccaacccacccacc

SEQ ID NO: 17104 - protein, 73 aa, Zea mays
  misc_feature: Ceres CLONE 1381764-F
MVSAPSPTTPLRSGTRHPPSVPPLVPLPHSPPPTSSRLPPPPETVPPPPTPPHPPRPPSIFLYHSSIKSPTHP

SEQ ID NO: 17105 - DNA, 710 bp, Zea mays
  misc_feature: Ceres CLONE 1381765-F
  misc_feature (21)..(21): n is a, c, t, g, unknown, or other
  misc_feature (710)..(710): n is a, c, t, g, unknown, or other
gcccgctgtagctcaccgcgntggcggccgctctagcactagtggatcccccgggctgcaggaattcgcacgagaccattacctagaacatcctaatcgaaaacttgcgctctggttttctctctttgcgccgctgttcaggcgcctcgcctctcctatccttgtcttgccctgtgtcccttcgtcgcctcggtgcactcgcccttcgttcatcgggcttccgcgcgctcgcgtttttcattattccttctctgcaccccgtttcgatttcgagcggggtcagtttcttcttcaccggttgatttgttctgctgctttgcgtctccgtgctctcgcagatcccttgtagccgctttgtctccgcgcgacgcccccgagcccccccgagcctcgcttggcccggcctgtcccgactcggccaccccctcgttctggcaataactcccctctccggtggcaccaccgctctcgctccttgaccctcccaccacgccgtgcgcccccccccccccccccctccccccccgtcaagtactcacacccccccgccccccaccacccgtcctcggaagcgggcaggattttcctgaccgtaaccccaccccccacttgccaccagcgccccccgccccccccaccgcccgcccgcgcgcccggcaggctcgcgacgccctgctgctctcttcgcccaccccccacccgcccccccn

SEQ ID NO: 17106 - DNA, 653 bp, Zea mays
  misc_feature: Ceres CLONE 1381768-F
  misc_feature: Encodes the peptide sequence at SEQ ID NO. 17107
ccaagtggagctcaccgcggtggcggccgctctataactagtggatcccccgggctgcaggaattcgcacgagaccattacctagaacatcctaatcgaaaaacccaccaatccacagcgacacccgaccccgccgtcgtgatgaggccggcgctgctcaagtccacggccgagctcctccgccgcagccgcggctacgcctcctcggccaacccggagcggaaggtggccatcctgggcgctgcgggcggcatcggccagccgctctccctcctcatgaagctcaacccgctcgtctcctccctctccctctatgatatcgccgggacccccggagtcctgtccgacgtcttccacattaattcttccttccctgccgaaggcgatcatgcccccacgacccacctcggggcgccccctcttggcctccgaagtcacagatgaccccctccgggcggcgcccccatagcgccgcccccccccacaccccagaactcgtcgacaatccactccccccacaatcattaacggcgaccccgccccccccccccaccccgtgtctggccagccccaccccctgccacttaggatttccccacccccccgtaacctccccctcttcccccctcccccctctctagccccccccaccc

SEQ ID NO: 17107 - protein, 100 aa, Zea mays
  misc_feature: Ceres CLONE 1381768-F
  misc_feature: SWISSPROT Homolog: EC 1.1.1.37 Malate dehydrogenase
MRPALLKSTAELLRRSRGYASSANPERKVAILGAAGGIGQPLSLLMKLNPLVSSLSLYDIAGTPGVLSDVFHINSSFPAEGDHAPTTHLGAPPLGLRSHR

SEQ ID NO: 17108 - DNA, 642 bp, Zea mays
  misc_feature: Ceres CLONE 1381769-F
  misc_feature: Encodes the peptide sequence at SEQ ID NO. 17109
  misc_feature (389)..(389): n is a, c, t, g, unknown, or other
  misc_feature (392)..(392): n is a, c, t, g, unknown, or other
  misc_feature (429)..(429): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtaacaagagggatagagcaaggccacacacacacacacaccactaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggccttggccctggccgtgtcgatcgccgaggcgaggaacatcaagaccacgacgacggagaagaaggacgacgcggnggngcagccgcagaccttcccgcccttcgaccgcctcggnggcggcgcgtccccggcgttcggcggcctccccggcggcggtattcctgggggcagcattcccgcgttcagcatgcccggcagcgggcgccgcctccccggcaaccgctcggcccgccaccggcagaacgctccctcttccgcccgagctcccccggcttcactgcacttcgccgcaggcccggggcccccaccccctcaccccccctctccg

SEQ ID NO: 17109 - protein, 124 aa, Zea mays
  misc_feature: Ceres CLONE 1381769-F
  misc_feature (40)..(40): Xaa is any aa, unknown, or other
  misc_feature (41)..(41): Xaa is any aa, unknown, or other
MARSSKMMVAAALLALALAVSIAEARNIKTTTTEKKDDAXXQPQTFPPFDRLGGGASPAFGGLPGGGIPGGSIPAFSMPGSGRRLPGNRSARHRQNAPSSARAPPASLHFAAGPGPPPPHPPSP

SEQ ID NO: 17110 - DNA, 684 bp, Zea mays
  misc_feature: Ceres CLONE 1381770-F
  misc_feature: Encodes the peptide sequence at SEQ ID NO. 17111
cccagctggagctcaccgcggtggcggccgctctagtactagtggatcccccgggctgcaggaattcgcacgagaccattacctagaacatcctaatcgaaaagagtgatgtcattccgcttgcttgattgttccagatattcgcagttgaccgggtcctcggagcacgatgaagtttgttgctgcctacttgcttgctgtcctcgctgggaacgccagcccctccgctgaggatttgactgccattctggagtcagtcgcctgtgaagctgacactgaaacgacgaaactcctgctgtcccaaccgacgcgtcccgtcctctccccacccccttgccgcgccgccgggaccagtttgcgttgagcgtatgtcgtcgcgcgcccccgccctcccttcccccccccccccccctgctcccctcccccctctctccctgcccccactctccacccccccccaccctacacccaccccccctccccccctcacgcgacccccccccccccccccccccctcttcccttttcctcccgctcccccccctacccccttcccccccatccctcccctccccctgcctctgcacgccccccccccttacccctcctccccctcctgctgtgtgtcctactcccactctccacctccccgccccctcttgccgtcttccttccctcctgccg

SEQ ID NO: 17111 - protein, 64 aa, Zea mays
  misc_feature: Ceres CLONE 1381770-F
MKFVAAYLLAVLAGNASPSAEDLTAILESVACEADTETTKLLLSQPTRPVLSPPPCRAAGTSLR

SEQ ID NO: 17112 - DNA, 650 bp, Zea mays
  misc_feature: Ceres CLONE 1381771-F
  misc_feature (273)..(273): n is a, c, t, g, unknown, or other
caagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggntcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgccctccagcccgtggcagctgcagggaacctgcggcgttggcagcaccccgatcctggccccgcgcgccgagctactgaggcatccgtgcagcccgacggcgacgccccactgctcgcctcaccgccagtcgttgcgcccgccccgctgccagccaccct

SEQ ID NO: 17113 - DNA, 660 bp, Zea mays
  misc_feature: Ceres CLONE 1381773-F
  misc_feature: Encodes the peptide sequence at SEQ ID NO. 17114
ccagctggagctcaccgcggtggcggccgctcatatacactagtggatcccccgggctgcaggaattcgcacgagaccattacctagaacatcctaatcgaaaaagaagtactaacgccccgcccctgcctggggttttaaccctacccaaccgccgcccatggcgtccatctcggagcccgctgctagggagaagcccatcgtcgtccgggtcaagcgcaaaccttcgcaaaaccgcccggacgctttctggctagagattaatgagaggccggcaaagaaggcggcgattgatttctcccgcctttccatctccgaaccctcctcgtcctctgccagtgtcaaagcttcagaggaaccacgggttaagaaaattcttgtccagcacatcgagacagtacaccactctgaagctgtcgaagatgctttacaatctcttttgcttgttgactcaaattccaaggagacaaagagcaagacaaaggagcggaatgaccgaatcaagtaagattaaaaaccagagcaactaccatccagctgccagaccgaggcatgaggatatggcacgacatgctccctccgcaccaacatgccagagtccacaacgagaaaagcctgatgcccgacactcatcgacacgcaacacgactctctacgctg

SEQ ID NO: 17114 - protein, 115 aa, Zea mays
  misc_feature: Ceres CLONE 1381773-F
MASISEPAAREKPIVVRVKRKPSQNRPDAFWLEINERPAKKAAIDFSRLSISEPSSSSASVKASEEPRVKKILVQHIETVHHSEAVEDALQSLLLVDSNSKETKSKTKERNDRIK

SEQ ID NO: 17115 - DNA, 751 bp, Zea mays
  misc_feature: Ceres CLONE 1381774-F
  misc_feature (751)..(751): n is a, c, t, g, unknown, or other
gccggctggagctcaccgcggtggcggccgctcatgaactagtggatcccccgggctgcaggaattcgcacgagaccattacctagaacatcctaatcgaaaatgcggtctgcctctgcccttaccgctacgctttcctcccggattccagcagcgaaacacgcgcggggcaaggacggagctggtaagccgatcgagccggcgagggtggaccagatgatgatggccgaggtggtcgccaaccaccgcacaacgacccccaacgacgggtactccagtgccaaacccgccgccgccgccgccgccgagcccagaggagccgtgaaccccgctcttgtccccgaagaacccggccgacataccaacgttcccgccaaccgcggcgcgcagccgccacagcgagataaagggacaggaacccccccaccagagacacgggagcggcgacgctcataggggcccgaccgtcccggcttcgcagcccaccccgtcttccccggccgcggaccgtgggggccccccccccctgcagccagcgccctcgcgcccgccgcgtggccgcctctccccccgcgcccggctaccccccaccccccccggcggcggcgagccccccccgctcctccacgctccccccccggcccccttccacctccgcgatcacaccccccccgcaccatgtctgccgtccgcccgctcgctgccccctccgcgtcccgtcgctcgccgcccccccccctcacacccccan

SEQ ID NO: 17116 - DNA, 687 bp, Zea mays
  misc_feature: Ceres CLONE 1381778-F
  misc_feature: Encodes the peptide sequence at SEQ ID NO. 17117
  misc_feature (462)..(462): n is a, c, t, g, unknown, or other
  misc_feature (687)..(687): n is a, c, t, g, unknown, or other
ccagctggagctcaccgcggtggcggccgctctagtactagtggatcccccgggctgcaggaattcgcacgagaccattacctagaacatcctaatcgaaaaccttccattcacccgcagctcccatcctctcgctcgccaggagaagcagccgccgttgctgctgccgcgtccacagaatggggggtttcgtgaagactcataagaccaatgcgtatttcaaacgtttccaagtgaaattcaagagaaggcgggctggcaagacagactacagggccaggataagggtgattaaccaagacaaaaacaagtacaacacacccaaatacagatttgttgtgcgatttaccaacaaggacatcactgcccaaatcatatctgctagtatagcgggtgatatggttcttggttctgcctactcccatgaattgccacgataatgggcttgaacttggcctgacncactatgcccctggcttgttgaacacgccttctgttgcctcccccccgtgtccagtaccccgccctatgcctgtagttccacacaccctacatgcatgctcactcacgcagctctttctctgtctagatagttctcataacctgcgtccttctagtacctcgattcttctctttctccccctgatgcttgttaatacccggccttacaaaaccttctcctctccn

SEQ ID NO: 17117 - protein, 86 aa, Zea mays
  misc_feature: Ceres CLONE 1381778-F
  misc_feature (27)..(87): Pfam Name: Ribosomal_L18p Pfam Description: Ribosomal L18p/L5e family
MGGFVKTHKTNAYFKRFQVKFKRRRAGKTDYRARIRVINQDKNKYNTPKYRFVVRFTNKDITAQIISASIAGDMVLGSAYSHELPR

SEQ ID NO: 17118 - DNA, 650 bp, Zea mays
  misc_feature: Ceres CLONE 1381781-F
aaagtggagtccccgcggtggcggcgctctagaactagtggatcccccgggctgcaggattcgcacgagaccattacctagaacatcctaatcgaaaagcttttgtattcctcgctgccgcgacgccaccccctacggtaatgcaagaggaggaacggatgaccaatggcgaccaagatattttccctccttatgctccttgctctttctgcatgagttgttaacgcgacaattttccctcgatgctcacaagctcctataggttcccttcttcccccataccttccatcaatgataggttcagtatgtgaaaacccagctcttcagccctataggctccaacaagcaatcgcagcaagcaacatacctttatcaccgcttgttgtttcaacaatcgccagccctatctttggtgcagtcattggtacaaaccatcagggcacagcagctgcagcaactcgtgctacctgtgatcaaccaagtagctctggcaaacctttctccctactctcagcaacaacaatttcttccattcaaccaactgtctacactgaaccctgctgcttatttgcagcaacaactattaccattcagccagctagctactgcctactctcagcaacaacaacttcttccatttaaccaattgg

SEQ ID NO: 17119 - DNA, 695 bp, Zea mays
  misc_feature: Ceres CLONE 1381783-F
  misc_feature: Encodes the peptide sequence at SEQ ID NO. 17120
  misc_feature (14)..(14): n is a, c, t, g, unknown, or other
  misc_feature (22)..(22): n is a, c, t, g, unknown, or other
  misc_feature (25)..(25): n is a, c, t, g, unknown, or other
ccccgctggagctnccacgcgntgncggccgctcttgcactagtggatcccccgggctgcaggaattcgcacgagaccattacctagaacatcctaatcgaaactctcgaaaccctagtcccctgctccattctcagccgccgccaatcccttcccgtgctccgcaaccgctgagtgagaagaagagatggccggcaaaggcgatggcccggctatcggcatcgatctcggcacgacgtactcttgcgtcggcgtgtggcagcacgaccgcgtcgagatcattgccaacgaccagggcaaccgcaccacgccctcgctacctctgctgcaccgactccgagcgcctcatcggagatgcggccaagaaccaggtcgccatgaaccccatgaacacccaccttcgatgccaagcgtcgcatcggcaggaggttgagggatgcgcccggccacaccgactacccgccgcggcccgcccagcacccccccggggcaggggcgagagccccccgcctgccgcccggggcgcaggagcagcggcaagccctcggcaccggcaagcagagctcccgcgagggcgtgtgataccgacggcgccgacaccccgcccccacaccccctcgcgtccggcagaagggcgagacgcggtgaggcgcaacccgttcgcctgagaggtcctgacaaccggcccgcgccat

SEQ ID NO: 17120 - protein, 81 aa, Zea mays
  misc_feature: Ceres CLONE 1381783-F
MAGKGDGPAIGIDLGTTYSCVGVWQHDRVEIIANDQGNRTTPSLPLLHRLRAPHRRCGQEPGRHEPHEHPPSMPSVASAGG

SEQ ID NO: 17121 - DNA, 610 bp, Zea mays
  misc_feature: Ceres CLONE 1381784-F
  misc_feature: Encodes the peptide sequence at SEQ ID NO. 17122
  misc_feature (21)..(21): n is a, c, t, g, unknown, or other
ccccgctggagctcaccgcgntggcggccgctctatgcactagtggatcccccgggctgcaggaattcgcacgagaccattacctagaacatcctaatcgaaaaacgcacctcccgacttctccggttctcccttcttcatagcagccacccacgcatctcagcgccgaggcgagcgaggacctcgtggttcgtgccctgctcacctcgtgaggatgtggatcgcgaggcggctcttcctcgcggcggcggcgctgctgatggctgtgcttctgctcgtcgcggggccgctggcgggccgggtcgtggcggtgtggggcgctgctccccccctttcggtcttgtgtgccccctctctttttttgttcccgccccgtcccggggccccctctttcgctcttctttgccgctcccccgcgccccccccctccgttttccctcctccctgtttccccccctccgcccgccccctccccccctcctttttccccccccccccgctgtgtggtgtgtttttcccctccccccgcctctctcccctcccccccccccccccccccccccgctcccctgcctgagtcctgcgcctcctctcctcccccgcccccccc

SEQ ID NO: 17122 - protein, 120 aa, Zea mays
  misc_feature: Ceres CLONE 1381784-F
MWIARRLFLAAAALLMAVLLLVAGPLAGRVVAVWGAAPPLSVLCAPSLFLFPPRPGAPSFALLCRSPAPPPSVFPPPCFPPSARPLPPSFFPPPPLCGVFFPSPRLSPLPPPPPPPRSPA

SEQ ID NO: 17123 - DNA, 666 bp, Zea mays
  misc_feature: Ceres CLONE 1381787-F
  misc_feature: Encodes the peptide sequence at SEQ ID NO. 17124
ccagctggagctcaccgcggtggcggccgctctagaactagtggatcccccgggctgcaggaattcgcacgagaccattacctagaacatcctaatcgaaaagtcgttctcgtctttcggtactcgcgcgcgccagctcacttctctacttcccttccccagatctacctccattcttccctcaaaatcacagatctctctcggccccgtgcccagcgctccgaaaccctagcgccgccgcgggtgccaggccgcgagcgtcgccatgggcatcgtgtttacgcggctcttctcgtcggtcttcggtaaccgcgaggctcgcatcctcgtcctcggcctggacaatgctgccaagaccaccatactctgcggccaaacaagcatcaggccatactggtggtgctactttccccacgcccaggctatcatatatgttggtgattccagccataccgacaggcttgccacctgcggaagaagaatgcaatgccaccccttgaggacgacgcactccaaggtagcagccgtctcttgcgcattgccataaacccctgctcgtccacgcagccgcccatcccccacctctcttaacgaccccacaacccaccacccccctgtgggccgtctcccgcacacccctgctcccgaaacgtcacagccgcgact

SEQ ID NO: 17124 - protein, 93 aa, Zea mays
  misc_feature: Ceres CLONE 1381787-F
  misc_feature (5)..(90): Pfam Name: Arf Pfam Description: ADP-ribosylation factor family
MGIVFTRLFSSVFGNREARILVLGLDNAAKTTILCGQTSIRPYWWCYFPHAQAIIYVGDSSHTDRLATCGRRMQCHPLRTTHSKVAAVSCALP

SEQ ID NO: 17125 - DNA, 685 bp, Zea mays
  misc_feature: Ceres CLONE 1381790-F
  misc_feature: Encodes the peptide sequence at SEQ ID NO. 17126
  misc_feature (685)..(685): n is a, c, t, g, unknown, or other
ccccgctgtagctcaccgcggtggcggccgctcttgcactagtggatcccccgggctgcaggaattcgcacgagaccattacctagaacatcctaatcgaaaaaagtagtagtagtaagtaagaacagatgtcaaacaacacttcccatgttcctcccatgcccctctctcatcacttcagcgactatggcttcgatccccagatcgactactttcaggttttggaagaagcgaggaagcacaagaaagaaactccctccattgacagtatacatcagttcaagctccagaaacctatatctaaggatgatctgatccgaaccgctctccacaagaagaagaagcgctggttcttgaaaaacgctatgctcttcttcagctggcggaaatggcgaaggcgaggcagtcattacccagaggaaggagacgtggagatggaactcgacgttcacatggcgagggctaggaactttcgcgccacatcatccccccccccccccactccataactggtccgcttcacgcccacgccaaactcttgcgagagtgcctaggctcgccctcaccgcacgccaaacgacacatccttccgtcgacgatcagccgtccagccccctccttccgctctcatctccccccacacgataccctccccccctctaatccccgcctctccacgcccccn

SEQ ID NO: 17126 - protein, 116 aa, Zea mays
  misc_feature: Ceres CLONE 1381790-F
MPLSHHFSDYGFDPQIDYFQVLEEARKHKKETPSIDSIHQFKLQKPISKDDLIRTALHKKKKRWFLKNAMLFFSWRKWRRRGSHYPEEGDVEMELDVHMARARNFRATSSPPPPTP

SEQ ID NO: 17127 - DNA, 687 bp, Zea mays
  misc_feature: Ceres CLONE 1381792-F
  misc_feature: SWISSPROT Homolog: EC 1.1.1.1 Alcohol dehydrogenase
ccaagctggagctcaccgcggtggcggccgctctacaactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtggggaccgggccagccactggtgatgcaggacgtgcaacattcccccccttactctttcctatttggtgtccatccaaggcacccctcccccaccaccccctcttccccccttctccctcccctcccttctctcttttcttctctcctcccttcttcccacccttctttaacaaatccctctgttcccgctggtgggactccccccccctctacacccctctatcactttcaaccccccctccccctccccccccccccacccccctcctcctccctcccccctcttgtttaatgtaccataactcccccctccttcctcctctctccccccccttccctcccccctttcctccctttcatccttccctccccttcccccttccctcacaatgtag

SEQ ID NO: 17128 - DNA, 637 bp, Zea mays
  misc_feature: Ceres CLONE 1381794-F
  misc_feature: Encodes the peptide sequence at SEQ ID NO. 17129
  misc_feature (637)..(637): n is a, c, t, g, unknown, or other
caagctggagctccccgcggtggcggccgctctagtactagtggatcccccgggctgcaggaattcgcacgagaccattacctagaacatcctaatcgaaaaaccgaggccaaaggccaccaccattccttccccaactctgcaggctgctcgtcgccctccctccacgccggacgcgccccgatccagatccaggggcgtaacatggcatcaaaacgtatcctcaaggaattaaaggacctgcaaaaggaccctccaacgtcatgcagtgcaggtcctgctggtgaggatatgttccactggcaggcaaccatcatgggtcctcctgatagtccatatgctggaggtgttttcttagtgaacattcatttccccccggactaccctttcaagcctccaaaggtatcttttaagacgaaggtcttccatccaaacatccatagcaatggaagcatatgtctcgacattcttaacgagcagtggagccctggcttcgccatccccacggtccttgcttcccatctgctccccccttactgatccccacccacacgatccctcttggccctcgctatgcccccccgcaccaccactcttgtccccccccccactccaccccccccccccggcaccagan

SEQ ID NO: 17129 - protein, 111 aa, Zea mays
  misc_feature: Ceres CLONE 1381794-F
  misc_feature (5)..(111): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSAGPAGEDMFHWQATIMGPPDSPYAGGVFLVNIHFPPDYPFKPPKVSFKTKVFHPNIHSNGSICLDILNEQWSPGFAIPTVLASHLLPPY

SEQ ID NO: 17130 - DNA, 692 bp, Zea mays
  misc_feature: Ceres CLONE 1381795-F
  misc_feature: Encodes the peptide sequence at SEQ ID NO. 17131
  misc_feature (248)..(248): n is a, c, t, g, unknown, or other
  misc_feature (286)..(286): n is a, c, t, g, unknown, or other
aaagctggagctccccgcggtggcggccgctctagaactagtggatcccccgggctgcaggaattcgcacgagaccattacctagaacatcataatcgaaaaatcaaccatattattgagaccaacaagcaacatagaaagtggaatccagtagcaacaacagagcaacaatggcgaccaagatattttccctccttatgctccttgctctttctgcatggtgtgctaacgcgacaatttcccctcantgctcacaagctcctatagcttcccttcttcccccatnacctcccatcatgatagcttcagaatgtgaaaaaccaagttcttcagccctataggttccaacaagcaatccgaacaagcaaaatacttttatccccctgggggttacaaaatccccagccttatttttgggggacgttttgggaaaaaaccttggggacaaaagtttggaaactttggggtattggggaaaacaccaagaagttggggaaaaattttcccccctcttttatagaaaaaaattttttttttttaaaaaagtggttaacaaaaaacccggggttttttttttgaaaaacaaatattacttcttccgcggtgtgttggtggtctttttccaaaaaaaaaaaatttttttttaaaaaaaaaaagggggcgcccccaccccccctcttttttttttaaaa

SEQ ID NO: 17131 - protein, 56 aa, Zea mays
  misc_feature: Ceres CLONE 1381795-F
  misc_feature (26)..(26): Xaa is any aa, unknown, or other
  misc_feature (39)..(39): Xaa is any aa, unknown, or other
MATKIFSLLMLLALSAWCANATISPXCSQAPIASLLPPXPPIMIASECEKPSSSAL

SEQ ID NO: 17132 - DNA, 783 bp, Zea mays
  misc_feature: Ceres CLONE 1381796-F
ccagctgtagctcaccgcggtggcggccgctcttacaactagtggatcccccgggctgcaggaattcgcacgagaccattacctagaacatcctaatcgaaaaacaagtcagaaaaaaaaaagaataagaagaaaggaatccctcctacgcggaagcgaagagattcgtcgcctcagccgcctctctgctcagatctgcggcggagcctcgccagcgggctgcgccccgcggcgccgccgatcccccaccccttccccgcgcgccggccgctccccccccccccccctgccccccctccgcccgccaccacccccgtcgccccccccacccacctgcccacccccccctcgccgccgccgcgcccctccccgcgcccgcgcccgccacccgggggcgcccgcaccgcggcgccatcgtcgcgccccccccccgccgacccccccctccccccctcccccgcccccgccccccccccggccttcccacatcactctcccggcggcgccgccccccccccgttgagagggaggtgcgcacgagggcccccccccactactccgcgcgcgcgcctcccgccacgtcttcttgctcctcacctcgcgcgcccccacctcaccgcccaccccccccccccccttccctctccctctcctcccccgcctgcgggcacaccccccccccacctcctcccccttccacgaaccgcacagcaaccccccgcctcccgcccgcacgcccaccccgggccaccaccaattgatagcgccccctctccccccatg

SEQ ID NO: 17133 - DNA, 704 bp, Zea mays
  misc_feature: Ceres CLONE 1381798-F
  misc_feature: Encodes the peptide sequence at SEQ ID NO. 17134
cccgctggagctcaccgcggtggcggccgctctatcactagtggatcccccgggctgcaggaattcgcacgagaccattacctagaacatcctaatcgaaaactgaattcttttctactagagctagagccaggcagccagccaacgccaagcggggtaggttgactcttctgtctacagcacctacctcttcacaccaactgccgcccctgctccgagaaccagaatggccgccgccgatgcatcttcgttgcctccgtccgccatcacctgccgagcggcggtggcgtcgcgaccgtaccagccactggtgatggacgagccgcaccccccccctcccctccccttcccttccccttttatttttctcatcccctactactattttatagtcctccattcttcgcccccccccctctcccccttcgcctccctcctcccccctctcccctcgtttcttcccctcccctctgttctctttagcatatttatggagtatctactcctttttccccccccccccccccttctctctcgctttcccccctgctcctcccctctcctccccccccccacacatatttgacccctcccctctctcctctttgttcccggttctttactcctcccccccctccccccgcccttcttcctctctcttccctgtccccccacccaccctcctcaccccacctcccaccccg

SEQ ID NO: 17134 - protein, 31 aa, Zea mays
  misc_feature: Ceres CLONE 1381798-F
MEYLLLFPPPPPLLSRFPPCSSPLLPPPTHI

SEQ ID NO: 17135 - DNA, 704 bp, Zea mays
  misc_feature: Ceres CLONE 1381802-F
  misc_feature (21)..(21): n is a, c, t, g, unknown, or other
gcctgctggagctccacgcgntggcggccgctcattcttagtggatcccccgggctgcaggaattcgcacgagaccattacctagaacatcctaatcgaaaagaatttgttcctcgtttcgctgccagcccaatcggttcagtttcggcggtaacaagatcccctgcggtcgccagtcgattctgtgagactgccagccatggagttgataagttcggtctcctttaaccgttttgattctggtcccccccccccctccgtgaccccccgcccgtgcccgccgagacgcctgcccttcccacctccccaccctacgggcgcccaacccatggcacccggggggtgtcggacctacaaccctttgtatgttacctggcgtgggcgacgaggcaccgtccccccccctacccaccctcccacacaatggataagcgatcaccccccacccccctcgcccccctcgcctccacgcgtagcccacccgtggtcgtgctcgcgccccgtgtctcctcctcgtccaccacctcggccacacataatattaatgtcggggcgccgcgacagccctcagcctccttcgccttaggcgaccgctgtcctccgccacctccctcccccccggccaccccaccccctcgaatataacaacaacaaaccgcaataagaacgctccgaccccccccgcgaccccccccctccatcct

SEQ ID NO: 17136 - DNA, 669 bp, Zea mays
  misc_feature: Ceres CLONE 1381805-F
  misc_feature: Encodes the peptide sequence at SEQ ID NO. 17137
caagctggagctcaccgcggtggcggccgctctacaactagtggatcccccgggctgcaggaattcgcacgagaccattacctagaacatcctaatcgaaaagattatatcgaaaatctggacggcggcggactcgattgtagcagcagccgccgggaacaagatggcggcggcgttgtcgcagctggacgacgagatcgtccgcggcatggccatcggcgctgtcttcaccgactatgccgggaagataaactgcctcgatttccaccgcaaggaagatctcctcgtcacttccagcgaggacgactccatccgcatgtacaacatcaccagcgcgacgctctcaccccctccctctcacaggaaacatgacgctgaccgcgcctgccccacccatcatccacgcgcccccccctgcctcctccgacacaacctacagtcttgccgaatcactttgttacccgtccacggggatgggggcggccccccccccccccttcccatggtctcgggtatgggctcctctcctccctccccccccccccctcccctcccacccctccccggccttaactaccccaccttccagttgttatgaacactgcctcactctcctccccaccctccttccctcccgccccctcctcaccctcccccccgcccctctcc

SEQ ID NO: 17137 - protein, 144 aa, Zea mays
  misc_feature: Ceres CLONE 1381805-F
MAAALSQLDDEIVRGMAIGAVFTDYAGKINCLDFHRKEDLLVTSSEDDSIRMYNITSATLSPPPSHRKHDADRACPTHHPRAPPCLLRHNLQSCRITLLPVHGDGGGPPPPLPMVSGMGSSPPSPPPPPLPPLPGLNYPTFQLL

SEQ ID NO: 17138 - DNA, 757 bp, Zea mays
  misc_feature: Ceres CLONE 1381806-F
  misc_feature (1)..(1): n is a, c, t, g, unknown, or other
  misc_feature (757)..(757): n is a, c, t, g, unknown, or other
nccggctgtagctcaccgcggtggcggccgctcctgcatagtggatcccccgggctgcaggatttcccacgagaccattacctagaacatcctaatcgaaaaattatcaagaaaccatgagttctaggttagctgaaatctcccttattgtaatctgttcatctcctggcgtgagtctgtggcgctagtgtgatgccttctcctagctcatggcttccggctcgcactccctaatcctgctctcacttaagcgctcgcgagctctctccagtgcataaagattgcagatctcagttctagcccaagaaacggccgcggcgccctccctgccgccgtcgcgaccacgcccggggtgagccccctcatcttcactaccccccccctgccccattacggccctcccctctgcgacatgtgtgctcttcccagctccgcccgacccgccgccgcctctggcctactccgcttgcgcgtcgcgcctgcccccgtccgacctccctcccccccccccttgaagccccgcgtgcgggcccccccccccctcccccgtgtttggtgtgatctccccctcgcccccggccccctcccgctccctaccagcgggtcgccccgctccctcccgcccgtggccacgtgccgcccgcctaccctctcccctgacatatatcgcgtttcttcccgccgccctcccctcagtcccctcaccctccgtccccaaacgtcttcgccctctcctcccctacgcgctcccctcccn

SEQ ID NO: 17139 - DNA, 642 bp, Zea mays
  misc_feature: Ceres CLONE 1381807-F
cccgctggagctcaccgcggtggcggccgctctagaactagtggatcccccgggctgcaggaattcgcacgagaccattacctagaacatcctaatcgaaaagtaccacgttcaaaacggcaagtcgatcgatctgaaaccacagatcgatcgacgaccagcagaagacgacgtacgtgaaaccgcgagacagtgcgaggacgactggggtgtggcggtgcgatccatcgacaaggccatgggacaacggcgctttgaggacgaacgcgcagctctggcgactgtggcaagcttgctgctcatcctaacgacagcccaagctgctgctgctgctgcttctggacgccatctgtctttgcccacgcagaaggcggcggcggcccgcatgaaccaacccattactagtgacacgcacgtcatcacagcccgcgccactcgctatctcgacggcggttcgtacgcgccccggcccccccccctccctcagcacgttgggtgggcctcccgaccctccgcccccccttctgcaccaggtaggtgccggccctccccctgcgcctcccactccccctccggcgtccccagcttgtcttcctctgcccccccctcaaagctcctgctcgccacttcctttttccctcc

SEQ ID NO: 17140 - DNA, 865 bp, Zea mays
  misc_feature: Ceres CLONE 1381809-F
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
gggttggcccntcnnntttcccgtgctcccctccctccctccacggttttacaaagtgggactccccgcggtggcgggcgctctataactagtggatcccccgggctgcaggaattcgcacgagaccattacctagaacatcctaatcgaaaacttaaagcacgcgcgcgccctgagctccccctcagtcctcgctagtcctttctccatcacaaacgctattcttttttccctaaagctcggagaccgccggaagcagaccaatggggcgctggccacccaccaaccacgccccgtcttgccccggggggtccccccccccgttttgtccccgttctccccatacccccacctctccgtcaggcgcccgcgctggatcctcccccccccccccccccgctcgaatgtgagtccaccaccctccacccccaaatatccgtgatctcgcctccccgcccctcgcccagctcccctttccccttttccccttgcccctctccgccccccgcggcgccggccccgcccccaaatcgcgagcttatatgcttacccgcccccttacgccctgcgtgcggttgtgctcccccctcgccccacctacgacacctaactttcaattccccccctcccctcccgtccccccccactccccctccccacccatctcaccccccgccccccggcgctgtcggtggtgttggacgttataaaaaatacaatttttccttgcagctctgcccccccccccacaccaaacagatacgcgatcctttcccgccgcaaccccacccgcgccacactgcatggctgcaattataagtgtgtaggtgcactcctcgcaccggttccagcagaacgcaacgca

SEQ ID NO: 17141 - DNA, 647 bp, Zea mays
  misc_feature: Ceres CLONE 1381812-F
  misc_feature: Encodes the peptide sequence at SEQ ID NO. 17142
aagctggagctccccgcggtggcggccgctctagaactagtggatcccccgggctgcaggaattcgcacgagaccattacctagaacatcctaatcgaaaaattattatttcttcttccagcggcaattcctggccaccaccgggcgcgctatattactccgggttcgtggacaagcatgcagaggggcgtgtccttccctggcggaatggcgaaggagtgcccgcccgccgagctctggctcccggacgagttcctggacgacgacttcttctccgaggaggagaaggcggcggtcgcggccaagagcgagagcgacgaggaggaagggatggacggcctctcgcgccgcgcgggcgggctcgtcgtcgggggtggaggggacggttcccctgcaaaggcgcaagtgttagccggctcgccgcaatcgattctgtgcggcctgcatgcttcccgggaaggacagcccccacggcgcggcgtcgcaagtcaggtccgccgccgtcggccgccgctggaaaagaccccgggccgaccactgggaaccttgttcaaaaaaggcggcccggccaaggtgggcccgcatggcgcaaaacctaacgggaatcccttggtgggaaaacaaaacggggggggcacattaaaaga

SEQ ID NO: 17142 - protein, 156 aa, Zea mays
  misc_feature: Ceres CLONE 1381812-F
MQRGVSFPGGMAKECPPAELWLPDEFLDDDFFSEEEKAAVAAKSESDEEEGMDGLSRRAGGLVVGGGGDGSPAKAQVLAGSPQSILCGLHASREGQPPRRGVASQVRRRRPPLEKTPGRPLGTLFKKGGPAKVGPHGAKPNGNPLVGKQNGGGTLK

SEQ ID NO: 17143 - DNA, 736 bp, Zea mays
  misc_feature: Ceres CLONE 1381817-F
  misc_feature: Encodes the peptide sequence at SEQ ID NO. 17144
aaagctggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaatacgatcgccctggggagccaccaggaggtgtaccacccgggcgccctcaaggcggcgttcgctgagttcatctccaccctcatcttcgtcttcgccggccagggctccgggatgcccttcagcaagctgaccggcgggggcccgacgaccccggacgcccctgattgcgggggcggtgggcgcacccgttccgccctgttcctcgccggggtctgggggcggcgaacctcctcccgggaggcccgtgaaaccctggccgggaccctttcggagcctttcgggggggggaacccatcaccccgggttccggggggccctcctggcctggggtgggggccaacttgtgtggggtccaccccggggcgggggttcccggcctcccccttttctaaaggggggggggagggccccagggacccccttctcttttcaaaggcgcgtaccccccgcgcgccaaaggaccgggaggttctcaaaaccccaaaaaaacctctgcgccccggggcgaccacccgggcgtcacccca

SEQ ID NO: 17144 - protein, 179 aa, Zea mays
  misc_feature: Ceres CLONE 1381817-F
MPINTIALGSHQEVYHPGALKAAFAEFISTLIFVFAGQGSGMPFSKLTGGGPTTPDAPDCGGGGRTRSALFLAGVWGRRTSSREARETLAGTLSEPFGGGNPSPRVPGGPPGLGWGPTCVGSTPGRGFPASPFSKGGGEGPRDPLLFSKARTPRAPKDREVLKTPKKPLRPGATTRASP

SEQ ID NO: 17145 - DNA, 607 bp, Zea mays
  misc_feature: Ceres CLONE 1381819-F
  misc_feature (355)..(355): n is a, c, t, g, unknown, or other
aaagctggagctccccgcggtggcggccgctctattactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggatgcatctccccaccggccggggcccacntgggccgccgccggtcccctggccccccgggcattgggcccccctttaatttggcgggccccatgggaaaaccaatttaacgccccggggtttacttttttccccacccaaccctgggcgggggaaaaaggcgattacaaccccggtggaattttggggaaaccccggggggtgggaaaccccccccccctgggggcaaaggggggaaatttctttgggggggagatttggggccccccccccccccccccc

SEQ ID NO: 17146 - DNA, 664 bp, Zea mays
  misc_feature: Ceres CLONE 1381823-F
  misc_feature: Encodes the peptide sequence at SEQ ID NO. 17147
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcgacaccagcaagctgacgctggcgaggaccgcgacagcggcgtggacgcctacgtctcccgctccgggaggggcgagtggccgcggccagggcctgggccgccaccagggtccaggcgggggagaccccaggaatgcattgaggggtggccgcccccccggaactggcccgccaaatttggaagaaggaatacggtccccgccaaccaaaaacgcgggccaaattcccggcaaaaggtgcca

SEQ ID NO: 17147 - protein, 150 aa, Zea mays
  misc_feature: Ceres CLONE 1381823-F
MGKGSVGASWWAFLLLAGVLLVVAATAGAEDGVVERDRKEDLRWCKQACEWQYGKDTPRKRECESECRERHQQADAGEDRDSGVDAYVSRSGRGEWPRPGPGPPPGSRRGRPQECIEGWPPPRNWPAKFGRRNTVPANQKRGPNSRQKVP

SEQ ID NO: 17148 - DNA, 659 bp, Zea mays
  misc_feature: Ceres CLONE 1381829-F
  misc_feature: Translation starting site: 268
  misc_feature (96)..(96): n is a, c, t, g, unknown, or other
  misc_feature (118)..(118): n is a, c, t, g, unknown, or other
  misc_feature (125)..(125): n is a, c, t, g, unknown, or other
  misc_feature (149)..(149): n is a, c, t, g, unknown, or other
  misc_feature (162)..(162): n is a, c, t, g, unknown, or other
  misc_feature (170)..(170): n is a, c, t, g, unknown, or other
  misc_feature (530)..(530): n is a, c, t, g, unknown, or other
  misc_feature (555)..(555): n is a, c, t, g, unknown, or other
aaagctggagctccccgcggtggcggccgctctagaactagtggatcccccgggctgcaggaattcgcacgagaccattacctagaacatcctaantcgaaaaaaaaaaacaaagggnagaagcntctcctcagaagcatatagcaccnagcggaacacggngaacggcnggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggagatgtgggcgctggcaaatctagcttggttcttcggtttgttaagggacagtttgttgattccaggaatcaacaattggagcagccttcttttccagacctttagcgtcaatgatgagactggtaagtttgaaatctgggatactgcccggcaagagaagtatcatagcttggctcccatgtactataggggtgcagctgctgccattngtgtctatgacatcacaaatccggnctcctttcaccggtgcaagaaatgggttcaagaaacttcaagcctcaggaaatcagaataccatagtgggctctggctggaaacaaggctgatatgctagatgc

SEQ ID NO: 17149 - DNA, 663 bp, Zea mays
  misc_feature: Ceres CLONE 1381831-F
  misc_feature: Encodes the peptide sequence at SEQ ID NO. 17150
aaagctggagctccccgcggtggcggccgctctagaactagtggatcccccgggctgcaggaattcgcacgagaccattacctagaacatcctaatcgaaaaaaaaaaaaaagcacacaccacgcagggcacaaggagaagaagaggggaagaaatattcttcccgtcgaaagacggagagaggaaaagggacaagggcaaggcaagagagaggcgtcgtcgtttgatctgctgccggagtgcgaagaggaagaggaagaggagcgccggagttgtaaagatgttcctggtggactggttctatggggtgctggcatcgcttgggctgtggcagaaggaggctaagatcctcttccttggcctcgacaacgccggcaagaccaccctcctccacatgctgaaggacgagcggctcgtacagcaccagccgacgcaataccccacgtcagaagagttgagcatcggcaggatcaagttcaaggcgttcgaccttgggggccaccagatcgcccgccgcgtctggaaggactactacgccaaggttgatgctgttgtgtacttggtggatgctgttgacaaggaacgttttgccgagtcgaagaaggagctcgatgcgcttcttgcagatgactcccttgcaaacgttcctttcctcatactggg

SEQ ID NO: 17150 - protein, 127 aa, Zea mays
  misc_feature: Ceres CLONE 1381831-F
  misc_feature (6)..(127): Pfam Name: Arf Pfam Description: ADP-ribosylation factor family
  misc_feature: The sequence is a functional homolog of SEQ ID NO 11 in US patent 7259294
MFLVDWFYGVLASLGLWQKEAKILFLGLDNAGKTTLLHMLKDERLVQHQPTQYPTSEELSIGRIKFKAFDLGGHQIARRVWKDYYAKVDAVVYLVDAVDKERFAESKKELDALLADDSLANVPFLIL

SEQ ID NO: 17151 - DNA, 747 bp, Zea mays
  misc_feature: Ceres CLONE 1381833-R
  misc_feature (37)..(37): n is a, c, t, g, unknown, or other
  misc_feature (46)..(46): n is a, c, t, g, unknown, or other
  misc_feature (49)..(49): n is a, c, t, g, unknown, or other
ttgtgtttttttggttgtgggcagcgaacaatacctnaacatgtanatnataaaattgggtaccgggccccccctcgaggtcgacggtatcgataaagcgtacgtcgctcgtacacgggctcgccggtcacctgcgcgcacgctgcggctgcgggtagggcgcaacgcgcgtccgtcgagcaccgtccgtcggcgcccgcccgcctgcgccgctcccgcccccgccgtcgcccttcacgatgtcctccagcatcttctgcaggtcctccagcgtgtccggcttctcgtttttcacgctatccatcatcaccagcatctcctgcatgaagtcggagaaatcctggtcgtcgtcgtcgagggggtcgaagagcccggcgtcgtacatggccttcttccccttgtccgacagaactgcaccaccgccaaccaaacaagcaatattcgatcaaatctcctaaagccaggcaaagccaaacacgtaggctgtggtaggccttaccggagtatgcctcctgggatccgctggaaccgctgaatggcctcgccggccgccgccggggtcgctggcccacccggtccggggtgcccatttcatcgcgaagccttccggtaacccggcccttatgtccggtggccggaaggcgttctttgcgggaagccccaaggaaccgcgttaaattaccaaccccgttccaatgcgccccgccccgcttgcctccccgggaagggaatttggtccggaatccc

SEQ ID NO: 17152 - DNA, 664 bp, Zea mays
  misc_feature: Ceres CLONE 1381838-F
  misc_feature: Encodes the peptide sequence at SEQ ID NO. 17153
  misc_feature (613)..(613): n is a, c, t, g, unknown, or other
aaagctggagctccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggccttttcagatccatgaagtacggatcccgccgtgggaaccaaactatggcattgctacttccaccaaaggggccttctcctgggttgatgcccccaagttggatgacaagactttgcccggnaaaaaaaccaaaaggggaaaaaacccgggggccgattttttaaaaccaaaa

SEQ ID NO: 17153 - protein, 166 aa, Zea mays
  misc_feature: Ceres CLONE 1381838-F
  misc_feature (1)..(49): Pfam Name: Ribosomal_L6e_N Pfam Description: Ribosomal protein L6, N-terminal domain
MAPTSKLSTGIKRASRSHTYHRRGLWAIKAKNGGAFPKADKAAAAVEPKFYPADDVKPRVPSTRKPKPTKLRSSITPGTVLILLAGRFMGKRVVFLKQLKSGLLLISGPFQIHEVRIPPWEPNYGIATSTKGAFSWVDAPKLDDKTLPGKKTKRGKNPGADFLKPK

SEQ ID NO: 17154 - DNA, 665 bp, Zea mays
  misc_feature: Ceres CLONE 1381843-F
  misc_feature: Translation starting site: 344
  misc_feature (502)..(502): n is a, c, t, g, unknown, or other
  misc_feature (522)..(522): n is a, c, t, g, unknown, or other
  misc_feature (531)..(531): n is a, c, t, g, unknown, or other
  misc_feature (540)..(540): n is a, c, t, g, unknown, or other
  misc_feature (553)..(553): n is a, c, t, g, unknown, or other
  misc_feature (579)..(579): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatgccggcgccgctcctggtgctcaacctcatcatgtacatcatcgtcatcggcttcgcgagctggaacctgaaccacttcatcaacgggcagaccaactaccccggcgtggccggcaacggcgcgacgttctacttnccctggtgtcgccatcctgnccggcgtgntgggcgcgncgtccaagctggncggcgtgcaccacgtgcgcgcctggncgcacgacagcctggccaccaacgccgcgtcgtcgctcatcgcctgggccatcancgcgctcgccttcgggctggcctgcaaagaa

SEQ ID NO: 17155 - DNA, 645 bp, Zea mays
  misc_feature: Ceres CLONE 1381845-F
  misc_feature: Encodes the peptide sequence at SEQ ID NO. 17156
  misc_feature (303)..(303): n is a, c, t, g, unknown, or other
  misc_feature (368)..(368): n is a, c, t, g, unknown, or other
tggagctccccgcggtggcggccgctctagaactagtggatcccccgggctgcaggaattcgcacgagaccattacctagaacatcctaatcgaaaaattttggctcctcactgccgcgccgccaccccctacaggtaaggaagaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacnaggctggcatgactcacattgtccgtgaggttgagaagccaggatccaaactccataagaagganacttgtgaggctgttaccatcattgaaacccctcctcttgtcattgttgggctcgtggcatatgtgaagactcctcgtggcctccgcacactcaactctgtttgggccaacatcttagtgagaagtgaggagaagttctacaagaactggtgcaagagcaagaagaagctttcacaagtatgctctcaatatgaaaatgatgctggcaagaagaaatcagctgcagcttgagagatgaagaatatgcttctgttatccgtgtcattgctcatacccg

SEQ ID NO: 17156 - protein, 147 aa, Zea mays
  misc_feature: Ceres CLONE 1381845-F
  misc_feature (51)..(145): Pfam Name: Ribosomal_L3 Pfam Description: Ribosomal protein L3
  misc_feature (50)..(50): Xaa is any aa, unknown, or other
  misc_feature (71)..(71): Xaa is any aa, unknown, or other
MSHRKFEHPRHGSLGFLPRKRSSRHRGKVKSFPRDDPKKPCHLTAFLGYXAGMTHIVREVEKPGSKLHKKXTCEAVTIIETPPLVIVGLVAYVKTPRGLRTLNSVWANILVRSEEKFYKNWCKSKKKLSQVCSQYENDAGKKKSAAA

SEQ ID NO: 17157 - DNA, 658 bp, Zea mays
  misc_feature: Ceres CLONE 1381848-F
  misc_feature: Encodes the peptide sequence at SEQ ID NO. 17158
  misc_feature (489)..(489): n is a, c, t, g, unknown, or other
  misc_feature (558)..(558): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattaccagaacatcctaatcaaaaaaagagattaggagacggtcgaccgccctcccgatcggggaagaagacgcgatcgatcaccccggcccccatggaattgttcaacggggtgcggttcgtgcgcctgcggtgctgcgcgcggcgcggtaagtacctggctgccggctccgacggctccagcgtgtgcctgacggggcagcgcggcgtgcacaacgcggtgtgggcggtgcaccacgcggcggggcccgacggcgggccctgcgtgctcctccgcggcgcctacggccggtacctcctggccaccagcgcgcaggccggcacggggccctcgcacggcgtggtcacggcgcaggacgggctcggcggcgccacgccgccgcccgggatgctgtggcaggccatccccaggnggtccaccttcgtcatccgcagcggcacggggcggtacctccgcgccaacggccggtacctgcggtggngcagggccgtcacctccgccggcgacaatggcagcaccatgatgcagtgggacattgagaacgtgcccatcagcatgacccgnccatgcattcttgatcc

SEQ ID NO: 17158 - protein, 162 aa, Zea mays
  misc_feature: Ceres CLONE 1381848-F
  misc_feature (1)..(149): Pfam Name: DUF569 Pfam Description: Protein of unknown function (DUF569)
  misc_feature (107)..(107): Xaa is any aa, unknown, or other
  misc_feature (130)..(130): Xaa is any aa, unknown, or other
MELFNGVRFVRLRCCARRGKYLAAGSDGSSVCLTGQRGVHNAVWAVHHAAGPDGGPCVLLRGAYGRYLLATSAQAGTGPSHGVVTAQDGLGGATPPPGMLWQAIPRXSTFVIRSGTGRYLRANGRYLRWXRAVTSAGDNGSTMMQWDIENVPISMTRPCILD

SEQ ID NO: 17159 - DNA, 656 bp, Zea mays
  misc_feature: Ceres CLONE 1381849-F
  misc_feature: Encodes the peptide sequence at SEQ ID NO. 17160
  misc_feature (595)..(595): n is a, c, t, g, unknown, or other
  misc_feature (641)..(641): n is a, c, t, g, unknown, or other
gctggagctccccgcggtggcggccgctctagaactagtggatcccccgggctgcaggaattcgcacgagaccattacctagaacatcctaatcgaaaaaaccatattattgagaccaacaagcaacatagaaggtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctcagcaacaacaatttcttccattcaaccaactgtctacactgaaccctgctgcttatttgcagcaacaactataaccatttagccngctagctactgcctactctcaacaacaacacttcttccatttaccnattggccgcactgaa

SEQ ID NO: 17160 - protein, 139 aa, Zea mays
  misc_feature: Ceres CLONE 1381849-F
METKIFSLLMLLALSTCVANATIFPQCSQAPIASLFPPYLPSIIASVCENPALQPYRLQQAIAASNIPLSPLLCQQSPALSLVQSLVQTIRAQQLQQLVLPVINQVALANLSPYSQQQQFLPFNQLSTLNPAAYLQQQL

SEQ ID NO: 17161 - DNA, 680 bp, Zea mays
  misc_feature: Ceres CLONE 1381852-F
  misc_feature: Translation starting site: 174
  misc_feature: SWISSPROT Homolog: EC 2.7.6.1 Ribose-phosphate diphosphokinase
  misc_feature (269)..(269): n is a, c, t, g, unknown, or other
  misc_feature (384)..(384): n is a, c, t, g, unknown, or other
  misc_feature (385)..(385): n is a, c, t, g, unknown, or other
  misc_feature (442)..(442): n is a, c, t, g, unknown, or other
  misc_feature (443)..(443): n is a, c, t, g, unknown, or other
gctggagctccccgcggtggcggccgctctagaactagtggatcccccgggctgcaggaattcgcacgagaccattacctagaacatcctaatcgaaaagtcaaagcagagtctgcccctccccgcgccgttctttttggttccccagtccccgccgccgccgaaacccgcagatggaggtcgtcgtcgccgcgaagcagaaggcgaagaacacatacacctcttctactgctcagaatgcgaggagctcgccctcaagatcgccgccngctccgacgccttcgagctccaatccatcaactggcggagcttcgacgacgggttcccgaacctgttcatcaacaaggcgcacgacatccgtgggcagcacgtggcggtcctggnnctcttcagctcgccgtcggtcatattcgagcagatctccgtcatcttcgcgctgccnnagctattcatcgcctcattcacgctcgtgctgccattcttcccacggggtcattcgaaggcggtgaagaaggagggaatttcccccccgggttccaccttggggggattttttgaaagattccccaaggggggggggggccttacaaagggtggtttttataaatttcccgggtctccgggaaggtttttttttgggaaaaatttccgccttggtttaaaaagggaatccccttctt

SEQ ID NO: 17162 - DNA, 669 bp, Zea mays
  misc_feature: Ceres CLONE 1381862-F
  misc_feature: Encodes the peptide sequence at SEQ ID NO. 17163
  misc_feature (442)..(442): n is a, c, t, g, unknown, or other
aaagctggagctccccgcggtggcggccgctctagaactagtggatcccccgggctgcaggaattcgcacgagaccattacctagaacatcctaatcgaaaagccaatcagccccatcactcttccgtcgtgtcttctcgcgctttccactcccaacgagatccatcacccccaacctctgtaagcttcccttgacgtcgtcgtcgtcatccatggagagcaaggacggtacccacgatcccgccacgacggccgcgccaccggccggcgcgccgcagcccgcgatgccttccgcggagacggcgcggtggggcacgcggcagatgggcccgccggcggcccccggggcgcacccggagaaccaagaggcggcgcggtggacggccgcgcgcggggaccaggagctgccgccgtacgtcatcatcggtgagccggtgggggngccgccgccggcacagcatagggggcagggggacagccccatggagcacatcctcgacttcttcaacacctgggagccccaaggccgaggaggtggcctccaacatctggggtcaatctgaaggccgcgccatccatgtcggaccgccgcatggggaaagttaaccctccggccgaaggcgctttccggagggcggctttccagaaagctgaacaagcagaactttt

SEQ ID NO: 17163 - protein, 116 aa, Zea mays
  misc_feature: Ceres CLONE 1381862-F
  misc_feature (77)..(77): Xaa is any aa, unknown, or other
MESKDGTHDPATTAAPPAGAPQPAMPSAETARWGTRQMGPPAAPGAHPENQEAARWTAARGDQELPPYVIIGEPVGXPPPAQHRGQGDSPMEHILDFFNTWEPQGRGGGLQHLGSI

SEQ ID NO: 17164 - DNA, 670 bp, Zea mays
  misc_feature: Ceres CLONE 1381869-F
  misc_feature: Encodes the peptide sequence at SEQ ID NO. 17165
  misc_feature (610)..(610): n is a, c, t, g, unknown, or other
  misc_feature (654)..(654): n is a, c, t, g, unknown, or other
aagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgatccacatcggccaggccggtatccaggtcggaaacgcgtgctgggagctgtactgcctcgagcatggcattcaggctgatggtcagatgcccggtgacaagaccattgggggaggtgatgatgctttcaacaccttcttcagtgagactggcgctgggaagcacgtcccccgtgctgtttttgttgaccttgagcccactgtcatcgatgaggtgaggactggcacctatcgccagctcttccatcctgagcagctcatcagtggcaaggaggatgcagccaacaacttcgctcgtggtcactacaccattggcaaggagattgttgacctgtgccttgaccgcatcaggaagcttgcagatnattgcactggtctccagggcttccctcgtctcaacgctgttggntggagaacgggctctg

SEQ ID NO: 17165 - protein, 147 aa, Zea mays
  misc_feature: Ceres CLONE 1381869-F
  misc_feature (49)..(146): Pfam Name: Tubulin Pfam Description: Tubulin/FtsZ family, GTPase domain
  misc_feature (128)..(128): Xaa is any aa, unknown, or other
MRECISIHIGQAGIQVGNACWELYCLEHGIQADGQMPGDKTIGGGDDAFNTFFSETGAGKHVPRAVFVDLEPTVIDEVRTGTYRQLFHPEQLISGKEDAANNFARGHYTIGKEIVDLCLDRIRKLADXCTGLQGFPRLNAVGWRTGS

SEQ ID NO: 17166 - DNA, 659 bp, Zea mays
  misc_feature: Ceres CLONE 1381877-F
  misc_feature: Encodes the peptide sequence at SEQ ID NO. 17167
  misc_feature (624)..(624): n is a, c, t, g, unknown, or other
gctggagctccccgcggtggcggccgctctagaactagtggatcccccgggctgcaggaattcgcacgagaccattacctagaacatcctaatcgaaaaattacaaccgaccaacgcgctttgcaacgcctccgctgcaatcagcccccgcggcgagattgccctgcccctgagtgctagttctcgccgttacgtaaggcttcttggccttgcgtcctccgtctttcgttgctgatacatcgaggtattaaagaagctgcctggttccgggcagcagaggtcgccgccgcctgcagcaatggccgacttctcctggctcacggtgcttggcttcctattcctcaccttcaactcaggcatggcgatttatcggtccaacggtgacgccggctccgtcgctttcgtcgtggtatcttatctcgacctgttggccctgttcgcctgcttgcgctactaccagcagttggatcagcagcactcccaaaagcgcgcgaggttcaaggctagagtttgaagcctcacgaccctccttactatcatgttcagttaccaggtggatgagattatgcccctgccagtcaaacttgttgtctggtcgatggcagacgctaccacctgtggcgncttctacgctgtcttcgtcacagggagaaagctgt

SEQ ID NO: 17167 - protein, 71 aa, Zea mays
  misc_feature: Ceres CLONE 1381877-F
MADFSWLTVLGFLFLTFNSGMAIYRSNGDAGSVAFVVVSYLDLLALFACLRYYQQLDQQHSQKRARFKARV

SEQ ID NO: 17168 - DNA, 667 bp, Zea mays
  misc_feature: Ceres CLONE 1381879-F
  misc_feature: Translation starting site: 150
  misc_feature (373)..(373): n is a, c, t, g, unknown, or other
  misc_feature (448)..(448): n is a, c, t, g, unknown, or other
  misc_feature (511)..(511): n is a, c, t, g, unknown, or other
  misc_feature (565)..(565): n is a, c, t, g, unknown, or other
  misc_feature (604)..(604): n is a, c, t, g, unknown, or other
  misc_feature (667)..(667): n is a, c, t, g, unknown, or other
tggagctccccgcggtggcggccgctctagaactagtggatcccccgggctgcaggaattcgcacgagaccattacctagaacatcctaatcgaaaaacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccnacaatcatcagccctattacagcagttacctttggtgcatttattggcacaaaacatcagggcacaacaactacnacaacttgtgctagcaaaccttgctgcctactctcagcaacatcagtttcttccattcaaccnactagctgcattgaactctgcttcttatttgcacaacaacaactaccattcagncagctatctgctgcctaccccccagcatttcttccattncacccactgacagcattgaactctcctgcttatttacagcagcaacaactactaccattcagn

SEQ ID NO: 17169 - DNA, 669 bp, Zea mays
  misc_feature: Ceres CLONE 1381881-F
  misc_feature: Translation starting site: 180
  misc_feature (229)..(229): n is a, c, t, g, unknown, or other
  misc_feature (409)..(409): n is a, c, t, g, unknown, or other
  misc_feature (410)..(410): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaatcaccaccatctcacttcatataccactccctaggaggacccagcaacacacacagccgagctttgcttaggcaagatgaacaggaagccaggagactgggactgcagggcgtgccagcacctcancttcagccgccgagacatatgccagcgctgcagcgagccacgtggagttgctgatcgtggcggcggaggaggaggaggcgactacgcccgcttcgtgggcgcggtggctcctcctttcgcggcggctttgccgctgctggctctgacgtccgggctggtgactggtactgctccctgcgnngcgcacacttcgccagncgctccagctgcttcaagtgctccgccaacaagggaggagccgctggggacagtggcgctggcggctttgaccggcaactgccacgctcagggggttacggtttcccaaaggggggtttttggggggtgggggttggggtttccccaaaaacaacccccccccgggtggagaaccccgaaaactggattctcccccaaaatccggagggaaaaagacaaaacttcccgcgggggggggggga

SEQ ID NO: 17170 - DNA, 667 bp, Zea mays
  misc_feature: Ceres CLONE 1381887-F
  misc_feature (271)..(271): n is a, c, t, g, unknown, or other
  misc_feature (282)..(282): n is a, c, t, g, unknown, or other
  misc_feature (284)..(284): n is a, c, t, g, unknown, or other
  misc_feature (287)..(287): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaaacgccaacgcctcatccacctgtgctgtgacctcatatttgtcctccgttccttcgtctcatgatctctgcgcctctgcggctgtcggcgccgagggctgccgtcgggggatcgttcctgctcggcgcgtccaagtccaagcccagcaggatccgctgcgccgcggggntgggggagggncnccnccgccgccacgctgtacgaggggctgggcctgcgcgccggcgcgacgggccgggagatcaaggccgcgtaccggcgcctggcgcgagagcggcacccggacgtggcgaccgcgcccggggccgctgccgagttcgtccgcctgcacgacgcctatgccacgctctccgacccggacagccgcgcgcgctacgaccgcagngccgtagccgcgaatggccgtggcacaacgcccctggaggagcggagatcgggggctatgggcggcccctccctccatggaagacggaccagggcttacaggagttgatggtatatatacaccagtctaacgaacctcctggggtcctggcggttagaaataacggccaggggcgtctct

SEQ ID NO: 17171 - DNA, 638 bp, Zea mays
  misc_feature: Ceres CLONE 1381888-F
  misc_feature: Encodes the peptide sequence at SEQ ID NO. 17172
aaagctggagctccccgcggtggcggccgctctagaactagtggatcccccgggctgcaggaattcgcacgagaccattacctagaacatcctaatcaaaaaatcccccggtgaggtgagcagaccacacctcccctccctctcgtgtcggagcctccgcctcggcttgtccccaccaacccgcagctcgctcccaccaaacccacacccgaacaatggcgtcggcgtccaaggaggaggtgatcgggaagctcaacgtccgcgtggtgcggggcaacaacctggtcatcgccgacccgctcacccacaccagcgacccctacgtcgtcctccagtacggcgctcagaaggtgaagactagcgtccagaggaagaactccaatccagtgtgggaacgaagtactgcagctctcagtaacacatcctacgaagccagtgcacgtggaaagttttgatgaaaacaattcacagcaaacgacagcatgggtgttgctgaaatcaacatactgacatctaccatgctgcgaagctggaactgaagcacgccctctgatgggacaaggtcaaaacatctaccctggcggagaaactaactttggcggcaaaagccatgtcaagggaaagatgggaaaggggcc

SEQ ID NO: 17172 - protein, 79 aa, Zea mays
  misc_feature: Ceres CLONE 1381888-F
  misc_feature (13)..(80): Pfam Name: C2 Pfam Description: C2 domain
MASASKEEVIGKLNVRVVRGNNLVIADPLTHTSDPYVVLQYGAQKVKTSVQRKNSNPVWERSTAALSNTSYEASARGKF

SEQ ID NO: 17173 - DNA, 678 bp, Zea mays
  misc_feature: Ceres CLONE 1381890-F
  misc_feature: Translation starting site: 194
aaagctggagctccccgcggtggcggccgctctagaactagtggatcccccgggctgcaggaattcgcacgagaccattacctagaacatcctaatcgaaaaattatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacagggctcagtatgctcttacatacccgtgagtcatttccatcctgatgcaacgccatgtactttgtgatggcaaggtcaggacagaacaggactaccctgctggggtcatggatgccatttccatcccccagaccaatggagaactacggggtgctgtacgataacaagggccggttcccgctttccccaatcaggaatgaggatgctaagtccaacttttgacaggttaaagcctggtcaattgggggcaaaggggcatcccttaattgaacccgaatggaggggcggaacatccggttacctgacccccctttgaagggccaagaacccttta

SEQ ID NO: 17174 - DNA, 650 bp, Zea mays
  misc_feature: Ceres CLONE 1381894-F
  misc_feature: Encodes the peptide sequence at SEQ ID NO. 17175
  misc_feature (597)..(597): n is a, c, t, g, unknown, or other
aaagctggagctccccgcggtggcggccgctctagaactagtggatcccccgggctgcaggaattcgcacgagaccattacctagaacatcctaatcgaaaaatcttcttcctcgtgcgcgtgcagccgccttgcttgcggccctgcctctctcctctcctgctctcccaccggccaccgtcgccggccgccaccgtcgccgccatgcctttccgattccagttcccatggctcaagaacccaactacaaacggcggcacctccaacatagacactaaccctagcccccgcttccccaaccccttcctccctatccaagcccatgtcacctccttcttctcctccttcccccgggcgctcccgccgccgccgccctgggcgcgcatcacctcgccagcctccacctccggggccctacctacctctgagatcgaggagcggctcgccggggtgcccgtgtacgcgctcgccaacgccgcccaggagttcgtgcttgtgtcgtccacacgcgtgggagggcaagggggcgagagcgtgagtccacgccggcgctcgggctgctctgcttccggaaaggagatgctgacgcgctgctgnagcagatggatggcgatatgcgcgccggctctggtgtccgtcctgtcgcgctg

SEQ ID NO: 17175 - protein, 148 aa, Zea mays
  misc_feature: Ceres CLONE 1381894-F
  misc_feature (131)..(131): Xaa is any aa, unknown, or other
MPFRFQFPWLKNPTTNGGTSNIDTNPSPRFPNPFLPIQAHVTSFFSSFPRALPPPPPWARITSPASTSGALPTSEIEERLAGVPVYALANAAQEFVLVSSTRVGGQGGESVSPRRRSGCSASGKEMLTRCXSRWMAICAPALVSVLSR

SEQ ID NO: 17176 - DNA, 662 bp, Zea mays
  misc_feature: Ceres CLONE 1381895-F
  misc_feature: Encodes the peptide sequence at SEQ ID NO. 17177
  misc_feature (486)..(486): n is a, c, t, g, unknown, or other
  misc_feature (580)..(580): n is a, c, t, g, unknown, or other
  misc_feature (641)..(641): n is a, c, t, g, unknown, or other
  misc_feature (642)..(642): n is a, c, t, g, unknown, or other
aaagctggagctccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtncgtgctgtggacggagagcaaggacgtgggcaagggctttcgctgcatccgcatggtcaacaaacacccgctcaacttcgacgccttccacggngacaaggaccacggcggcgtgcacgacggcaccgccgtcgtgctctgggagtggtgcaggnncaaaaacagagctgaaagac

SEQ ID NO: 17177 - protein, 167 aa, Zea mays
  misc_feature: Ceres CLONE 1381895-F
  misc_feature (109)..(109): Xaa is any aa, unknown, or other
  misc_feature (161)..(161): Xaa is any aa, unknown, or other
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDAXVLWTESKDVGKGFRCIRMVNKHPLNFDAFHGDKDHGGVHDGTAVVLWEWCRXKNRAER

SEQ ID NO: 17178 - DNA, 667 bp, Zea mays
  misc_feature: Ceres CLONE 1381897-F
  misc_feature: Encodes the peptide sequence at SEQ ID NO. 17179
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaagaggggctcgtactcttgtcacgttccttcctgactgcccccacttctcctccggaggagcggcggcgggttacctcccaacagcccgaccatggaagccgacatcgctttcaggtatgagatcccccggaccgcccagttcctccgcgacggcgcctacaccagggtcgcgctccagatccccgacgagatgctgaaggatgctgctgcgcaggcgaggacgttgcgacgggagcttgcctccgacggcgccgacgagggggtatagggtgttcgtgatggccgacacggcgtacaactcctgctgcgtggacgaggtgggcgcgtcccacatcgatgcgcagtgcgtcgtccactacggccacgcctgcatgagcccaacatcaaatttgccagctttctttgtatttgggaaggcaccgttggatgtccacgcatgtgccggcacattgctggagtgctcaggaaaaagcataagcgcattctggttttatatggactagagtacgcatatgcatgggatgaccntagacagactttcatggagtcatgtaaatcaaattct

SEQ ID NO: 17179 - protein, 100 aa, Zea mays
  misc_feature: Ceres CLONE 1381897-F
MLLRRRGRCDGSLPPTAPTRGYRVFVMADTAYNSCCVDEVGASHIDAQCVVHYGHACMSPTSNLPAFFVFGKAPLDVHACAGTLLECSGKSISAFWFYMD

SEQ ID NO: 17180 - DNA, 657 bp, Zea mays
  misc_feature: Ceres CLONE 1381899-F
  misc_feature: Encodes the peptide sequence at SEQ ID NO. 17181
  misc_feature (390)..(390): n is a, c, t, g, unknown, or other
  misc_feature (392)..(392): n is a, c, t, g, unknown, or other
  misc_feature (393)..(393): n is a, c, t, g, unknown, or other
  misc_feature (411)..(411): n is a, c, t, g, unknown, or other
  misc_feature (452)..(452): n is a, c, t, g, unknown, or other
  misc_feature (457)..(457): n is a, c, t, g, unknown, or other
  misc_feature (466)..(466): n is a, c, t, g, unknown, or other
  misc_feature (467)..(467): n is a, c, t, g, unknown, or other
  misc_feature (477)..(477): n is a, c, t, g, unknown, or other
  misc_feature (589)..(589): n is a, c, t, g, unknown, or other
  misc_feature (590)..(590): n is a, c, t, g, unknown, or other
aagctggagctccccgcggtggcggccgctctagaactagtggatcccccgggctgcaggaattcgcacgagaccattacctagaacatcctaatcgaaaaaatgagtccgcgcccacggccgaggcagctgcaggcagcggcccggccggcggagaagggcggaagggcaaggcgcccaagggcgggcccgagaacggcaagttccggtaccgcggcgtgcggcagcggagctggggcaagtgggtggcggagatccgcgagccgcggaagcgctcccgcaagtggctcggcaccttcgccacccgcgaggacgccgcgcgcgcctacgaccgcgccgcgctcctcctctacggcccccgcgcgcacctcaacctcacctccccgccgncnngctacgctcgcgcgccgngctcgcacccgcactcctcctccgccacgtcgtctgccccngcagngctccgccnngctctggcgngcccgccactgcaccagctctccagcgacggtgctcctgcaccggatttccactaccacaatcagttccagcgccgtctcttggcgcagccgacacccacactatactacgnncacacgaccacggcgttcacagtgaccaccagggtgccgacacgggtggcggccccgcaggagccgc

SEQ ID NO: 17181 - protein, 218 aa, Zea mays
  misc_feature: Ceres CLONE 1381899-F
  misc_feature (68)..(119): Pfam Name: AP2 Pfam Description: AP2 domain
  misc_feature (130)..(130): Xaa is any aa, unknown, or other
  misc_feature (131)..(131): Xaa is any aa, unknown, or other
  misc_feature (137)..(137): Xaa is any aa, unknown, or other
  misc_feature (152)..(152): Xaa is any aa, unknown, or other
  misc_feature (155)..(155): Xaa is any aa, unknown, or other
  misc_feature (159)..(159): Xaa is any aa, unknown, or other
  misc_feature (196)..(196): Xaa is any aa, unknown, or other
AGAPRGGGRSRTSGSPGLQEFARDHYLEHPNRKNESAPTAEAAAGSGPAGGEGRKGKAPKGGPENGKFRYRGVRQRSWGKWVAEIREPRKRSRKWLGTFATREDAARAYDRAALLLYGPRAHLNLTSPPXXYARAPXSHPHSSSATSSAPAXLRXALAXPPLHQLSSDGAPAPDFHYHNQFQRRLLAQPTPTLYYXHTTTAFTVTTRVPTRVAAPQEP

SEQ ID NO: 17182 - DNA, 634 bp, Zea mays
  misc_feature: Ceres CLONE 1381905-F
  misc_feature: Translation starting site: 221
  misc_feature (347)..(347): n is a, c, t, g, unknown, or other
  misc_feature (599)..(599): n is a, c, t, g, unknown, or other
aaagctggagctccccgcggtggcggccgctctagaactagtggatcccccgggctgcaggaattcgcacgagaccattacctagaacatcctaatcgaaaaataaaccactccacactccccctctcctagtctgctctccacactcccgctctcctgctactctgctccgtgatctggtctggtgagatcggggatcggaccatcgactcggcgagacatggcggactggggccccgtggtggtgggcgtggtgctgttcgtgctgctctcgccgggcctgctctgcgagctgccgggcacccaccgccacgtcgacttcggcggcttccacacaacggcaaggncatcttcgtccacaccctcgtcttcttcgcccgcttcaccatcctcacgctcgcgctccacatccacatctacaccggctagctagctagctagtgcggagcacatgccgccggtctggactcgcggaggtctcagatcagaaaggaacgccggccggcggcgcgtcctggtgtgctgctcttgttcctctgcagttcgatcgattcgacgaagtgcttgtaactgcctaagcttcctccttgctatgctangtactctctatctatcatgtaaagcccgcatggtc

SEQ ID NO: 17183 - DNA, 666 bp, Zea mays
  misc_feature: Ceres CLONE 1381907-F
  misc_feature: Encodes the peptide sequence at SEQ ID NO. 17184
aaagctggagctccccgcggtggcggccgctctagaactagtggatcccccgggctgcaggaattcgcacgagaccattacctagaacatcctaatcgaaaaaatatcgcacatattattgagaccaactagcaacatagaaagcacaatagtgtaccaacaatggcagccaaaatattttgcctccttatgctccttggtctttctgcaagtgctgctacggcgaccattttcccgcaatgctcacaagctcctatagcttcccttcttcccccgtacctctcaccagtggtgtcttcggtatgtcaaaacccaattcttgaaccctacaggatccaacaggcaatcgcagctggcatcttacctttatcacccttgttcctccaacaatcatcagccctattacagcagttacctttggtgcatttattggcacaaaacatcagggcacaacaactacaacaacttgtgctagcaaaccttgctgcctactctcagcaacagcagtttcttccattcaaccaactagctgcattgaactctgcttcttatttgcaacaacaacaactaccattcagccagctacctgctgcctacccccagcaatttcttccattcaaccaactggcagcattgaactctcctgcttatttacagcagcaacac

SEQ ID NO: 17184 - protein, 168 aa, Zea mays
  misc_feature: Ceres CLONE 1381907-F
MAAKIFCLLMLLGLSASAATATIFPQCSQAPIASLLPPYLSPVVSSVCQNPILEPYRIQQAIAAGILPLSPLFLQQSSALLQQLPLVHLLAQNIRAQQLQQLVLANLAAYSQQQQFLPFNQLAALNSASYLQQQQLPFSQLPAAYPQQFLPFNQLAALNSPAYLQQQH

SEQ ID NO: 17185 - DNA, 658 bp, Zea mays
  misc_feature: Ceres CLONE 1381920-F
tggagctccccgcggtggcggccgctctagaactagtggatcccccgggctgcaggaattcgcacgagaccattacctagaacatcctaatcgaaaatacactgagaagcgcagagactggcgacttcgtactcggctatctccgcgactcacagctttccccaattccaccccttctcccatttctcaccaccgccgtcgctccccccgttcaacaacaccgtgagggagagcatctcagatcgcacagcggatcaggctggcatccaggtcgaaaacgggcgctggcagctgtgctgcctcaagcatgggattcaggctgatgcacagatgcgcgctgacaagaacattgggggaggtgatgatgctctccaacaccatcttcagagagactggcgctgctagagcacgtcccccgtgctgttgttgttgaccgtgagtccactgacatcgatgtacgcgagactggcacctaccgccagctcttgcatcctgagcagatcatctgtggcaaggaggatgcagccaacaacttcggtggtgatcactacaccagtggcaaggagattgtagacctgtgccttgacggcatcaagaagcttgcagatagttgcagtgagcaccagcgcttcctcgcctatcacgctgatggcggaga

SEQ ID NO: 17186 - DNA, 649 bp, Zea mays
  misc_feature: Ceres CLONE 1381926-F
  misc_feature: Encodes the peptide sequence at SEQ ID NO. 17187
  misc_feature (561)..(561): n is a, c, t, g, unknown, or other
aaagctggagctccccgcggtggcggccgctctagaactagtggatcccccgggctgcaggaattcgcacgagaccattacctagaacatcctaatcgaaaaattcccctcccgaagtcccgatcctgtcctcaaatcccattgctctatcttctctagcggcgagtcgaggcggggaagacgagctagcggcgaggatgttgtgggtagataagtaccggccgaaaaccctagacaaggtcaccgtgcacgaccaggttgctcagaacctcaggaagtttgtgtcggagcaggattgcccgcacctgttgttctatgggccgtcggggtccgggaagaaaaccctaatcctagcgctcatcaagcagatgttcggcgccggcgcggagaaggttaagctggagaaacagacatggaaaatcgatactggaaacaggacatttgagatagaattggcgatggtgtcaagtgctcaccatgtggagatgacccccagtgatgctggctttcaagacaggtatggttgttcaggagtcatcaaagagatggcgaagaacaggnccattgatgccaaagcaagagagcatttaaaggccttggggtaaatgaagtccacaagctctccgaagagcccagtattccctcggca

SEQ ID NO: 17187 - protein, 135 aa, Zea mays
  misc_feature: Ceres CLONE 1381926-F
  misc_feature: SWISSPROT Homolog: EC 2.1.2.11 3-methyl-2-oxobutanoate hydroxymethyltransferase
  misc_feature (122)..(122): Xaa is any aa, unknown, or other
MLWVDKYRPKTLDKVTVHDQVAQNLRKFVSEQDCPHLLFYGPSGSGKKTLILALIKQMFGAGAEKVKLEKQTWKIDTGNRTFEIELAMVSSAHHVEMTPSDAGFQDRYGCSGVIKEMAKNRXIDAKAREHLKALG

SEQ ID NO: 17188 - DNA, 705 bp, Zea mays
  misc_feature: Ceres CLONE 1381927-F
  misc_feature: Encodes the peptide sequence at SEQ ID NO. 17189
  misc_feature (278)..(278): n is a, c, t, g, unknown, or other
  misc_feature (322)..(322): n is a, c, t, g, unknown, or other
  misc_feature (327)..(327): n is a, c, t, g, unknown, or other
  misc_feature (344)..(344): n is a, c, t, g, unknown, or other
  misc_feature (369)..(369): n is a, c, t, g, unknown, or other
  misc_feature (437)..(437): n is a, c, t, g, unknown, or other
  misc_feature (455)..(455): n is a, c, t, g, unknown, or other
  misc_feature (456)..(456): n is a, c, t, g, unknown, or other
  misc_feature (465)..(465): n is a, c, t, g, unknown, or other
  misc_feature (466)..(466): n is a, c, t, g, unknown, or other
  misc_feature (472)..(472): n is a, c, t, g, unknown, or other
  misc_feature (516)..(516): n is a, c, t, g, unknown, or other
  misc_feature (537)..(537): n is a, c, t, g, unknown, or other
tggagctccccgcggtggcggccgctctataactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacctatattccaggggacttgccaccagtcatggcattgggtaccttgaacccatgcntgcagtactgcctgatgcaacagggggcttgccagcttgagggnggggnccgtccctgatgctgcnacaactgttggtctttttgtttccnactatgcccaggggtgttgccacagatgatgacgcctaacatgatggccccattgattgatgccgaanatgatggccccaaagggnnttggcccannatgatncccccaaatgaatgatgccacaattgttacctgaaaaccccggncttggaagattttggttggcnccgggggcggcaccattaaatgtaaaaacacaaagggtgccgtgaacaatatccccccattggtttttaccaacagaacccttttgggtgggaggctggcattcctaaaacaaaaaaactttgtagaggtcggagatacaaaaaaaaagaagttcccaactccccccc

SEQ ID NO: 17189 - protein, 59 aa, Zea mays
  misc_feature: Ceres CLONE 1381927-F
  misc_feature (41)..(41): Xaa is any aa, unknown, or other
  misc_feature (57)..(57): Xaa is any aa, unknown, or other
MAAKMLALFALLALCASATSATYIPGDLPPVMALGTLNPCXQYCLMQQGACQLEGGXRP

SEQ ID NO: 17190 - DNA, 667 bp, Zea mays
  misc_feature: Ceres CLONE 1381933-F
  misc_feature: Encodes the peptide sequence at SEQ ID NO. 17191
  misc_feature (396)..(396): n is a, c, t, g, unknown, or other
  misc_feature (414)..(414): n is a, c, t, g, unknown, or other
  misc_feature (429)..(429): n is a, c, t, g, unknown, or other
  misc_feature (484)..(484): n is a, c, t, g, unknown, or other
  misc_feature (528)..(528): n is a, c, t, g, unknown, or other
  misc_feature (552)..(552): n is a, c, t, g, unknown, or other
  misc_feature (580)..(580): n is a, c, t, g, unknown, or other
  misc_feature (609)..(609): n is a, c, t, g, unknown, or other
  misc_feature (627)..(627): n is a, c, t, g, unknown, or other
gctggagctccccgcggtggcggccgctctagaactagtggatcccccgggctgcaggaattcgcacgagaccattacctagaacatcctaatcgaaaaacactatagaccacagccagtcagccacatcactagctatctgtgcagaggcaatggcgtccaaggttgagctggtggtggaggtcaagtccccggctgacaagctgtgggcggcgctgcgtgactcgacggagctgttccccaagatcttccccgagcagtacaagagcatcgagaccgtcgagggcgacggcaagtcggccggcaccgtccgcctccctcagtacaccgaggcggtgccgatgctgacgttcgccaaggagaagcttgagacggcggacgacgagaacaaggtgntgtcgtacagcgtggtgnacggcgagctgccgnactttctacagaaacttcagatcacgctgaaggtgactccggccaaggcggaggncgaggggcgccccctcgtcagctggggcatgggagtcgacaggnccaacgaccaggtgcctgaccggnacgtcatcaaggagacggcaccaagacngtccacgacctcgacgactacctcctcangaactagatggagcgacnactgaagatggtccagtacagtacaggtccagtccattct

SEQ ID NO: 17191 - protein, 158 aa, Zea mays
  misc_feature: Ceres CLONE 1381933-F
  misc_feature (1)..(152): Pfam Name: Bet_v_I Pfam Description: Pathogenesis-related protein Bet v I family
  misc_feature (82)..(82): Xaa is any aa, unknown, or other
  misc_feature (88)..(88): Xaa is any aa, unknown, or other
  misc_feature (93)..(93): Xaa is any aa, unknown, or other
  misc_feature (111)..(111): Xaa is any aa, unknown, or other
  misc_feature (126)..(126): Xaa is any aa, unknown, or other
  misc_feature (134)..(134): Xaa is any aa, unknown, or other
  misc_feature (143)..(143): Xaa is any aa, unknown, or other
  misc_feature (153)..(153): Xaa is any aa, unknown, or other
MASKVELVVEVKSPADKLWAALRDSTELFPKIFPEQYKSIETVEGDGKSAGTVRLPQYTEAVPMLTFAKEKLETADDENKVXSYSVVXGELPXFLQKLQITLKVTPAKAEXEGRPLVSWGMGVDRXNDQVPDRXVIKETAPRXSTTSTTTSSXTRWSD

SEQ ID NO: 17192 - DNA, 535 bp, Zea mays
  misc_feature: Ceres CLONE 1381935-F
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (262)..(262): n is a, c, t, g, unknown, or other
  misc_feature (278)..(278): n is a, c, t, g, unknown, or other
  misc_feature (285)..(285): n is a, c, t, g, unknown, or other
  misc_feature (292)..(292): n is a, c, t, g, unknown, or other
  misc_feature (317)..(317): n is a, c, t, g, unknown, or other
  misc_feature (359)..(359): n is a, c, t, g, unknown, or other
  misc_feature (364)..(364): n is a, c, t, g, unknown, or other
  misc_feature (390)..(390): n is a, c, t, g, unknown, or other
  misc_feature (403)..(403): n is a, c, t, g, unknown, or other
  misc_feature (404)..(404): n is a, c, t, g, unknown, or other
  misc_feature (427)..(427): n is a, c, t, g, unknown, or other
aagctggagctccccgcggtggcggccgctctagaactagtggatcccccgggctgcaggaattcgcacgagaccattacctagaacatcctaatcgaaaactatcatcatccaatccagatcagcaaagcggcagtgcgtagagaggatcgtcgaacagaacagcatgaagatggcatcgttctcgtcgtgtgctggctctgtcagctgccagcgcctctgcaatgcagatgccctgccccctgcgcgnnnngctgcaggncttgtacggcgcttgncgcccgncctgacnaacgatgatggggcgcggcggctgnacccctacgcgagtacctgaggcaccgaatgcaccccgtggnggggngccatactacgcgggtgtggcagacnagcgcatgtacannccgtccggaacagggtgccaaanaaatgaggatatggaccttgaacccgtccccaaaaattggaaaatatttttgccctttaaggggggccctttccccccaaaaaaacctttaaaaaaccacctttttat

SEQ ID NO: 17193 - DNA, 660 bp, Zea mays
  misc_feature: Ceres CLONE 1381938-F
aaagctggagctccccgcggtggcggccgctctagaactagtggatcccccgggctgcaggaattcgcacgagaccattacctagaacatcctaatcgaaaaacgccgtccctcctgctcctgctctccacacgccgccggagaaacgcggcggaacgcccagcacgggctgcacggcaggtcggcactcggtagcacatccctcccggtggtccggccctccgccgtcccagcacgacagcacttccggcgaccaggtcctaggctcccagcgtccggcggtcccagcagtccagcacgacagtgacagcacttcgggaacacgggctccgcgcgttctgctgtgcagggtctagcggtctgctgtccacggctccgcgcgtccaggaggatgtgtatcccaagtttggggtttggtcaaaacgtaaaaactacgaacatcagtaactaaattatttagggtgaagcatggaagggaaaattctttttggaggatctggcccttgaatcaaaaaggaaacctttgggccaaccaacatttgtggaaaataacacgttcctgccccaattggggaaaaaaaaacaccttttgggccccggcccctttaggggatagaaatattcccacccttggagggagccatttggaaacccaaaacc

SEQ ID NO: 17194 - DNA, 759 bp, Zea mays
  misc_feature: Ceres CLONE 1381943-F
  misc_feature: Encodes the peptide sequence at SEQ ID NO. 17195
ggtggcggccgctctagaactagtggatcccccgggctgcaggaattcgcacgagaccattacctagaacatcctaatcgaaaagaggcggagagatcgcacgcggcctctgacgattggtctattcatcctgcttgctgccagactgcaccgccgatgtcttcaatttcactaggggatcactcgtaccagcagggtcctgcggcgcgacactccgctcggtttcgctcccgagacccgggcctgccgagccgccgccatggacgaggagtacgacgagatcgttctgggtacggggctccaggagtgtatcctcagcggacccctctccgtcgacgccctccaggttctacccctggatagaaaatggttactcccgaggacatttccccctccctaaacctgaaccaacttctggaacaaggtttaggtgtgaaaaaaaaacccaccggcctcttctaggtggcccaccaaccgacttcccttgtgcaaacagcggttccaaagccctactagaggggaaaacccgcgaccttttgtgtccgccacttctccctttccaccccgtggggtggacacaaatttatgcgttcctcttcaaaaaccgttatcctgctgcaacgcccttacgtccctccccccactagcgggaaaaatactccccgacggttacatctggcccctcccgatattggcagacacgcccatataatatgtgctctttccgacgaggggctccttaacctctgatccaacaag

SEQ ID NO: 17195 - protein, 46 aa, Zea mays
  misc_feature: Ceres CLONE 1381943-F
MDEEYDEIVLGTGLQECILSGPLSVDALQVLPLDRKWLLPRTFPPP

SEQ ID NO: 17196 - DNA, 734 bp, Zea mays
  misc_feature: Ceres CLONE 1381944-F
  misc_feature: Encodes the peptide sequence at SEQ ID NO. 17197
aagctggagctccccgcggtggcggccgctctacaactagtggatcccccgggctgcaggaattcgcacgagaccattacctagaacatcctaatcgaaaagatactatcagattgtcacaagctggtgaaggagcttctttctgagcatgaatatggattcaacatcggaattttcaaacgccgtttttcccaggagtatggatacgagcttgaacaccggaagctcgggtatctggaccttgaaacgctgctgcatattatgcctgatgtaagggtgaaattcccaagggtcatgcgctcagaacacgggaacgggcaggctggcagcaagggagacggaaaccgaagcagcggcgatgacttgatctgggaggagcttggtcctgtatctgccacaactgaaaccgccgccgccgccgctgatgcaggggccgacaaggaaacatgctatcgtcctcccactccttcagacgacgagttctcggacagcgacagcataaaagaccggcagcctagaaggaacgccgagcagcagagctcgcttctccagatcattggagcttggaaagcagaggggggtggcgacgtctctaacaacagcctcaggacatcgaaacggggttggtggactgttcgagaagcagccggggcagtgctggcaccagcgcagcttcaggaaaaggggcagacgttgtctccgaagctaccgcacaagaggtactcccttcgtgc

SEQ ID NO: 17197 - protein, 157 aa, Zea mays
  misc_feature: Ceres CLONE 1381944-F
MPDVRVKFPRVMRSEHGNGQAGSKGDGNRSSGDDLIWEELGPVSATTETAAAAADAGADKETCYRPPTPSDDEFSDSDSIKDRQPRRNAEQQSSLLQIIGAWKAEGGGDVSNNSLRTSKRGWWTVREAAGAVLAPAQLQEKGQTLSPKLPHKRYSLR

SEQ ID NO: 17198 - DNA, 698 bp, Zea mays
  misc_feature: Ceres CLONE 1381947-F
  misc_feature: Encodes the peptide sequence at SEQ ID NO. 17199
  misc_feature (553)..(553): n is a, c, t, g, unknown, or other
  misc_feature (672)..(672): n is a, c, t, g, unknown, or other
ctctagaactagtggatcccccgggctgcaggaattcgcacgagaccattacctagaacatcctaatcgaaaaaaatcgacccattcatctcctcagcctcgttcaccacacagtccgccactcctttagtagcttgtgatttggacggcgacgatatcactgcacgtccgcaggacgaccacccatgccccaagttcaacgtgatcgcatcgtggtgcgcgttcctcctgctctgcgccgtgctgctggtcgtatcatccacgggcgcgcgcgcagatgcagtggtcgaacgaccaccgtcaaggaggatctgctcctctgcaagcaactcccgcatcgccagtacggaaaggacaccccgcggaaaactcaatgtgatacccagcgccccgagcgtcaccagcaagctgacagcgccaaggacggtaacagcggctcgcacgcctacgtctcccgctccgggaggggcgagtgccggcgtcagtgcctgcgccgacacgaggatcagccgtggaagacccagaagagcatgaggtgctgccgccgccgcgnactggccgtcgacatggagcaagagtaccgtcgcgacagcgagagcgcgcgcaacagccacaagaggtgcgagcgccaccaccgcggggactggtgatagacgcatcgctgcctgatgnactgcaagagcctggagcggaagaag

SEQ ID NO: 17199 - protein, 154 aa, Zea mays
  misc_feature: Ceres CLONE 1381947-F
  misc_feature (123)..(123): Xaa is any aa, unknown, or other
MPQVQRDRIVVRVPPALRRAAGRIIHGRARRCSGRTTTVKEDLLLCKQLPHRQYGKDTPRKTQCDTQRPERHQQADSAKDGNSGSHAYVSRSGRGECRRQCLRRHEDQPWKTQKSMRCCRRRXLAVDMEQEYRRDSESARNSHKRCERHHRGDW

SEQ ID NO: 17200 - DNA, 700 bp, Zea mays
  misc_feature: Ceres CLONE 1381954-F
  misc_feature: Encodes the peptide sequence at SEQ ID NO. 17201
  misc_feature (700)..(700): n is a, c, t, g, unknown, or other
agtggatcccccgggctgcaggaattcgcacgagaccattacctagaacatcctaatcgaaaaaacaaattcccgagacgccattctcaccatccacacaaagccacagcccaagagcagagtcgtcgtcgtcgtcgggcatggcggggttcaaggtgacgcggatctcggagggccccgtgaagccggcgtcggcgacgcccgaggagacgctgccgctggcttgggtggaccggtacccgacgcaccgtggcctggtggagtcgatgcacatcttccggtcgggcgcgggcgaggccccggccgtgatccgggcggcgctggccaaggcgctggtcttcttctacccgctggcgggccgcatcgtggagggggagcagccggggcgccccgccatccgctgcaccgccgacggcgtctacttcgcggaggccgaggcggactgcagcctggaggacgtgcgcttcctggagcggccccctgctgctgcccaagggagacctcgtgccttaccccggcgacgaccgctggcccgtcgagccgcacaacacatcctgatgatgcagatcaccaagttcacctgcggcggcttcgtgatgggcctgcggttcaaccacgcggtcggcggacggcatggggcgcggggcaatttcttcaacgccgtggggggacatggcgccggtggcttggcgggaacccn

SEQ ID NO: 17201 - protein, 186 aa, Zea mays
  misc_feature: Ceres CLONE 1381954-F
  misc_feature: SWISSPROT Homolog: EC 2.3.1.166 2-alpha-hydroxytaxane 2-O-benzoyltransferase
MAGFKVTRISEGPVKPASATPEETLPLAWVDRYPTHRGLVESMHIFRSGAGEAPAVIRAALAKALVFFYPLAGRIVEGEQPGRPAIRCTADGVYFAEAEADCSLEDVRFLERPPAAAQGRPRALPRRRPLARRAAQHILMMQITKFTCGGFVMGLRFNHAVGGRHGARGNFFNAVGGHGAGGLAGT

SEQ ID NO: 17202 - DNA, 717 bp, Zea mays
  misc_feature: Ceres CLONE 1381957-F
  misc_feature: Encodes the peptide sequence at SEQ ID NO. 17203
  misc_feature (385)..(385): n is a, c, t, g, unknown, or other
cgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggngaagaggagtcgcgggcggcgcgcctccagtcttttttcgcctccgtgctctccgggctcttcggccaggccgaggccgaggacgaggacgaggacgaagagatgcccacgcgcaaccacaacgctgccgcggctgccgctcccgcaccatcacatcacacccgaggtggtgctcccgctcttggaaagagcaggcccgtgccccgcccgagctgatgccctgaacccggggagccccccctcggggaaatgggaaacctcgtcaggggccggcccggcgaaggaaaaccctcagctggcggaggaaaaccattcgccccattcacgcgaag

SEQ ID NO: 17203 - protein, 37 aa, Zea mays
  misc_feature: Ceres CLONE 1381957-F
MPTRNHNAAAAAAPAPSHHTRGGAPALGKSRPVPRPS

SEQ ID NO: 17204 - DNA, 731 bp, Zea mays
  misc_feature: Ceres CLONE 1381959-F
  misc_feature: Encodes the peptide sequence at SEQ ID NO. 17205
  misc_feature (530)..(530): n is a, c, t, g, unknown, or other
tggagctccccgcggtggcggccgctctagaactagtggatcccccgggctgcaggaattcgcacgagaccattacctagaacatcctaatcgaaaaatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcggcatgctccgcggggtgcgccagttcaacgagggccccccgtggagggcgaancaggcgctctactcgagggacctcgctcgcaacctgcgcttcgcctccaacttcgacctcttcaaggctgctgcggccgactggcgcgacacgcccctctgcgaggtggctcccaacccgcccccccgggagggactggcgcagccactcggaaacgtgaggttgaataccgccccgttgtgaacaaaactgggggcctcg

SEQ ID NO: 17205 - protein, 190 aa, Zea mays
  misc_feature: Ceres CLONE 1381959-F
  misc_feature: SWISSPROT Homolog: EC 1.14.11.20 Desacetoxyvindoline 4-hydroxylase
  misc_feature (130)..(130): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGGMLRGVRQFNEGPPWRAXQALYSRDLARNLRFASNFDLFKAAAADWRDTPLCEVAPNPPPREGLAQPLGNVRLNTAPL

SEQ ID NO: 17206 - DNA, 736 bp, Zea mays
  misc_feature: Ceres CLONE 1381974-F
  misc_feature: Encodes the peptide sequence at SEQ ID NO. 17207
  misc_feature (658)..(658): n is a, c, t, g, unknown, or other
aaagctggagctccccgcggtggcggccgctctagaactagtggatcccccgggctgcaggaattcgcacgagaccattacctagaacatcctaatcgaaaaaaaattcctcatattttctctcctcccctggtcccttctcgttctcgcccgcgtaattcctctctggcgtctaccaaaagcggagcaaccgaggcaagaaaaaggggtgggcgaggaaaagcgattaggcttctcttccagttcctgattcagtctgagaaacaatggatatctgaagcatgaaaagtcaacccacctcactcttttaaacagttcggttaacacacttaatggctgcggtgtttgcatgacattctctttgagcttatatgggtggctgtattggtaatttaagcagatctcagtcacttccagattctaaaccaaagcgatctttgagaaagaaatatcaggattcatcgactggaaacagaagacgatggcaatcgggtctagaagcaatggagaagaatgttagcatatctgtttctcttgaggggaatatctcttctattcccaattcaatagccaacgactctaaaacgtcaatggaaaacagggtagatacatcatttatcaaccatgcggctgaagcatgggctgagatgaaaaaacnatgggttgagcccccaggcagaaggtctgagaaagacccccgaaggcaggggggatagttggtccacaacatatgatt

SEQ ID NO: 17207 - protein, 114 aa, Zea mays
  misc_feature: Ceres CLONE 1381974-F
  misc_feature (96)..(96): Xaa is any aa, unknown, or other
MGGCIGNLSRSQSLPDSKPKRSLRKKYQDSSTGNRRRWQSGLEAMEKNVSISVSLEGNISSIPNSIANDSKTSMENRVDTSFINHAAEAWAEMKKXWVEPPGRRSEKDPRRQGG

SEQ ID NO: 17208 - DNA, 632 bp, Zea mays
  misc_feature: Ceres CLONE 1382006-F
  misc_feature: Encodes the peptide sequence at SEQ ID NO. 17209
agagctggagctccccgcggtggcggccgctctagaactagtggatcccccgggctgcaggaattcgcacgagaccattacctagaacatcataatcgaaaaatatatcgattcgctgccacacagatagggttttctctccacgcagcgcgctcctcgatccccaacaggcaacagccaagccgccgtcgtcccccgctccgtagtacggcgccgccagatcgtcagccaccatgatcatctccaagaagaaccgccgcgagatctgcaaatacctgttccatgagggggtcttgtacgccaagaaggactacaacctggccaagcaccctaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaataccctcaagaagtcttccaagcccccgtctcgtcccttcggctctggcccacctggtgaccgccccaggggccctcctcgttatgaaggtgacaggcctaggtttggtgatagggatggttacagaggaggt

SEQ ID NO: 17209 - protein, 133 aa, Zea mays
  misc_feature: Ceres CLONE 1382006-F
  misc_feature (3)..(98): Pfam Name: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRSFLNLPSEVVPNTLKKSSKPPSRPFGSGPPGDRPRGPPRYEGDRPRFGDRDGYRGG

SEQ ID NO: 17210 - DNA, 673 bp, Zea mays
  misc_feature: Ceres CLONE 1382009-F
  misc_feature: Encodes the peptide sequence at SEQ ID NO. 17211
  misc_feature (265)..(265): n is a, c, t, g, unknown, or other
  misc_feature (367)..(367): n is a, c, t, g, unknown, or other
  misc_feature (373)..(373): n is a, c, t, g, unknown, or other
  misc_feature (419)..(419): n is a, c, t, g, unknown, or other
  misc_feature (420)..(420): n is a, c, t, g, unknown, or other
  misc_feature (441)..(441): n is a, c, t, g, unknown, or other
  misc_feature (457)..(457): n is a, c, t, g, unknown, or other
  misc_feature (517)..(517): n is a, c, t, g, unknown, or other
aaagctggagctccccgcggtggcggccgctctagaactagtggatcccccgggctgcaggaattcgcacgagaccattacctagaacatcctaatcgaaaacgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcanaggatgtgctaatgagcatcgtccatgcgatgctgggttggcttattgctgcaccaattgtactggtcgtgctgtacgccgtttcgttcccttgtttcaggntcctgntcaacaggtttggtggtattccttcgagcccccagacccccatcannagcgtgtagccagtgcctggnccggatcctctgcagntacatccgtggacatagctgcagatgtgtcgctgacatccgggggcggccgtggcgtggncccaaacgtcagtgactcgacgtaattgcagaggaacggtttcagccagtgaggcatgctgaatgccccctggattggggtgcacccagttctttgggatgccgtccgattgaaatgggttcggggatcatggtgcttcggcatccccaggactgg

SEQ ID NO: 17211 - protein, 142 aa, Zea mays
  misc_feature: Ceres CLONE 1382009-F
  misc_feature (89)..(89): Xaa is any aa, unknown, or other
  misc_feature (123)..(123): Xaa is any aa, unknown, or other
  misc_feature (125)..(125): Xaa is any aa, unknown, or other
  misc_feature (140)..(140): Xaa is any aa, unknown, or other
KAGAPRGGGRSRTSGSPGLQEFARDHYLEHPNRKRCNAVTLMVLNLAATPIELSLIVPFLRLGEAVTGSGHFPLTADALKNVLTGHASXDVLMSIVHAMLGWLIAAPIVLVVLYAVSFPCFRXLXNRFGGIPSSPQTPIXSV

SEQ ID NO: 17212 - DNA, 659 bp, Zea mays
  misc_feature: Ceres CLONE 1382010-F
  misc_feature: Translation starting site: 144
  misc_feature (494)..(494): n is a, c, t, g, unknown, or other
  misc_feature (543)..(543): n is a, c, t, g, unknown, or other
aaagctggagctccccgcggtggcggccgctctagaactagtggatcccccgggctgcaggaattcgcacgagaccattacctagaacatcctaatcgaaaaattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggccagatcctgnagggcgtgggcgtcgactacgtggacgagagcgaggtgctgacccccgncgacgacgcgcacacatcaccagcacaatttcgcggtcccttcgtctgcgctgccgcgacctcggggaggcgctccccagggggcgcgagggcgccccatgatccgccccagggag

SEQ ID NO: 17213 - DNA, 643 bp, Zea mays
  misc_feature: Ceres CLONE 1382014-F
  misc_feature: Translation starting site: 174
  misc_feature: SWISSPROT Homolog: EC 1.2.1.12 Glyceraldehyde-3-phosphate dehydrogenase (phosphorylating)
  misc_feature: SWISSPROT Homolog: EC 1.2.1.59 Glyceraldehyde-3-phosphate dehydrogenase (NAD(P)(+)) (phosphorylating)
  misc_feature (317)..(317): n is a, c, t, g, unknown, or other
  misc_feature (318)..(318): n is a, c, t, g, unknown, or other
  misc_feature (494)..(494): n is a, c, t, g, unknown, or other
agagctggagctccccgcggtggcggccgctctagaactagtggatcccccgggctgcaggaattcgcacgagaccattacctagaacatcctaatcgaaaaatatccgctcccctacctctccagcatctcccgtctccgtcgtctcgtctccgctcctcacctcgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaanngtacgacaccgtgcacggccaatggaagcacagcgacatcgccctcaaggactcgaagacgcttctcttcggcgagaagccggtcaccgtctttggcatcaggaaccccgaggagatcccgtgaggtgaggctggtgctgagtatgtcgtggagtccaccggtgtcttcactgacnaggacaaggctgctgcacatctgaagggtggtgccaagaaaggtgttatctctgcccccaagcaaagatgcacccatggtttgttggtggtgtcaatgaggacaagtacaccctccgatgtaacattggttcccaatgctagctgcacc

SEQ ID NO: 17214 - DNA, 908 bp, Zea mays
  misc_feature: Ceres CLONE 1382020-F
  misc_feature: Encodes the peptide sequence at SEQ ID NO. 17215
  misc_feature (908)..(908): n is a, c, t, g, unknown, or other
gcgcggcccccccccccccccccaccacactcccgggtcccacccaaagctggagctccccgcggtggcggccgctctagaatagtggatcccccgggctgcaggaattcgcacgagaccattacctagaacatcctaatcgaaaaatccccatattattgatacgaactagcaacatacatagcgaagtacactagcaacatcttagcaccaatggcagccaagatttttgccatccttgccctccttgctctttcagcgagcgctggtaccgcgactattattccccaatgctcacaacaatacctctctccggtgacagacgcgagatttgaatacccaactatacaatcctacaggctaccagagggcatcccagcaagcatcttacgggtcggttagaattgacccgcccacccaccactatggcgctattggcaacaacccatccttgatgaatcccaccccccccccaaagaatccgccagcactgcgagctaccgaccgacagggtggctttcccaataaatcccacttccagagtaatttttccacccgaaaacccttggcctggcctttaccctccccgggcgaacaaaacaaatttttctatcccatttctccaatccccagctaatccttgggggggcggaagcccctggcgtggcgttaaacgtggcccacagcgacgacaggagcataaccgaccccccttaccacactcaattctgtgcccgaggaagcccctggcattgccctttccttcacctgcagggcaagcaggctggccatcccatctgccaagtacacccggctcggcgggcgaaaactttgggccgtgcttctttctccggaccgcacacccgcaaagtctgtgtgcgcacttttaaccacacagccctcgggcn

SEQ ID NO: 17215 - protein, 62 aa, Zea mays
  misc_feature: Ceres CLONE 1382020-F
MAAKIFAILALLALSASAGTATIIPQCSQQYLSPVTDARFEYPTIQSYRLPEGIPASILRVG

SEQ ID NO: 17216 - DNA, 591 bp, Zea mays
  misc_feature: Ceres CLONE 1382022-F
  misc_feature: Encodes the peptide sequence at SEQ ID NO. 17217
  misc_feature (343)..(343): n is a, c, t, g, unknown, or other
  misc_feature (467)..(467): n is a, c, t, g, unknown, or other
aaagctggagctccccgcggtggcggccgctctagaactagtggatcccccgggctgcaggaattcgcacgagaccattacctagaacatcctaatcgaaaaacttcccgtgtttctaactccggtggctccaccaccagcaacccgtgcagcgagcccaccccgaccactgccatgtcgaggcgcggcgactgggtctacgagaacaacggcgggacctgcgtggccatcgctggcgccgattactgtgtcgtcgcggcggacacccgcctctctgtcggatacagcatcctcacgcgcgaccactctaagatctgcgacctggctgacaaatgtgtactancatcttctgctttcaggtgatattaagctctgcacagaactagctgcagagaatgctatacacacagcatacaaaagatgagctgccctgcatggacagctcctctcaataccctgactacaangcttcttccctattaccccctcaatgtggctcggggggctttacaccaaaggaaaagggtgggtttttcccccatgagggggaaaggtcccaaccaaaaaactgggtttaaagggctcaaggaa

SEQ ID NO: 17217 - protein, 62 aa, Zea mays
  misc_feature: Ceres CLONE 1382022-F
  misc_feature: SWISSPROT Homolog: EC 3.4.25.1 Proteasome endopeptidase complex
  misc_feature (57)..(57): Xaa is any aa, unknown, or other
MSRRGDWVYENNGGTCVAIAGADYCVVAADTRLSVGYSILTRDHSKICDLADKCVLXSSAFR

SEQ ID NO: 17218 - DNA, 657 bp, Zea mays
  misc_feature: Ceres CLONE 1382034-F
  misc_feature: Encodes the peptide sequence at SEQ ID NO. 17219
  misc_feature (394)..(394): n is a, c, t, g, unknown, or other
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaattgtttgtttgtttgatgagaaagcgcaaacgggagagaaaccctagctggctagctctcccgcctctctataaatcagcgcagcctgttcgtacagcgccacacaccacagttagcttcctttcaattattgtatttcagtcgagttgctaaacaacacgaactcctcagtcgtttgagttttgaggaggcaagcaagaggacccatcgatggcctccttgaaggaccactgtgccgtggtggcagttgtagtggcgatctgcttcgtcgtcctcgccgccggcctccttncgcacgcgtcgacggcggtggacgagccggcgaagtataagcccagnagagcggcagcgccgtcccctgcatctgcatcatcctacgtcccgccggcgggtcagcccgggatcgtcgtccagggggtcatctactgcaggtcctgcaagctcagggggtacaacaggggattggacgcgtcccctctccccaatggaacggaaacctggggggttaccgcggacccgaaaaaaaaaaaaccggggggtaaaccaaaaaaaacc

SEQ ID NO: 17219 - protein, 115 aa, Zea mays
  misc_feature: Ceres CLONE 1382034-F
  misc_feature (28)..(28): Xaa is any aa, unknown, or other
  misc_feature (43)..(43): Xaa is any aa, unknown, or other
MASLKDHCAVVAVVVAICFVVLAAGLLXHASTAVDEPAKYKPXRAAAPSPASASSYVPPAGQPGIVVQGVIYCRSCKLRGYNRGLDASPLPNGTETWGVTADPKKKKPGGKPKKT

SEQ ID NO: 17220 - DNA, 695 bp, Zea mays
  misc_feature: Ceres CLONE 1382035-F
  misc_feature: Encodes the peptide sequence at SEQ ID NO. 17221
  misc_feature (457)..(457): n is a, c, t, g, unknown, or other
aaagctggagctccccgcggtggcggccgctctagaactagtggatcccccgggctgcaggaattcgcacgagaccattacctagaacatcctaatcgaaaactccactcctcctcctctctctctccacatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaagaggagcccgtatccctccgccccgctgcccgccggaccgatggactccgagcactggatctcgcgcctggccgccgcgaagcgcttctacgcggngcagttccgccacagcgatcgggccgggatggaaccagctggaaatgaaccaagaaggcaggcccgaggttcccctggcccaacgggtaagagggacccgaagggcggattccctttggggggccccgggggggaggagcacccgttgaaaaccccaaacccggggcctgcccctggttggctcaaaaagggtgtacaaaaggaaatgggtatccccatttcacccaccccaaatggg

SEQ ID NO: 17221 - protein, 98 aa, Zea mays
  misc_feature: Ceres CLONE 1382035-F
  misc_feature (19)..(19): Xaa is any aa, unknown, or other
MDSEHWISRLAAAKRFYAXQFRHSDRAGMEPAGNEPRRQARGSPGPTGKRDPKGGFPLGGPGGEEHPLKTPNPGPAPGWLKKGVQKEMGIPISPTPNG

SEQ ID NO: 17222 - DNA, 738 bp, Zea mays
  misc_feature: Ceres CLONE 1382040-F
  misc_feature: Encodes the peptide sequence at SEQ ID NO. 17223
  misc_feature (19)..(19): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (53)..(53): n is a, c, t, g, unknown, or other
aattcaaccctcccctccntntttttttttttggtgnnnnnnccccccaacanggaaaaagctggggctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtcctcccgctccgggaggggcgagtgccggcgccagtgcctgcgccgccacgagggccagccgtgggagacccaggagtgcatgagggcggggccgccgccgcgggactggccgggggacatgggagcaaggaggacggggcgcgagcagcgagaagcgccgggcaaatgcccggggagagggtgcggaacggccaaccaaccgg

SEQ ID NO: 17223 - protein, 155 aa, Zea mays
  misc_feature: Ceres CLONE 1382040-F
MGKGSVGASWWAFLLLAGVLLVVAATAGAEDGVVERDRKEDLRWCKQACEWQYGKDTPRKRECESECRERHQQADAGEDGDSGVDAYVLPLREGRVPAPVPAPPRGPAVGDPGVHEGGAAAAGLAGGHGSKEDGARAARSAGQMPGERVRNGQPT

SEQ ID NO: 17224 - DNA, 677 bp, Zea mays
  misc_feature: Ceres CLONE 1382041-F
  misc_feature: Encodes the peptide sequence at SEQ ID NO. 17225
aaagctggagctccccgcggtggcggccgctctagaactagtggatcccccgggctgcaggaattcgcacgagaccattacctagaacatcctaatcgaaaaaagaaaagcctccattcccgagtctccagccaaccacatccagtccaccccatccccctcgaccccgacaaccccgagtcccgacccgatggcgcccaaggccgagaagaagccagcggagaagaagccggcggccgaggagaaggcggagaagacgaccgcaggcaagaagcccaagtccgagaagcgcctgcccgcctcgaagtcctccggcaaggagggcggcgagaagaaggcgaagaagaaggccaagaagagcgaggagacctacaaaatctacatcttcaaggtcctaaagcaagtgcaccccgacatcggcatctcctccaaggccatgtccatcatgaactccttcatcaacgaaatcttccaaaagctcgccgggaggccggtaagttcgcccggaacacaagaaagcccccatcccctcccgggaaaaccaaacctccgggggcctccccccccccaggaaaagtcccccaaaaacccccgtcccccaagggaaacaagggccccccccccaggtccccccccatatttgggccaccctggcgcgccccccggttatttgtttt

SEQ ID NO: 17225 - protein, 162 aa, Zea mays
  misc_feature: Ceres CLONE 1382041-F
MAPKAEKKPAEKKPAAEEKAEKTTAGKKPKSEKRLPASKSSGKEGGEKKAKKKAKKSEETYKIYIFKVLKQVHPDIGISSKAMSIMNSFINEIFQKLAGRPVSSPGTQESPHPLPGKPNLRGPPPPQEKSPKNPRPPRETRAPPPGPPPYLGHPGAPPGYLF

SEQ ID NO: 17226 - DNA, 713 bp, Zea mays
  misc_feature: Ceres CLONE 1382043-F
  misc_feature: Encodes the peptide sequence at SEQ ID NO. 17227
  misc_feature (9)..(9): n is a, c, t, g, unknown, or other
  misc_feature (15)..(15): n is a, c, t, g, unknown, or other
  misc_feature (19)..(19): n is a, c, t, g, unknown, or other
  misc_feature (21)..(21): n is a, c, t, g, unknown, or other
  misc_feature (36)..(36): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
aaaaaaaanaacatnttantnaactcctatcataancaacggcggnnnngggtcaaagctggagctccccgcggtggcggccgctctagaactagtggatcccccgggctgcaggaattcgcacgagaccattacctagaacatcctaatcgaaaaccaattcgtctactgctcctccagctcctccgctgcgccgccggtcgccgcccgacaccgccgaagaagagcagacgccgagtccaggacgtcgccgcggggctcggggaacgcggtgttgccatcgcgaggaaggtcggaagttcgctgttcgcccgccggatcggcaccgtcgccaccgcccatggcaaccgtcgcccccgtcgtctccgacctcgtcgacttcctcaacgcgtcgcccaccgcctttcacgccgttgacgaggcgaagcggcggctgaaggcggcggggttcgtgcagctgtcggagcgggaggagtgggcgggtctcgagcccgggcgcaagtacttcttcacacgcaaccactccactatggtcgcttttgccatcggcgcaaaatacgttgctggcaatgggttccacatcatcggtgcacacactgacagcccttgcctgaagctcaagcctgtctccaaggtaaccaaaggaggttaccttgaaggttggggttcaaacgtatgggtgggtgggttgtgggaacacatgggtttggact

SEQ ID NO: 17227 - protein, 124 aa, Zea mays
  misc_feature: Ceres CLONE 1382043-F
  misc_feature: SWISSPROT Homolog: EC 3.4.11.21 Aspartyl aminopeptidase
MATVAPVVSDLVDFLNASPTAFHAVDEAKRRLKAAGFVQLSEREEWAGLEPGRKYFFTRNHSTMVAFAIGAKYVAGNGFHIIGAHTDSPCLKLKPVSKVTKGGYLEGWGSNVWVGGLWEHMGLD

SEQ ID NO: 17228 - DNA, 704 bp, Zea mays
  misc_feature: Ceres CLONE 1382045-F
  misc_feature: Encodes the peptide sequence at SEQ ID NO. 17229
  misc_feature (325)..(325): n is a, c, t, g, unknown, or other
  misc_feature (336)..(336): n is a, c, t, g, unknown, or other
  misc_feature (339)..(339): n is a, c, t, g, unknown, or other
  misc_feature (341)..(341): n is a, c, t, g, unknown, or other
  misc_feature (342)..(342): n is a, c, t, g, unknown, or other
  misc_feature (384)..(384): n is a, c, t, g, unknown, or other
  misc_feature (387)..(387): n is a, c, t, g, unknown, or other
  misc_feature (391)..(391): n is a, c, t, g, unknown, or other
  misc_feature (397)..(397): n is a, c, t, g, unknown, or other
ggagctccccgcggtggcggccgctctatcctagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgcgaccgcaggnaggacctgcgntgntnngcagcagcgtgcgagtggcagtacggaaaggacaccccgcgnaanaggnaatgcnagagcgagtgccgcgagcgccaccagcaagctgacgcgggcgaggacggcgaacggcgcgtggaacgcctacctcttccgcttccgaagggccaagtgccggcccccaggcctgccccccccacaaggccagccggggaaaacccataattgcttgagggggggcccccccccgggattggcccttaaaattgaacaaaaaatacggccccgggaaaaaaaaaagggggaaatagtcccggaaaaaggggaaaccccccaccccggggaaattggggagaaaaaacccccctctcttttaggaacta

SEQ ID NO: 17229 - protein, 112 aa, Zea mays
  misc_feature: Ceres CLONE 1382045-F
  misc_feature (40)..(40): Xaa is any aa, unknown, or other
  misc_feature (44)..(44): Xaa is any aa, unknown, or other
  misc_feature (45)..(45): Xaa is any aa, unknown, or other
  misc_feature (60)..(60): Xaa is any aa, unknown, or other
  misc_feature (62)..(62): Xaa is any aa, unknown, or other
  misc_feature (64)..(64): Xaa is any aa, unknown, or other
MGKGSVGASWWAFLLLAGVLLVVAATAGAEDGVVERDRRXDLRXXAAACEWQYGKDTPRXRXCXSECRERHQQADAGEDGERRVERLPLPLPKGQVPAPRPAPPTRPAGENP

SEQ ID NO: 17230 - DNA, 695 bp, Zea mays
  misc_feature: Ceres CLONE 1382046-F
  misc_feature (333)..(333): n is a, c, t, g, unknown, or other
  misc_feature (351)..(351): n is a, c, t, g, unknown, or other
  misc_feature (354)..(354): n is a, c, t, g, unknown, or other
aaagctggagctccccgcggtggcggccgctctagaactagtggatcccccgggctgcaggaattcgcacgagaccattacctagaacatcctaatcaaaaaagcttgttgctgctgctgaaggaaaagacaattttctccttacctcctgggctcaggcctcaggcgcacagccttctgcttctcttcctctcctcgcgtccccccaccaaaccctaacccgagcacccagcccctcctcgcgtctgctcgcgccggcctttggggctctcactctgagcggcagggacccgcagggctccggttgtgtccaggaaacatcccagttgttgncgagagaccaagaaatgncgnaaaaggaggaagcgaaaggttggagcgggaagagatggaagagcgggagcaggaaggggaggcaaaggaggtgaaggtgaagtttcctctcttcgatggctctgaaatcgggccccgtgcgttgcaaccgccgccgccactaccgtaacccgccttcagggaatccggctctcccccaattggccccaagaataatccattttaccccaaaaactggctagggagtgggaaaccaaaaaaagggggagggaaaaattttaaaaaaaaggacaaaaaatgtttcccacggggaagaagccccctttttgggggacttttccccaaaaggtgtatcccccaag

SEQ ID NO: 17231 - DNA, 767 bp, Zea mays
  misc_feature: Ceres CLONE 1382049-F
  misc_feature: Encodes the peptide sequence at SEQ ID NO. 17232
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (34)..(34): n is a, c, t, g, unknown, or other
  misc_feature (35)..(35): n is a, c, t, g, unknown, or other
nnnnnncccccccccccccccccccccccccccnntatatgggggggggggcaagctggagctccaccgcggtggcggccgctctagaactagtggatcccccgggctgcaggaattcgcacgagaccattacctagaacatcctaatcgaaaacccgtccctctcccacccttttcagatctgcctgcgagcccccgccacgcacccccatgcccatgcggccatgcccatgaccccccgacgcgaggccactactgccaatggctccctgccgtgaccgagcccatggaggacctcgccccgggggccctcgcactcttcgccgccgtcgctgacttcatagacgactccgctcctgctgccgccggggccgggatgccaccgccggagcccgagtccgcgcccgggagtccctgctccgactgcgggaggggcgccaccgcccacttcgagggcttcgccgacctcgcctccacgctcgtgctcgacgacctcggctcccccgcctccgcctccgcctccgccagctcggtccccgccctccggcccagggccgccaggaggcggcttagcgctcgactggcggggcgcgctgggggactccccctcccgtgggggcgccccgccggccccaagatggaaggaaagccgccccgcggtggtgccccaaacctttcttcgaccggtccccgcttctgggaatggttccggccggccgaacggcgcgccccgggcggacctgggcgtcgggcccggggccctgccc

SEQ ID NO: 17232 - protein, 160 aa, Zea mays
  misc_feature: Ceres CLONE 1382049-F
MEDLAPGALALFAAVADFIDDSAPAAAGAGMPPPEPESAPGSPCSDCGRGATAHFEGFADLASTLVLDDLGSPASASASASSVPALRPRAARRRLSARLAGRAGGLPLPWGRPAGPKMEGKPPRGGAPNLSSTGPRFWEWFRPAERRAPGGPGRRARGPA

SEQ ID NO: 17233 - DNA, 734 bp, Zea mays
  misc_feature: Ceres CLONE 1382050-F
  misc_feature: Encodes the peptide sequence at SEQ ID NO. 17234
  misc_feature (1)..(1): n is a, c, t, g, unknown, or other
  misc_feature (22)..(22): n is a, c, t, g, unknown, or other
  misc_feature (44)..(44): n is a, c, t, g, unknown, or other
  misc_feature (45)..(45): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
  misc_feature (734)..(734): n is a, c, t, g, unknown, or other
ntggggggggggccgcccgcgntgccctccgcccccggcccggnngaatnnnnngntcaaactggagctccccgcggtggcggccgctctagaacaagtggatcccccgggctgcaggaattcgcacgagaccattacctagaacatcctaatcgaaaaaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggtcttcgagttcaccgaggagtcacgccagtggatcgaccgcatgggtgactacaatggactcggaggcaagtgtaaccgtgggctctctgtggtcgacagctacaagctgctcaagggcgctgatgctctgggcgaaggagaaaacgttccttggcttgcacccctcggttgggggattggaagggctttcagggctttcttttccttggggccttgatgagaaatcatgggaatgacctcttcaccacttccggtaggggggcccaagccctttggctggggttccaggggcgtgcccccccaagggctggggcctttaaatttggcctggccggaaatatggaccn

SEQ ID NO: 17234 - protein, 103 aa, Zea mays
  misc_feature: Ceres CLONE 1382050-F
  misc_feature: SWISSPROT Homolog: EC 2.5.1.67 Chrysanthemyl diphosphate synthase
MAAGGNGAGGDTRAAFARIYKTLKEELLTDPVFEFTEESRQWIDRMGDYNGLGGKCNRGLSVVDSYKLLKGADALGEGENVPWLAPLGWGIGRAFRAFFSLGP

SEQ ID NO: 17235 - DNA, 703 bp, Zea mays
  misc_feature: Ceres CLONE 1382051-F
  misc_feature: Translation starting site: 206
  misc_feature: SWISSPROT Homolog: EC 5.3.3.2 Isopentenyl-diphosphate Delta-isomerase
  misc_feature (427)..(427): n is a, c, t, g, unknown, or other
  misc_feature (430)..(430): n is a, c, t, g, unknown, or other
  misc_feature (488)..(488): n is a, c, t, g, unknown, or other
  misc_feature (499)..(499): n is a, c, t, g, unknown, or other
  misc_feature (521)..(521): n is a, c, t, g, unknown, or other
aaagctggagctcaccgcggtggcggccgctctagaactagtggatcccccgggctgccggaattcgcacgagaccattacctataacatcctattcaaataaacattatcctccgcccccggcagccgcaaaaaagcttcgccgtcgcgtcccgctcctccgcccgcccgacgcgacccctaagaactggagagagagggcggcatggctgccgcagtggtcgacgacgctggtatggacgccgtccagaagcgcctcatgttcgaagacgaatgcattttggtggacgagcagggacaatgttgttggccatgagtcaaagtacaactgccatttgatggaaaaagattgaattctgagaatctgctacatagggggccatttccggggagttcctttttcactcaaaatatgagctgtactttncancaaagtccggcgacaagttacctttttctttagtttggacccatacctgctgcagccnccctctggtanccgtgagtctgagttatccagnagaacttaactttggtggtgagaaatgcagcacagaaggaagctactgggatgagcttgggcatccccagcaaaaaatatgccccaggtgaaccatttcccccctcctgggggcgaatgcttttacaaggcaccatcttgacgggaaatgggggggaagcatgaacttgaactaactgcttg

SEQ ID NO: 17236 - DNA, 665 bp, Zea mays
  misc_feature: Ceres CLONE 1382054-F
  misc_feature: Encodes the peptide sequence at SEQ ID NO. 17237
aagctggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccggggcctccttgctgcttcaggaagtgtagccgctataaaatttgagagcctttggcgtagcttctctgagtgggcggatgtccgagctgtggccaccacgtcatccttgcacttcgttgatagatcatctctaccaaggggcatccttctttaccctgatgatgatgaaagggtcacccgg

SEQ ID NO: 17237 - protein, 82 aa, Zea mays
  misc_feature: Ceres CLONE 1382054-F
  misc_feature: SWISSPROT Homolog: EC 4.1.1.36 Phosphopantothenoylcysteine decarboxylase
MATSEPVQESLVVHYSQPSRPRGLLAASGSVAAIKFESLWRSFSEWADVRAVATTSSLHFVDRSSLPRGILLYPDDDERVTR

SEQ ID NO: 17238 - DNA, 689 bp, Zea mays
  misc_feature: Ceres CLONE 1382058-R
  misc_feature (425)..(425): n is a, c, t, g, unknown, or other
  misc_feature (432)..(432): n is a, c, t, g, unknown, or other
  misc_feature (467)..(467): n is a, c, t, g, unknown, or other
cgattgggtaccgggccccccctcgaggtcgacggtatcgataagcttttttttttttttttttgtaaggagttatttcatcgtcgatttatttaattttagaaaccatacaataaaaagttaaataataatgccactgatattaatgagtcgcattttttggcgatgcagcaataaatttgacaagcgacttggtacctcccaaagtagatgggacgataagcacaagccctttcgcgacagacccaacccaacatgaattgaattcaaacttatcctcgaacgctaaactcacatcaagtagtaatccaacatctgtctcctccaaatggtcaccacaatcgcaatcgccaatcgcttcatctctcgagtgtatctctaccttcataccatgacgctcagtagtactatctttcgcacccgcntgttccnttgagaaaacagatacatcctcagcagcttttacngattttttcatgcatgccatggccgttttccaacatgttttgggccccgatttcaaaggggcccacccggggtaaaaaacccaaaactggcccagggaatcccttgagaaaattttccctttttaacgggggggaagggaaaaaaatgggtttaaaaggggccccgggaaaaaaacaaaaaaacctttggattttatccccccttttttaaaaaaaaatgtg

SEQ ID NO: 17239 - DNA, 698 bp, Zea mays
  misc_feature: Ceres CLONE 1382063-F
  misc_feature: Encodes the peptide sequence at SEQ ID NO. 17240
agagctggagctccccgcggtggcggccgctctagaactagtggatcccccgggctgcaggaattcgcacgagaccattacctagaacatcctaatcgaaaactagaagcctccaccctcctgcgcctccaccctcctcgccgcctcactccctctgcagaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtggcgctgctccagttgctgctgccgccccagctggaggtgctgcagctgctgctgcccctgctgcagaggagaaaaaggagagcccagggagagtctgatgacgacatgggctccagcctggtcgaactgagaggcctccctacccagccattagcaaattcccttatggtgggcaaaaacttatcttacggtatggccggaacccctttggtaattaacaagacctcaaggttttggggtttttggaaagggggcttttgaaaagggggatggaaaaaccttaaaccccctggtttta

SEQ ID NO: 17240 - protein, 98 aa, Zea mays
  misc_feature: Ceres CLONE 1382063-F
  misc_feature (21)..(96): Pfam Name: Ribosomal_60s Pfam Description: 60s Acidic ribosomal protein
MASGELACTYAALILSDDGIAITAEKIATIVKAANIKVESYWPALFAKLLEKRSVEDLILSVGSGGGAAPVAAAAPAGGAAAAAAPAAEEKKESPGRV

SEQ ID NO: 17241 - DNA, 678 bp, Zea mays
  misc_feature: Ceres CLONE 1382064-F
  misc_feature: Encodes the peptide sequence at SEQ ID NO. 17242
  misc_feature (342)..(342): n is a, c, t, g, unknown, or other
  misc_feature (406)..(406): n is a, c, t, g, unknown, or other
  misc_feature (424)..(424): n is a, c, t, g, unknown, or other
  misc_feature (444)..(444): n is a, c, t, g, unknown, or other
  misc_feature (506)..(506): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcnggtggtgcaagcaggcgtgcgagtggcagtacggagaggacacccccgcggaagagggaatgcnagagcgagtgccgcgagncgcaccagcaagctgacgcnggcgaggacggcgacagcggcgtggacgcctacgtctcccgctccgggaggggcgagtgccngcgccagtgcctggcccgccacgaaggccagccgtgggaaacccagagggcatgaggcggtgcccgccgccgggaacgggccgtcaaaatggacaaaaaatacggtcccggaaacaaaagaccggacaatgtccgaaagggggcaaaccccccccccgggggactgggggaa

SEQ ID NO: 17242 - protein, 106 aa, Zea mays
  misc_feature: Ceres CLONE 1382064-F
  misc_feature (56)..(56): Xaa is any aa, unknown, or other
  misc_feature (62)..(62): Xaa is any aa, unknown, or other
  misc_feature (89)..(89): Xaa is any aa, unknown, or other
MVGVPPARRRAAGRSSHGRGGGRSGRTGPQGGPAGGASRRASGSTERTPPRKRECXSECREXHQQADAGEDGDSGVDAYVSRSGRGECXRQCLARHEGQPWETQRA

SEQ ID NO: 17243 - DNA, 700 bp, Zea mays
  misc_feature: Ceres CLONE 1382067-F
  misc_feature: Encodes the peptide sequence at SEQ ID NO. 17244
agagctggagctccccgcggtggcggccgctctagaactagtggatcccccgggctgcaggaattcgcacgagaccattacctagaacatcctaatcgaaaaacaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagctctcgctcgccgccggcggcctctccctccccagctactccgactccgccaaggtcgcctacgtactacaaggcggcggtacctgcggcctcgtcctccccgaggtgactaaggagacgtgctgccggagaaggatggcgaccccctggagctgcccttccgcgcggtgacctggttggacaaagtccccggccgggaaggccaacccaacggggctcttccctccgggaaccctgcaaggggccacaagggggggggagtgtcccgaattccaaactcacgggggtccgggggtagtttttctgggggtgtgcacccgaaatcggtgctccggggggtgggtttctttcggaaccccccaaacccccattgggttgggttggaagcccacca

SEQ ID NO: 17244 - protein, 98 aa, Zea mays
  misc_feature: Ceres CLONE 1382067-F
MAAVDLTPRTPKKAYGGDGGAYYEWSPADLPMLAVASIGAAKLSLAAGGLSLPSYSDSAKVAYVLQGGGTCGLVLPEVTKETCCRRRMATPWSCPSAR

SEQ ID NO: 17245 - DNA, 716 bp, Zea mays
  misc_feature: Ceres CLONE 1382068-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (46)..(46): n is a, c, t, g, unknown, or other
  misc_feature (47)..(47): n is a, c, t, g, unknown, or other
  misc_feature (59)..(59): n is a, c, t, g, unknown, or other
nnnnnccccaccccnnnnnnacccccacccgccccctcctgggggnngggcaagctggngctccccgcggtggcggccgctctagaactagtggatcccccgggctgcaggaattcgcacgagaccattacctagaacatcctaatcgaaaatctgcgtgccgaataaccctcacccccgatcctcccgatggcctccgtgtgtttcgctgcgcgctgtaggtcccgggcaccgctccgcgcgtcgtctcccgatccacctccgcgttgaggacctcgtgccgtgggactcgaaaccggcgtgacccgcaaagctgacgacgcgcccaatcgatcccgctacggtgtatgttccatcaagcacgaccgacgtccctgaggctgtgctgttaggagcccttcgagctctcttgatgtaatacatgggaatagacccctggtgatccttatctgcaaagaacgccgttctatctgcggtgcttagcaggtgctctatggtatggctcaaaccttcgacgacacatgagacccgagggcccctactgtgaaacgccccagcactggcatggacagtgtcttgggaatgaaaggcctcaggccctgcaccctcggcttgggcatgagactgctgctccgttgcttacagcctatcgcgaacagctggggcctgctgcatgaccctgcccggggggcagcgcgacatcccacttgggaacg

SEQ ID NO: 17246 - DNA, 691 bp, Zea mays
  misc_feature: Ceres CLONE 1382070-F
  misc_feature (311)..(311): n is a, c, t, g, unknown, or other
  misc_feature (366)..(366): n is a, c, t, g, unknown, or other
  misc_feature (380)..(380): n is a, c, t, g, unknown, or other
  misc_feature (388)..(388): n is a, c, t, g, unknown, or other
agagctggagctccccgcggtggcggccgctctagaactagtggatcccccgggctgcaggaattcgcacgagaccattacctagaacatcctaatcgaaaagaggcctcccgtcgcggtggtcgctttcggccctggaccccgctgccggaatcgaatctcctcccctcctttctcctccgacctcccccttccccccctccgcggctccgccccgacccgtgacgcctcgcttcgcacccctctcgcatctccgccgcatctccgccgcgatcctcccgactagccgcgactgcctcccctccagcggncaggcagaggatggagggggcaggcaaggatggcaacccgttgaggaatatcggnatggcaagactctncgaattgnctcattcgggagggtgaaattacggagcatatcagcacgggacacaggtggcaatcaagatcctcaccgccgtaaaatcaaaggcatgggaatggaaaaaaaagtaaaaaaaagattaagattttggggttattatggatccccctattacccccccctaggagggtaaaaaacccccggttaaatttttttttttatggaaaaaagtaaagggggggaaaatttttattaatttttttaaaaaaaagaaccttcgaagaaaaaaaacccccccttttttccaaaaaaaaaaaacccggggag

SEQ ID NO: 17247 - DNA, 681 bp, Zea mays
  misc_feature: Ceres CLONE 1382078-F
  misc_feature: Encodes the peptide sequence at SEQ ID NO. 17248
agagctggagctccccgcggtggcggccgctctagaactagtggatcccccgggctgcaggaattcgcacgagaccattacctagaacatcctaatcgaaaaagcaagcagcgatccgaagctcaatcaattcactcaaacctcttccccaaatcttcgattagattctcgttgacaagaagactagaaccgaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccagaggcgcacgtgttcaagggcgacgtacccgggctgaagaaggaggaggtcaaggtggaggtcgaggacggcaacgtccttcagatcagcggcgagcgcaacagggagcaggaggagaagacggacacctgggcaccgcgtggagcggagcaccgggaggtttcctgcgcagggttccgactgcccgagaacggcaagacgggagcagattcacgggccgcatggaagaacggcgggcttacagtcactggggccgaaggaggaccgccagaaggctggaagtgaagggccattcaaatctcg

SEQ ID NO: 17248 - protein, 153 aa, Zea mays
  misc_feature: Ceres CLONE 1382078-F
  misc_feature (54)..(151): Pfam Name: HSP20 Pfam Description: Hsp20/alpha crystallin family
MSLIRRSNVFDPFSLDLWDPFEGFPFGSGNSSSLFPSFPRTSSETAAFAGARIDWKETPEAHVFKGDVPGLKKEEVKVEVEDGNVLQISGERNREQEEKTDTWAPRGAEHREVSCAGFRLPENGKTGADSRAAWKNGGLTVTGAEGGPPEGWK

SEQ ID NO: 17249 - DNA, 683 bp, Zea mays
  misc_feature: Ceres CLONE 1382084-F
  misc_feature: Encodes the peptide sequence at SEQ ID NO. 17250
  misc_feature (569)..(569): n is a, c, t, g, unknown, or other
  misc_feature (570)..(570): n is a, c, t, g, unknown, or other
  misc_feature (666)..(666): n is a, c, t, g, unknown, or other
  misc_feature (678)..(678): n is a, c, t, g, unknown, or other
  misc_feature (683)..(683): n is a, c, t, g, unknown, or other
aagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcagaacggagtacaggggcctgcccgacgccaatggcgaggacgcggggacggtgccggccgcgctccgcaaggtgtccatagtcccgctcgttttcctcatcttctacgaggtctccggcggggcgggcggcatcgaggacagcgtgggcgcagcggggccgctcctcgccatcgtcggcttccttgtcctccccgtcatctggagcatcccggaggcgctgattaccgcggagctgggcaccatgttcccggagaagcggcggtacgtcgtgtgggtcgcctcggcgctcggcccctactggggattccagcaaggnntgggtgaaagtgcctcagtggcgtcatcgacaatgccctgtaccccgtcctcttcctggactactccaagtccgccgtgctgcccctgggcggggnccccgccagggnccgtn

SEQ ID NO: 17250 - protein, 148 aa, Zea mays
  misc_feature: Ceres CLONE 1382084-F
  misc_feature (111)..(111): Xaa is any aa, unknown, or other
  misc_feature (143)..(143): Xaa is any aa, unknown, or other
  misc_feature (147)..(147): Xaa is any aa, unknown, or other
MGECRTEYRGLPDANGEDAGTVPAALRKVSIVPLVFLIFYEVSGGAGGIEDSVGAAGPLLAIVGFLVLPVIWSIPEALITAELGTMFPEKRRYVVWVASALGPYWGFQQGXGESASVASSTMPCTPSSSWTTPSPPCCPWAGXPPGXV

SEQ ID NO: 17251 - DNA, 705 bp, Zea mays
  misc_feature: Ceres CLONE 1382085-F
  misc_feature: Encodes the peptide sequence at SEQ ID NO. 17252
  misc_feature (524)..(524): n is a, c, t, g, unknown, or other
  misc_feature (560)..(560): n is a, c, t, g, unknown, or other
  misc_feature (609)..(609): n is a, c, t, g, unknown, or other
  misc_feature (619)..(619): n is a, c, t, g, unknown, or other
  misc_feature (630)..(630): n is a, c, t, g, unknown, or other
  misc_feature (649)..(649): n is a, c, t, g, unknown, or other
  misc_feature (659)..(659): n is a, c, t, g, unknown, or other
  misc_feature (660)..(660): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (694)..(694): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgacgccgctcgtggtgctcaacctcatcatgtacatcatcgtcatcggcttcgcgagctggaacctgaaccacttcatcaacgggcagaccaactaaccccggcgtggccggcaacggcgcgacgttctaacttcctggtgttcgccatcctggnccggcgtggtgggccgcgccaaaacttgtgttgggngggggggggtgccacccccgtgcacgcctgggcgccacgacagcctggnccaccaaaancgccgcgtcgntcgctcaatcgcctggggnccatcacggnngctcggaccttacgtcgttgnnnnnntggcaggnagattccacat

SEQ ID NO: 17252 - protein, 40 aa, Zea mays
  misc_feature: Ceres CLONE 1382085-F
MAGIGRNMVTPLVVLNLIMYIIVIGFASWNLNHFINGQTN

SEQ ID NO: 17253 - DNA, 716 bp, Zea mays
  misc_feature: Ceres CLONE 1382086-F
  misc_feature: Translation starting site: 246
  misc_feature (360)..(360): n is a, c, t, g, unknown, or other
  misc_feature (389)..(389): n is a, c, t, g, unknown, or other
  misc_feature (391)..(391): n is a, c, t, g, unknown, or other
aaagctggagctccccgcggtggcggccgctctagaactagtggatcccccgggctgcaggaattcgcacgagaccattacctagaacatcctaatcgaaaagagagaagtcttctctgtcacagcgccgacgcttcccaattccttccaatcggcacctcgccgtcctcgtgtgcaatccccagctctcctcggccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgatngtgaaaattctacggggggggggacccananaaggaaacttatgtttatatggacttcctaatgaaacatgggaaataaactggctggctgaggaggtccctcctgaattggcaaagccagcttctggaaataaattttggccgggaaggggaaggaagaaaaaaaattggttaacacttggtgcggggaaaaaggaatcttgggccaaggggcgggtgggattttatttttgggagaaagggtttggttttcaaaaagaaaacccgggaaaaggcccttttccccggagaaaaaaaaacctttcccccaaaaaaatatagggggtggcccacagagaacacccccaaaaaaaaag

SEQ ID NO: 17254 - DNA, 654 bp, Zea mays
  misc_feature: Ceres CLONE 1382088-F
  misc_feature: Encodes the peptide sequence at SEQ ID NO. 17255
  misc_feature (131)..(131): n is a, c, t, g, unknown, or other
tctgaactagtggatcccccgggctgcaggaattcgcacgagaccattacctagaacttcctaatcgaaaaattccccgccgcctcgcgcccccgctcgcttcacttctctaggtgcgcaccgatcaaaanagatggcggtgccgctgctgacgaataagatcgtgaagaagcgggtcaagcagttcaagaggccccacctcgaccgctacaagtgccttaagccaagctggcgcaggccaaagggtattgactcccgtgtcaggaggaagttcaagggatgcaccttgatgcccaacattggttatggttctgacaagtcgaccaggcactacctccccaggaggggggggaagtttgtggtccacaacgtttctgagctggagttgctcatgatgcacaacaggacctactgcgctggaattgctcacacgggtccactaagaagcccaaggagatccgggggagggtgctgcgcagctcgacattggggccacgaacaagttggctaggttccccagccgggaggacgaggaggctgggtttcttgccttacgggcgaagtggggggttgccatttcctttccggaggaaactacctttggtttggggcctctggtagacactgaaaaaccaaagtcacctcttaactttt

SEQ ID NO: 17255 - protein, 125 aa, Zea mays
  misc_feature: Ceres CLONE 1382088-F
  misc_feature (14)..(108): Pfam Name: Ribosomal_L32e Pfam Description: Ribosomal protein L32
MAVPLLTNKIVKKRVKQFKRPHLDRYKCLKPSWRRPKGIDSRVRRKFKGCTLMPNIGYGSDKSTRHYLPRRGGKFVVHNVSELELLMMHNRTYCAGIAHTGPLRSPRRSGGGCCAARHWGHEQVG

SEQ ID NO: 17256 - DNA, 614 bp, Zea mays
  misc_feature: Ceres CLONE 1382089-F
  misc_feature: Encodes the peptide sequence at SEQ ID NO. 17257
gctctagaactagtggatcccccgggctgcaggaattcgcacgagaccattacctagaacatcctaatcgaaaaatcggcctcagtcgcacatatctactatactatactctaggaagcaaggacaccaccgccatggcaggcaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagaggatgccggtgatgatgccacagatgatgacgcctaacatgatgtcaccattgatgatgccgagcatgatgtcaccaatggtcttgccgagcatgatgtcccaaatgatgatgccacaatgtcactgcgacgccgtctcggagattatgctgcaacagcagttaccattcatggtcaacccaatgggcatgacgatgtcacccatgttcttacagcaacccctttgtggggctgcattctagatggagatatttgtgttggatggaata

SEQ ID NO: 17257 - protein, 150 aa, Zea mays
  misc_feature: Ceres CLONE 1382089-F
MAGKMLALFALLALCASATSATHIPGHLPPVMPLGTMNPCMQYCMMQQGLASLMACPSLMLQQLLALPLQRMPVMMPQMMTPNMMSPLMMPSMMSPMVLPSMMSQMMMPQCHCDAVSEIMLQQQLPFMVNPMGMTMSPMFLQQPLCGAAF

SEQ ID NO: 17258 - DNA, 741 bp, Zea mays
  misc_feature: Ceres CLONE 1382093-F
  misc_feature: Translation starting site: 220
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (29)..(29): n is a, c, t, g, unknown, or other
  misc_feature (32)..(32): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
nnnnnnnnnccccnnnaaaaataacaaanacnaaaaggggtgcnnngngcagagctggggctccccgcggtggcggccgctctagaatagtggatcccccgggctgcaggaattcgcacgagaccattacctagaacatcctaatcgaaaaatcaaccatattattgagaccaacaagcaacatagaaggtggaatccagtagcaacaatagagcaacaatggggaccaagatattttccctccttatgctccttgctctttctacatgtgttgctaacgcgacaattttccctcaatgctcacaagctcctatagcttcccttcttcccccataccttccatcaattatagcttcaatatgggaaaacccagctcttcaaccatataggcttcaacaagcaatcgcagcaaccaacatagcgtggggcggccttgttgtttcaacaatcgccagccctatctttggtgcagtcattggtacaaagcatcaggggacaacagctggagcaactcgtgctacctctgatcaacccagtaggtctgggaaaccttttctcctactcctcagaacaacaattttcttccattcaaccaaggtggctaccctgaacccctgctggtttattgtgcggagacaacctattaccatttaggccgggggggggtactgggctaatcgtgaggaaagcgaggagggtgctttccttttttaaccaagttggcgcccccacttgagaccg

SEQ ID NO: 17259 - DNA, 657 bp, Zea mays
  misc_feature: Ceres CLONE 1382094-F
  misc_feature: Encodes the peptide sequence at SEQ ID NO. 17260
agagctggagctccccgcggtggcggccgctctagaactagtggatcccccgggctgcaggaattcgcacgagaccattacctagaacatcctaatcgaaaaatcttccaagtcaccaacgcaaattgcaccaagaaatccatcgagaggccgtcgacaggggaattaatggcgtcgtcgtctagcagcagccaccgccgcctcatcctcgcagccgccgtcctgctctccgtgctcgcggctgccagcgccagcgccgggacctcctgcgtgccggggtgggccatcccgcacaacccgctcccgagctgccgctggtacgtgaccagccggacctgcggcatcgggccgcgcctcccgtggccggagctagagaggagatgctggcgggagctggcggaatcccggcgtactgcggtggcacgggctggcatcctctggacggggcgatcccgccgggccggacgcccagtggaggccgctagaggaactgcgggctgccccgggaggggcaaaaggggatcccccgccccctcctccggggggccaagggaacctgggcccccttaaggggggcccccaagggcccttggatttttcgggggggggaaatggcccctccaataatttgggaaaagatatagggttggggggaaa

SEQ ID NO: 17260 - protein, 133 aa, Zea mays
  misc_feature: Ceres CLONE 1382094-F
MASSSSSSHRRLILAAAVLLSVLAAASASAGTSCVPGWAIPHNPLPSCRWYVTSRTCGIGPRLPWPELERRCWRELAESRRTAVARAGILWTGRSRRAGRPVEAARGTAGCPGRGKRGSPAPSSGGPREPGPP

SEQ ID NO: 17261 - DNA, 744 bp, Zea mays
  misc_feature: Ceres CLONE 1382098-F
  misc_feature: Translation starting site: 309
  misc_feature: Pfam Name: ChaC Pfam Description: ChaC-like protein
tggagctccccgcggtggcggccgctctagaactagtggatcccccgggctgcaggaattcgcacgagaccattacctagaacatcctaatcgaaaactctcatccgatttcccaggcaggtaggccgtcgaggagggcaggaagaccgaagaccgagccgtgcgggggctcgggacggaaacggtacaggacgccaaaatctcatatccttcctgcccgcccgcccgtgcccgaagacgcgtcgttcttgatggtcgcgccccacctccgccctctcctcctcgagggagatcggatacgccacaggatgcccgatgacgctgagagaccttcggctacggctccctcatctgtaaccccggcttccagtgcaacaagaaaatcctcggtttcatcaaggggtaacagcgcccctttaatctccgctggcctggaccattgaggaaccccggtatattcccgggaggccctgccggcttggaaccggacgacgtaggccttaggctgggggaaatggcaaattggggccgggggcggcccttaaaatcgagctaaaaaggcttacggaacttggaaaagaaaacaggggggactcccacccaaaaaatacccccttggtttccaaaagggaggaaaatccctggaaaccttgttgggggggggccctttaagggtccctttccccccccaaaatctatttggaaaactggctttttttttggccccccgatcttcttggaggg

SEQ ID NO: 17262 - DNA, 669 bp, Zea mays
  misc_feature: Ceres CLONE 1382100-F
  misc_feature: Encodes the peptide sequence at SEQ ID NO. 17263
  misc_feature (315)..(315): n is a, c, t, g, unknown, or other
  misc_feature (364)..(364): n is a, c, t, g, unknown, or other
  misc_feature (367)..(367): n is a, c, t, g, unknown, or other
  misc_feature (369)..(369): n is a, c, t, g, unknown, or other
  misc_feature (391)..(391): n is a, c, t, g, unknown, or other
  misc_feature (413)..(413): n is a, c, t, g, unknown, or other
  misc_feature (442)..(442): n is a, c, t, g, unknown, or other
  misc_feature (605)..(605): n is a, c, t, g, unknown, or other
aagctggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccggcggcaagagcgtcnaggcccaggagcacctcgccgaagggcgcagccgcggaggccaaactcncangnagcagctggggcagcaggggancagcgagatggggaagaagggncgtctgagcaccacggacgagtcgggcgncgagcgcgccgccggggagggcgtcagcatcgacgagtccaagttcaccaagtagtcctatcgcgtgcgtgcgtacgcagcgttcgtagctgtctgcgtagtgtaccttgggcgtagctagtgctactctctactttggagtagctgaatgataataatgganctagcagcatgcatggtagcgatcatacatacgtacgtacatgcaggtacttggtgtgtgatca

SEQ ID NO: 17263 - protein, 91 aa, Zea mays
  misc_feature: Ceres CLONE 1382100-F
  misc_feature (1)..(92): Pfam Name: LEA_5 Pfam Description: Small hydrophilic plant seed protein
  misc_feature (32)..(32): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (57)..(57): Xaa is any aa, unknown, or other
  misc_feature (74)..(74): Xaa is any aa, unknown, or other
MASGQESRKELDRKAREGETVVPGGTGGKSVXAQEHLAEGRSRGGQTXXXQLGQQGXSEMGKKGRLSTTDESGXERAAGEGVSIDESKFTK

SEQ ID NO: 17264 - DNA, 908 bp, Zea mays
  misc_feature: Ceres CLONE 1382101-F
  misc_feature: Encodes the peptide sequence at SEQ ID NO. 17265
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
ttttttgtttttaatgacttttnnnnnnccccnnnnnnncaagctggagctccccgcggtggcggccgctctataatagtggatcccccgggctgcaggaattcgcacgagaccattacctacaacatcctactcgaaaaagaagtcgagacgtgacgcccccgccccgcgtcttctactcttcttcatcttcactgctcaccaacccatccatcccccagtcctcctcactgctcacccgtctcccatccccacaccaccaccaccaagatcttccggccttcccctccccagacccggtgggatccccaccatccccgccccccgatggagctgctcgcgcgcgccaaggtggtggggctcaagagccaccaggacacgttcctgtacccgcgaccatgacgaagccgccccccgacgggggacgcgcgtactgacccacaagcaaacccgcgctcgccccaaggagcgcgttcccctcccacacccatgccgactttccagccggcgggacccgggaacggccaagtatcctcccgcttccacccggagagccgtgtccccgctggggcaattcactgcccgcgtaaagggtgtagaaatatggagcgccctgctcccagggcccgccacccccacaagcggggcccccggggtaactgtcgaaccccctttggctgctagcggtatacccagggaggccactcaccgcgtgttgagcggtcacgggcccaactttcattctccgtggcacaagggcgagagcttccacgcgaatcgggaggagaacaattgcagagcagcccacaagaatgggacccctcaagggctatcacgcctacgcgagtggaccactcgggagccgtcaagagagacgggaagagagggcgtacggcagcaacccaccg

SEQ ID NO: 17265 - protein, 32 aa, Zea mays
  misc_feature: Ceres CLONE 1382101-F
MGPLKGYHAYASGPLGSRQERREERAYGSNPP

SEQ ID NO: 17266 - DNA, 681 bp, Zea mays
  misc_feature: Ceres CLONE 1382102-F
  misc_feature (390)..(390): n is a, c, t, g, unknown, or other
  misc_feature (478)..(478): n is a, c, t, g, unknown, or other
  misc_feature (581)..(581): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaataaacaactcgaccaaacccaagtccagacccgcagctcccgtcagccgccggaggcggagggaaccgagccggcgaccggcagaccgcagagaagaggccagaagccgaccgcaggcagccgccaccgcaccaaaacccgaggtctcgaggcaatcgagcgcgcgcgggtcgggggctgcggccatgtcggtgagttgcgggctcgagtgggtggtgtgccttggctgcacgcggtgggcgtggaagcggctcacctacatcggcgcctaggagagcgagacgtgnccgccggcgtccgccgacgagttcgagcccgtcccgcgcctctgccgcgccgtgctcgcgaactacgacgaggagctctccagccccnaggtcggcgccggcggagcacggctacttcgacatcgacccgcagggcatccctcagggggctacctacgaggagggtcggcaacgcgtggcccggcgtaccntcggctacgtcgacgaggggcacaagggagatcatcctcggcgggcgggggcntccagcctcgggggcacggccaaactacgagggggctcatggacaac

SEQ ID NO: 17267 - DNA, 695 bp, Zea mays
  misc_feature: Ceres CLONE 1382104-F
  misc_feature (695)..(695): n is a, c, t, g, unknown, or other
aaagctggagctccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctagcgacggcggcgtgctaccggtgacattgtccccctcggcccctccatccctgacgcagcgggggcaggctgcaggaagccagcccctattcgagacaaggtcgatctttgctgccttggcgagcttcagccgaatcaaggtcgagcatggcggcaggccagtaaatagagcaacacaaaacccttcaaattaatgaagacctctgcagcaacccccgacccgggcgccacaccagggggccaacttccccatcggcatcgccctcggtcggtgggtggaggcttggggagggccagcggccgcagcggcaacatggggcaatcagtggggtcccatcctgagcgcgccccaaggaagcacgtgggctgggccccgcccgttcttn

SEQ ID NO: 17268 - DNA, 713 bp, Zea mays
  misc_feature: Ceres CLONE 1382105-F
  misc_feature: Encodes the peptide sequence at SEQ ID NO. 17269
  misc_feature (237)..(237): n is a, c, t, g, unknown, or other
  misc_feature (301)..(301): n is a, c, t, g, unknown, or other
  misc_feature (378)..(378): n is a, c, t, g, unknown, or other
ctggagctccccgcggtggcggccgctctagaactagtggatcccccgggctgcaggaattcgcacgagaccattacctagaacatcctaatcgaaaaacacactggctcgttctcacgacaaattcgattcatcaaaatctacaaacgtagtagtatttacgagaatagatattacaggcccaaacagctgctgcttctgttgaagcacgccgcaccggcagacgttacccctccnatggggcgatgcagaacggagtacaggggcctgcccgacgccaatggcgaggacgcggggacgntgcccggcgcgctccgcaaggtgtcatagtcccgctcgtttcctcatcttctaggagttctccgggggccgttcggnatgaggaaagcggggggccaggggggcccctcctcccccatggggggttccttgccccccccgcttttggggaatcccgggggccttaataccggggagttgggacccttttcccggaaaaggggggtaacccggggggggcccccccggcctccggcccaatggggaatcccaaagggggggggaagaggtttaggggggttataaaaaggctgtgccccccctctttttgggaaaaaaaaaaaacccggcgtctcctggggggggccccccccaagggggttttggggtgtctcatcccgggggggtgttgctttttacaaaagggggggccc

SEQ ID NO: 17269 - protein, 30 aa, Zea mays
  misc_feature: Ceres CLONE 1382105-F
  misc_feature (22)..(22): Xaa is any aa, unknown, or other
MGRCRTEYRGLPDANGEDAGTXPGALRKVS

SEQ ID NO: 17270 - DNA, 688 bp, Zea mays
  misc_feature: Ceres CLONE 1382106-F
  misc_feature: Encodes the peptide sequence at SEQ ID NO. 17271
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaataatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctacttcctggtgttcgcctcctggccnnncgttatgggggcgcggcgtccaagccttggcggacgtgcaccacgtgtcgcgtctggcgccacgacagcctggccaccaaacggccgcgtcgtccgctcatcgcctgggacatcacggcgctcgcccttcggactggcccttgcaaggagacccacatcgccg

SEQ ID NO: 17271 - protein, 115 aa, Zea mays
  misc_feature: Ceres CLONE 1382106-F
  misc_feature (14)..(93): Pfam Name: AWPM-19 Pfam Description: AWPM-19-like family
  misc_feature (61)..(61): Xaa is any aa, unknown, or other
MAGIGRNMVAPLLVLNLIMYIIVIGFASWNLNHFINGQTNYPGVAGNGATFYFLVFASWPXVMGARRPSLGGRAPRVASGATTAWPPNGRVVRSSPGTSRRSPFGLALARRPTSP

SEQ ID NO: 17272 - DNA, 744 bp, Zea mays
  misc_feature: Ceres CLONE 1382107-F
  misc_feature: Encodes the peptide sequence at SEQ ID NO. 17273
  misc_feature (523)..(523): n is a, c, t, g, unknown, or other
  misc_feature (544)..(544): n is a, c, t, g, unknown, or other
  misc_feature (630)..(630): n is a, c, t, g, unknown, or other
  misc_feature (676)..(676): n is a, c, t, g, unknown, or other
  misc_feature (726)..(726): n is a, c, t, g, unknown, or other
  misc_feature (727)..(727): n is a, c, t, g, unknown, or other
aaagctggagctccccgcggtggcggccgctctagaactagtggatcccccgggctgcaggaattcgcacgagaccattacctagaacatcctaatcgaaaagttccgtgtccgcgtccagtgtgtccgctccccctcagtcctagcggtagcgtgcgcgcgggagacgtagatggcggcttcggcggcggcggcggcggcggcggcgacaccggtggcgccgacagaggggacggtgatcgcgatccacagcctggaggagtggagcatccagatcgaggtgacctacacgctccggtgcgccggcaaggaggtggcgtccggcaccatgccggaccccggctggatcgccgccagcggctccaccgcgctggagatccccgccaaggtgccctacgacttcctcgtctccctcgtcagggacgtcggccgggactgggacatcgactacgagctccaggtcggactcaccgtcgacctccccatcgtcggcaacttcaccatcccgctctccacctccggngagttcaagctccccaccctncaggacttgttctgatctagtagtagctcgcttgccttctgttctgtgcgggcgcgcaccagcgatctgtacgacgagcttttgcnaaataacgacgcagctcctctggtctatatatctcagtggatgccntagctagggggatggatggtttaataaataaagagctggatttcattcannaaaaaaaaaaaaaaaag

SEQ ID NO: 17273 - protein, 128 aa, Zea mays
  misc_feature: Ceres CLONE 1382107-F
  misc_feature (2)..(128): Pfam Name: LEA_2 Pfam Description: Late embryogenesis abundant protein
MAASAAAAAAAATPVAPTEGTVIAIHSLEEWSIQIEVTYTLRCAGKEVASGTMPDPGWIAASGSTALEIPAKVPYDFLVSLVRDVGRDWDIDYELQVGLTVDLPIVGNFTIPLSTSGEFKLPTLQDLF

SEQ ID NO: 17274 - DNA, 656 bp, Zea mays
  misc_feature: Ceres CLONE 1382108-F
  misc_feature: Encodes the peptide sequence at SEQ ID NO. 17275
  misc_feature (338)..(338): n is a, c, t, g, unknown, or other
  misc_feature (347)..(347): n is a, c, t, g, unknown, or other
  misc_feature (352)..(352): n is a, c, t, g, unknown, or other
  misc_feature (365)..(365): n is a, c, t, g, unknown, or other
  misc_feature (512)..(512): n is a, c, t, g, unknown, or other
  misc_feature (533)..(533): n is a, c, t, g, unknown, or other
gctctagaactagtggatcccccgggctgcaggaattcgcacgagaccattacctagaacatcctaataaaaaaggaggaaaagcacgcgagagcttgtcggagggctctctgtctctgtgataaaccgatacgcagaggaagctgcggagaggtgtccctgctctgccggtgagctgcggccagcgggtgaagagaagtggaccggacggggaggaaggagagagagaagaagaaaaaggcgccgcgggggccatggctggacacgcgccggcgagggacaagaccaccaccggcttcgccgctacgtgcagcctgctgagccagtttctcaagganaagaggggncggcnctgggggcctcgncggcctcgccatggcgccggcgccggcagctggagcaggggctttccggccgccgaccaccatgaacttgctgtccgcgctcgacgcggccaaggccaccgtcgggggagccagaaggccatggccaacgcaccggcggaatcaggngaaagggggggtgggggaagnagggccaccagctgaccatcttctacgggggaaaagtggtcgtcgttcgacaggttccccctccgccagggcaagggacctgctgcatatcgtgaggccggccgggggccgaccgccgtggtg

SEQ ID NO: 17275 - protein, 93 aa, Zea mays
  misc_feature: Ceres CLONE 1382108-F
  misc_feature (46)..(46): Xaa is any aa, unknown, or other
  misc_feature (53)..(53): Xaa is any aa, unknown, or other
MAPAPAAGAGAFRPPTTMNLLSALDAAKATVGGARRPWPTHRRNQXKGGVGEXGPPADHLLRGKSGRRSTGSPSARARDLLHIVRPAGGRPPW

SEQ ID NO: 17276 - DNA, 654 bp, Zea mays
  misc_feature: Ceres CLONE 1382110-F
  misc_feature: Encodes the peptide sequence at SEQ ID NO. 17277
  misc_feature (318)..(318): n is a, c, t, g, unknown, or other
  misc_feature (369)..(369): n is a, c, t, g, unknown, or other
  misc_feature (389)..(389): n is a, c, t, g, unknown, or other
  misc_feature (481)..(481): n is a, c, t, g, unknown, or other
  misc_feature (564)..(564): n is a, c, t, g, unknown, or other
  misc_feature (601)..(601): n is a, c, t, g, unknown, or other
  misc_feature (610)..(610): n is a, c, t, g, unknown, or other
  misc_feature (611)..(611): n is a, c, t, g, unknown, or other
aaagctggagctccccgcggtggcggccgctctagaactagtggatcccccgggctgcaggaattcgcacgagaccattacctagaacatcctaatcgaaaaatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagtcatctcaccctcatcttcgtcttcgccggccagggctccggcatggncttcagcaagctgaccggcggcggcccgacgaccccggcgggcctgatcgncgcggcggtggcgcacgcgntcgcgctgttcgtgggcgtgtctgtgggcgcgaacatctccggcgggcacgtgaacccctgccggtgacttccgggggcttcggggggcggnaacatcaaccttgttcccgggggctcctggacctggtggggccacttgctgggggcccaccgggggggggttcctggtcccgntttccaaaggggggggaaggccacgggaccctttcgntttacaggnnttgttccgggggggaaggccttgttgcttgaaaaaccaaaaaa

SEQ ID NO: 17277 - protein, 47 aa, Zea mays
  misc_feature: Ceres CLONE 1382110-F
  misc_feature (2)..(2): Xaa is any aa, unknown, or other
  misc_feature (19)..(19): Xaa is any aa, unknown, or other
  misc_feature (26)..(26): Xaa is any aa, unknown, or other
MXFSKLTGGGPTTPAGLIXAAVAHAXALFVGVSVGANISGGHVNPCR

SEQ ID NO: 17278 - DNA, 784 bp, Zea mays
  misc_feature: Ceres CLONE 1382111-F
  misc_feature: Encodes the peptide sequence at SEQ ID NO. 17279
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnnnnnnaaaannnnnnnngggggggggtnnnnnccaagctggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcctccttatgctccttgggctttctgcaagtgctgctacggcgaccattttcccacaatgctcacaagctcctatagcttcccttcttccctcgtacctctcaccagcggtgtcttcggtatgtgaaaacccaattcttcagccctacgggatccaacagggaattgcagctggcatcttacctttatcacccttggggctcgggggatcatcagccctattacagcagttacctttggggggatttatgggcacaaaacatgggggggacaacgactacgacaacttggggctaggaaagcttggtggcctattcccaggaacatcgggtgtctttccgtttcaaccaactaaccttgcattggaaccctggcttgcttattttggcaagaaacagcgacctagccgtttcgggccgggttatcctggtggggctaccccccgggcgaatgggcgttcccatttcaacccaagttgagacagggttgggaagttcgccccctgggtttattttaaccgggcgggtcgacggacgtagcttaccgcatttctcgccg

SEQ ID NO: 17279 - protein, 165 aa, Zea mays
  misc_feature: Ceres CLONE 1382111-F
MAAKIFCLLMLLGLSASAATATIFPQCSQAPIASLLPSYLSPAVSSVCENPILQPYGIQQGIAAGILPLSPLGLGGSSALLQQLPLGGFMGTKHGGDNDYDNLGLGKLGGLFPGTSGVFPFQPTNLALEPWLAYFGKKQRPSRFGPGYPGGATPRANGRSHFNPS

SEQ ID NO: 17280 - DNA, 682 bp, Zea mays
  misc_feature: Ceres CLONE 1382112-F
  misc_feature: Encodes the peptide sequence at SEQ ID NO. 17281
  misc_feature (619)..(619): n is a, c, t, g, unknown, or other
aagctggagctccccgcggtggcggccgctctagaactagtggatcccccgggctgcaggaattcgcacgagaccattacctagaacatcctaatcaaaaaagacagacgcaggcggcaggcagcggcgcagcgcaccgcttcttcctcttctatctctcatctacagccttcgctgcgccgccatggccaccacccgcttgctgccgctgctccgacgccgcctcgccgccgcaatcgccggatcgcctgctccctactccctccgaggaccctcatttcctgcaccagcagctgcagggctaaggtccctcctaaaagctgctggagcgagcgatactgcaacagaaccccaggaccaacagcattccgaaacaactcccccgccggcttctgtcccgacaccggagtccggtctcagagtcagggacacctcccacctgaagatctcaccaaggcatgacctcgccatgatctttacgtgcaaggtgtgcgagaacaggtccatgaagatggccagcagggactcgtacgagaacggagtcgtggtcgtgcggtgcggtggctggcacaacctcccactcatggcggacaggcttggctggtttggggagccgggnagcattgaggactttcctagcgacccaaggggaaggaagttaaaaaaggtttcaacgaaacta

SEQ ID NO: 17281 - protein, 71 aa, Zea mays
  misc_feature: Ceres CLONE 1382112-F
  misc_feature (1)..(64): Pfam Name: zf-DNL Pfam Description: DNL zinc finger
MIFTCKVCENRSMKMASRDSYENGVVVVRCGGWHNLPLMADRLGWFGEPGSIEDFPSDPRGRKLKKVSTKL

SEQ ID NO: 17282 - DNA, 668 bp, Zea mays
  misc_feature: Ceres CLONE 1382116-F
  misc_feature: Translation starting site: 171
aaagctggagctccccgcggtggcggccgctctagaactagtggatcccccgggctgcaggaattcgcacgagaccattacctagaacatcctaatcgaaaaatcaaccatattattgagaccaacaagcaacatagaaggtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaagccagctcttcaaccctataggctccaacagcaatcgcagcaagcaacatacctttatcacccttggttcacaaatcgcagccgtatctttggtgcagtcattggtacaaaccatcagggcacagcagctgcagcaactcgtgctacctggggatcacccaggtactctgggaaaccttttctccctactctcaggaacaacaaatttcttccatttcaccaaattggctacattggaacggggctggcttatttgcaggaaacaatattaacatttcagcccggttggtttctgggcaaatttccagaaaaaaaaaattctttccttttaacccagtgggccggaggg

SEQ ID NO: 17283 - DNA, 626 bp, Zea mays
  misc_feature: Ceres CLONE 1382118-F
  misc_feature: Encodes the peptide sequence at SEQ ID NO. 17284
  misc_feature (303)..(303): n is a, c, t, g, unknown, or other
  misc_feature (307)..(307): n is a, c, t, g, unknown, or other
  misc_feature (362)..(362): n is a, c, t, g, unknown, or other
  misc_feature (529)..(529): n is a, c, t, g, unknown, or other
gcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtaggtgtgggtgcatcatggtgggcgttcctcctgctcgccggcgtgctgctggtcgtagcagccacggccggggcggaggacggagtggtccaacgggaccgcaaggaggacctgcggtggtgcaagcaggcgtncaantggcaggagggggggggcgcgctcgcgaagagggaatgcaagagcgagtgccgcnagcgccaccagcaagctgacgcgggcgaggacggcgacggggggggtggacgcctacgtctcccggtccggaaggggcggagtgccggcgccagtgcctgcgccgccacgagggccagccgggggagaaccagaagtgcatgagggggtgccgcccccgcggactgnccgtccacatgaagccaggagtaccgtcccggcagggagagggcggccaagggccgggaggaggggggagcccaccaccggcgggactggggggaga

SEQ ID NO: 17284 - protein, 167 aa, Zea mays
  misc_feature: Ceres CLONE 1382118-F
  misc_feature (101)..(101): Xaa is any aa, unknown, or other
  misc_feature (102)..(102): Xaa is any aa, unknown, or other
  misc_feature (121)..(121): Xaa is any aa, unknown, or other
QEFARDHYLEHPNRKIDPAISSPSFTTQSATPLVACDLYVDEITGRVADDDTWGRVGVGASWWAFLLLAGVLLVVAATAGAEDGVVQRDRKEDLRWCKQAXXWQEGGGALAKRECKSECRXRHQQADAGEDGDGGGGRLRLPVRKGRSAGASACAATRASRGRTRSA

SEQ ID NO: 17285 - DNA, 736 bp, Zea mays
  misc_feature: Ceres CLONE 1382121-F
  misc_feature: Encodes the peptide sequence at SEQ ID NO. 17286
  misc_feature (702)..(702): n is a, c, t, g, unknown, or other
  misc_feature (707)..(707): n is a, c, t, g, unknown, or other
  misc_feature (727)..(727): n is a, c, t, g, unknown, or other
  misc_feature (730)..(730): n is a, c, t, g, unknown, or other
  misc_feature (733)..(733): n is a, c, t, g, unknown, or other
aagctggagctccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggagaccaagatattttccctccttatgctccttgctctttctacatgtgttgctaacgcgacaattttccctcaatgctcacaagctcctatagcttccctttttcccccataccttccatcaattatagcttcagtatgtgaaaacccagctcttcaaccatataggcttcaacaagcaatcgcagcaagcaacatacctttatcgcccttgttgtgtcaacaatcgccagccctatctttggtgcagtcattggtacaaaccatcagggcacaacagctgcagcaactcgtgctacctgtgatcaaccaagtagctctggcaaacctttctccctactctcagcaacaacaatttcttccattcaaccaactgtctacactgaaccctgctgcttatttgcagcaacaactattaccatttagccagctagctactgcctactctcaacacaacaacttcttccatttaaccaattggccgcactgaaccccgctgcttatttgcagcagcaaataagccgcggcgctcgnccagncatcgtcgccctggcgccgncgncgncgg

SEQ ID NO: 17286 - protein, 163 aa, Zea mays
  misc_feature: Ceres CLONE 1382121-F
METKIFSLLMLLALSTCVANATIFPQCSQAPIASLFPPYLPSIIASVCENPALQPYRLQQAIAASNIPLSPLLCQQSPALSLVQSLVQTIRAQQLQQLVLPVINQVALANLSPYSQQQQFLPFNQLSTLNPAAYLQQQLLPFSQLATAYSQHNNFFHLTNWPH

SEQ ID NO: 17287 - DNA, 760 bp, Zea mays
  misc_feature: Ceres CLONE 1382123-F
  misc_feature: Encodes the peptide sequence at SEQ ID NO. 17288
  misc_feature (278)..(278): n is a, c, t, g, unknown, or other
  misc_feature (760)..(760): n is a, c, t, g, unknown, or other
aagctggagctccccgcggtggcggccgctctagaactagtggatcccccgggctgcaggaattcgcacgagaccattacctagaacatcctaatcgaaaaaccccagccgccgccgccgccaccgccaccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctgnagggagtctcgattctgccctcgaagcgccctccgcacaaggtggctggcttcagtaaccaccctgatgcccccgcatcaagcggggccccaatccgcgggatttccgcttcaatttcagggagaagaaccccaacccccactttggatttccggcccgaaaaaccccccgccccaaggccaaaaaatcccccttcaaaagggaacccttggaaatctccctcctcccctcccattggccccaactccccccgggttttaacgccctgcttttatcttctcaacccccccccctcaaagggccccccccaaaaaggggggccccccccggggaccccctttaaaatatccggggggggtccccctttgtgcccccctggatatttcagaggggggccccccacaaataggaaacactcttttatacccttttggcgccgccccccggcgagcgaacaaaatttttaaatactcccgcctgan

SEQ ID NO: 17288 - protein, 190 aa, Zea mays
  misc_feature: Ceres CLONE 1382123-F
  misc_feature (1)..(122): Pfam Name: Ribosomal_S17e Pfam Description: Ribosomal S17
  misc_feature (36)..(36): Xaa is any aa, unknown, or other
MGRVRTKTVKKTSRQVIEKYYSRMTLDFHTNKKVLXGVSILPSKRPPHKVAGFSNHPDAPASSGAPIRGISASISGRRTPTPTLDFRPEKPPAPRPKNPPSKGNPWKSPSSPPIGPNSPRVLTPCFYLLNPPPSKGPPQKGGPPPGTPFKISGGGPPLCPPGYFRGGPPTNRKHSFIPFWRRPPASEQNF

SEQ ID NO: 17289 - DNA, 673 bp, Zea mays
  misc_feature: Ceres CLONE 1382128-F
  misc_feature: Translation starting site: 189
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
aaagctggagctccccgcggtggcggccgctctagaactagtggatcccccgggctgcaggaattcgcacgagaccattacctagaacatcctaatcgaaaaaaaagtttcgtccaccatttcgctctcgcaagtcgcaagccaccgatttgtttacaggcgccggagctcccgacgacgactgagccatgtgcggcggcgcgatccttgccgagctccgcgagccggcgccgcgccggctcacggagcgggacatctggcagcagaagaagaagcccaagaggggcggcgccggcgggaggcgctcgttcgcggcggaagacgatgaggacttcgaggccgacttcgaggactttgaagccgactccggtgaggcgggggtggagctcgnnnaaggggctgacgacgacgtcatcgagatcaagcccttcgccgccaagagtactttctccagagatggcttaagcaccatgactactgctggttatgatgcccctgcagcaaggttggccaaaaggaagaggaagaatcaatacaggggtatccgccagcgcccttggggtaagtgggctgctgagatcagaatccccagaagggcgttcgtgtttggcttggtactttcaataggccggagggaactgcaagagcttatgatgctgaagcgccgcagatc

SEQ ID NO: 17290 - DNA, 755 bp, Zea mays
  misc_feature: Ceres CLONE 1382129-F
  misc_feature: Encodes the peptide sequence at SEQ ID NO. 17291
  misc_feature (403)..(403): n is a, c, t, g, unknown, or other
  misc_feature (404)..(404): n is a, c, t, g, unknown, or other
  misc_feature (490)..(490): n is a, c, t, g, unknown, or other
  misc_feature (491)..(491): n is a, c, t, g, unknown, or other
  misc_feature (739)..(739): n is a, c, t, g, unknown, or other
  misc_feature (747)..(747): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggatggnnagagcgagtgccgcgagcggcaccagcaagctgacgcgggcgaggacgggcgacagcggcgtggacgcctacgtctcccgctcggnnaaaggggcgagtgccgggcgcagtgcctgcgccgccacgagggccagccgtgggagacccaggagtgcatgaggcggtgccgccgccgcggactgggcgtcgacatggagcaagagtacggtcgcggcagcgagagcgcgggcaagtggccgggagaggtgcgagcgccaccaccgcggggacctggtgggaagagcagcgctgcctgagatgaaaaaaaaacgcgggaggggaaagaaggagggcgncacggggncccggggg

SEQ ID NO: 17291 - protein, 161 aa, Zea mays
  misc_feature: Ceres CLONE 1382129-F
  misc_feature (64)..(64): Xaa is any aa, unknown, or other
  misc_feature (93)..(93): Xaa is any aa, unknown, or other
MGKGSVGASWWAFLLLAGVLLVVAATAGAEDGVVERDRKEDLRWCKQACEWQYGKDTPRKRDGXSECRERHQQADAGEDGRQRRGRLRLPLGXRGECRAQCLRRHEGQPWETQECMRRCRRRGLGVDMEQEYGRGSESAGKWPGEVRAPPPRGPGGKSSAA

SEQ ID NO: 17292 - DNA, 719 bp, Zea mays
  misc_feature: Ceres CLONE 1382131-F
  misc_feature: Encodes the peptide sequence at SEQ ID NO. 17293
  misc_feature (432)..(432): n is a, c, t, g, unknown, or other
aaagctggagctccccgcggtggcggccgctctagaactagtggatcccccgggctgcaggaattcgcacgagaccattacctagaacatcctaatcgaaaaaacattagcaaggcgatagataagaggaaggaaagaacataggcagccgaagcgactgtcgcgaggcaaggccatcgtccgccatgacgctctccctctccacctctttcctccccatccccgccgccgcgaggaccaccgcccgcaccctacgctccgtcgtcccctcccaggggatgcgctgctcgatgcgcaagaagggggaggacagcggcgaccgctgcccttgcgagaagcagtgcgagggccaccacgaccgggaaagcaggcaggggtgcgtccaggcttgcgagcgccggcaacagcagcgcggcggcagccgtgactccnacgtcgacgaggacgacggcgaccgggggtgccagatgaaatggcggcgcccacagcgatcggcaggcggaggcaagtggtgccttgcagcgcctgcccagggttagcccacagggaggagggacgccggccccccaacgaacaaacaaaagggggccgggtggcccaaaaaaaaaatcgccggccccccacaggggaatcgggaaggggaagggccaaggggggtggctttcaaaggccttttgggaagggggaaacccacccggggggggggccccccccccccc

SEQ ID NO: 17293 - protein, 117 aa, Zea mays
  misc_feature: Ceres CLONE 1382131-F
  misc_feature (83)..(83): Xaa is any aa, unknown, or other
MTLSLSTSFLPIPAAARTTARTLRSVVPSQGMRCSMRKKGEDSGDRCPCEKQCEGHHDRESRQGCVQACERRQQQRGGSRDSXVDEDDGDRGCQMKWRRPQRSAGGGKWCLAAPAQG

SEQ ID NO: 17294 - DNA, 671 bp, Zea mays
  misc_feature: Ceres CLONE 1382133-F
  misc_feature: Encodes the peptide sequence at SEQ ID NO. 17295
  misc_feature (388)..(388): n is a, c, t, g, unknown, or other
  misc_feature (396)..(396): n is a, c, t, g, unknown, or other
aaggtggagctccccgcggtggcggccgctctagaactagtggatcccccgggctgcaggaattcgcacgagaccattacctagaacatcctaatcgaaaaaggcaactactccgtctcacgcctctcctgtcccctctcgccgctctcgccccgcctctgcctccggctccgcctcctccatcgcacccaggtttcctccccaccccaccgccactcctaccccgccacgtcgtgtagtcgcggcggcggatatgcaagccgccgccgccttcaaccaggcagccttcaccgtccgctcgctgcatcgccccccgaggcccctccatctagctgttgcggaggatgcttttgcgggaataaaaggcgcgggggggaggggggcccgntgctgcgnaagcctctctgtcggcgtcggcagctacgacagcgagcacactccagtatttccaagacaacaatcatgggatccctacaagcttcttggggttgatcaagatgcatctggaagaagaggtccggagggcaccggaattttcttctaaaacaatacgccggatatgaagaaagtgaagaggccattggaaggggcttatgacaagataataatgaataggctacgcagaccctaagaaatccaaattcaatctgaaaagcaggcgtaaagaggag

SEQ ID NO: 17295 - protein, 96 aa, Zea mays
  misc_feature: Ceres CLONE 1382133-F
  misc_feature (48)..(48): Xaa is any aa, unknown, or other
MQAAAAFNQAAFTVRSLHRPPRPLHLAVAEDAFAGIKGAGGRGARCCXSLSVGVGSYDSEHTPVFPRQQSWDPYKLLGVDQDASGRRGPEGTGIFF

SEQ ID NO: 17296 - DNA, 724 bp, Zea mays
  misc_feature: Ceres CLONE 1382137-F
  misc_feature: Encodes the peptide sequence at SEQ ID NO. 17297
  misc_feature (573)..(573): n is a, c, t, g, unknown, or other
  misc_feature (574)..(574): n is a, c, t, g, unknown, or other
  misc_feature (582)..(582): n is a, c, t, g, unknown, or other
aagctggagctccccgcggtggcggccgctctagaactagtggatcccccgggctgcaggaattcgcacgagaccattacctagaacatcctaatcgaaaaaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctgaactcctctcccaacaaggggccagcctcacccccaacgcccatctaagccaagtgcacggtgctgctagatcccgatctcgttctgccaaccgccgagggagggttgcgctcgccggatcccgcccgagtcacgtgcggctttgattcgctgcacctgtcgtgcaggaaccggaggaacgaggatggaggatgactcgccgctgacgaagacgatgaagggtgcggtgacaggactcgccgcgggaaccatctgggggcaccgtcggcgcacctggtacgacgtggcccccgtggtggagcgccacgtcgcgctccctggnncttatccngaccgctcaagatgtgcggcacctacggggccaccttcgccaccaatcgggggcttctacatcggcgtcaagcagctcgtgcagagccagcgcaagaagcgcgacttctccaacggggcccgtcggcggcgttcgtttgcgg

SEQ ID NO: 17297 - protein, 96 aa, Zea mays
  misc_feature: Ceres CLONE 1382137-F
  misc_feature (47)..(47): Xaa is any aa, unknown, or other
MEDDSPLTKTMKGAVTGLAAGTIWGHRRRTWYDVAPVVERHVALPGXYPDRSRCAAPTGPPSPPIGGFYIGVKQLVQSQRKKRDFSNGARRRRSFA

SEQ ID NO: 17298 - DNA, 751 bp, Zea mays
  misc_feature: Ceres CLONE 1382138-F
  misc_feature: Encodes the peptide sequence at SEQ ID NO. 17299
  misc_feature (1)..(1): n is a, c, t, g, unknown, or other
  misc_feature (15)..(15): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
ncccccccccccccnnctnnccccttccccgcggtggtgggcnntnntcagagctggggctccccgcggtggcggccgctctagaactagtggatcccccgggctgcaggaattcgcacgagaccattacctagagcatcctaatcgaaaattggagctctcaccggtggacaacttccagtacggagtacaaacctggcctgtttcctagaagccattgaagctggctgtacgaacacaacaggaaatgatgattaccacgtgatggagtttgactgcgaagatggtggcttaccactttatcaaattatgctacctaggccagccagccccactgggtctgggtgcaccgatgcagtcctcgtaacagaagcaggatcttggaggctatgatacttatattgggaccaggaaagatggcgggggcgggtggaagtagccactcgcagtcccatcatggaggagattggcctgcctctttggctccctcaaacttagtaacagcaactgtgagccaggttcgaggccgggtcagtgaggttcgggcctggtaggtagggaaggggtcttcctccagttttccatgctgcatcaggagtgtatcttctagatgggggagggggagcgtccagaggggattttgtagaagcctgggggtcattttcatggcccatgggggcagggcccatccgggaaaagagaggtcgggtgcattaacccggaggggggctggtttaggcgttccgttaga

SEQ ID NO: 17299 - protein, 42 aa, Zea mays
  misc_feature: Ceres CLONE 1382138-F
MEFDCEDGGLPLYQIMLPRPASPTGSGCTDAVLVTEAGSWRL

SEQ ID NO: 17300 - DNA, 733 bp, Zea mays
  misc_feature: Ceres CLONE 1382139-F
  misc_feature: Translation starting site: 179
  misc_feature: Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (175)..(175): n is a, c, t, g, unknown, or other
  misc_feature (406)..(406): n is a, c, t, g, unknown, or other
  misc_feature (566)..(566): n is a, c, t, g, unknown, or other
  misc_feature (573)..(573): n is a, c, t, g, unknown, or other
  misc_feature (574)..(574): n is a, c, t, g, unknown, or other
  misc_feature (613)..(613): n is a, c, t, g, unknown, or other
  misc_feature (670)..(670): n is a, c, t, g, unknown, or other
  misc_feature (678)..(678): n is a, c, t, g, unknown, or other
  misc_feature (714)..(714): n is a, c, t, g, unknown, or other
aaagctggagctcaccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccnaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgcntctgtggaagtttgagaccaccaagtactactgcacggtcattgatgcccctggacaccgtgacttcatcaagaacatgatcactggtacctcccaggctgactgtgctgtccttatcattgactccacccactggtgggttttgaggctggtatctccnaggatgnncagacccgtgaaacatgctctcctttgcgtcacccttgnagtgaagcagatgatttgctgctgcaaacagatggatgcaacactcccaatactccnagcacgtnaatgaagaatttgtgaaggagtctcatctacttcanggaaagttgggtacacccc

SEQ ID NO: 17301 - DNA, 678 bp, Zea mays
  misc_feature: Ceres CLONE 1382140-F
  misc_feature: Encodes the peptide sequence at SEQ ID NO. 17302
  misc_feature (395)..(395): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaatctccagcagcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggaggcagaggagaaaggnctgattactccaggcgtgagtgttctgattgaaccaactagcggcaacacgggcattggactggcctttatggctgctgccaagggctacaaacttacactcacaatgcctgcctccatgagcatggagaggaggatcatattgaaggcttttggtgctgaacttgtccttactgacccactcctgggaatgaaaggagctgtcaagaaagcggaagaatacnagcaaagacacccaactcttacatcccttcgcaatttgaaaatccagctaacccagagaa

SEQ ID NO: 17302 - protein, 158 aa, Zea mays
  misc_feature: Ceres CLONE 1382140-F
  misc_feature (12)..(158): Pfam Name: PALP Pfam Description: Pyridoxal-phosphate dependent enzyme
  misc_feature: SWISSPROT Homolog: EC 2.5.1.47 Cysteine synthase
  misc_feature (139)..(139): Xaa is any aa, unknown, or other
MGEASPSIAKDVTELIGNTPLVYLNKVTEGCVGRVAAKLESMEPCSSVKDRIGYSMITEAEEKGLITPGVSVLIEPTSGNTGIGLAFMAAAKGYKLTLTMPASMSMERRIILKAFGAELVLTDPLLGMKGAVKKAEEYXQRHPTLTSLRNLKIQLTQR

SEQ ID NO: 17303 - DNA, 718 bp, Zea mays
  misc_feature: Ceres CLONE 1382149-F
  misc_feature: Encodes the peptide sequence at SEQ ID NO. 17304
  misc_feature (21)..(21): n is a, c, t, g, unknown, or other
  misc_feature (22)..(22): n is a, c, t, g, unknown, or other
  misc_feature (28)..(28): n is a, c, t, g, unknown, or other
  misc_feature (268)..(268): n is a, c, t, g, unknown, or other
  misc_feature (331)..(331): n is a, c, t, g, unknown, or other
  misc_feature (342)..(342): n is a, c, t, g, unknown, or other
  misc_feature (343)..(343): n is a, c, t, g, unknown, or other
  misc_feature (360)..(360): n is a, c, t, g, unknown, or other
  misc_feature (361)..(361): n is a, c, t, g, unknown, or other
  misc_feature (372)..(372): n is a, c, t, g, unknown, or other
cctttccccacccggccgggnntggggncggccgctctagaactagtggatcccccgggctgcaggaattcgcacgagaccattacctagaacatcctaatcgaaaactccaccagtccaccatcgccacctacgcccaaccaaacccaactccatctcttccgactataaacgcaacccaccaccgctgccgcgaacctctgcgctccgaataccccagacccccgatcctcccaatggccaccgcattttcgctgcgcgctgcggncccggccaccgctcccccgcgcgtctcccgatccacctccgcggcgagggtcgtgcccgtggncctcgcactgnncggacgcgaaaggctgnntgcgcgtgcancagttacgggcaaggcggatgtaccatcgagcacgttcgacgcccatgaggtcttgctgtttgaagctcctccgggaggcctgatggagaaaatggaattaaatccaacggtgggggtatttggtgaaaaaagttggccattacggggggtctttaaaaagggacaaaaggttgggttgaaacgtttggaacacctttcagttcgggaaccccctttggggaaaaacctttttagggggtgggagttgggggcggaaaaaaaaggggttggccccccccttaaaaaaaaaaaaaagggaaatccccgctctttttaaaaaaaaaaaaaaaaaaaaggggggggggt

SEQ ID NO: 17304 - protein, 150 aa, Zea mays
  misc_feature: Ceres CLONE 1382149-F
  misc_feature: SWISSPROT Homolog: EC 1.2.4.1 Pyruvate dehydrogenase (acetyl-transferring)
  misc_feature (11)..(11): Xaa is any aa, unknown, or other
  misc_feature (32)..(32): Xaa is any aa, unknown, or other
  misc_feature (36)..(36): Xaa is any aa, unknown, or other
  misc_feature (42)..(42): Xaa is any aa, unknown, or other
  misc_feature (46)..(46): Xaa is any aa, unknown, or other
MATAFSLRAAXPATAPPRVSRSTSAARVVPVXLALXGRERLXARAXVTGKADVPSSTFDAHEVLLFEAPPGGLMEKMELNPTVGVFGEKSWPLRGVFKKGQKVGLKRLEHLSVREPPLGKNLFRGWELGAEKKGVGPPLKKKKKGNPRSF

SEQ ID NO: 17305 - DNA, 648 bp, Zea mays
  misc_feature: Ceres CLONE 1382162-F
  misc_feature: Encodes the peptide sequence at SEQ ID NO. 17306
  misc_feature (487)..(487): n is a, c, t, g, unknown, or other
aaagctggagctccccgcggtggcggccgctctagaactagtggatcccccgggctgcaggaattcgcacgagaccatacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgcccgcacgagggccagccgtgggagaccccagagtgcatgaggcggtgccgccgccggggactgggcgtcgactggagcaagagtacggtcgcggcagcgagagcgcgggcagtggccggaagagtgccagc

SEQ ID NO: 17306 - protein, 145 aa, Zea mays
  misc_feature: Ceres CLONE 1382162-F
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRPHEGQPWETPECMRRCRRRGLGVDWSKSTVAAARARAVAGRVP

SEQ ID NO: 17307 - DNA, 681 bp, Zea mays
  misc_feature: Ceres CLONE 1382166-F
  misc_feature (437)..(437): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaccctcatcatgtacatcatcgtcatcggcttcgcgagctggaacctgaaccacttcatncacgggcagacaactaccccggggtggccggcaacggcgcgacgttctactttctggtgttcgccatcctggccggcgtggggggcgcggcgtccaagctggcgggcgtgcaccacgtgcgcggctggcgcacgacaggctgcccaccaacgccgcgtcgtcgctcatcggctgggcatcagggggctcgcctttggggtggcctggaaagaaatcccacatcggggaaccccggggtgtgggc

SEQ ID NO: 17308 - DNA, 896 bp, Zea mays
  misc_feature: Ceres CLONE 1382169-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (29)..(29): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (896)..(896): n is a, c, t, g, unknown, or other
nnnccccccccccccccccccccccccanatgagtatnntttgggnnngggacagaactggagctccccgcggtggcggccgctctagaactagtggatcccccgggctgcaggaattcgcacgagaccattacctagaacatcctaatcgaaaaaactactccgtcactttggttgcaaaggtcctcctcgattcatcgatcactgcaccgggcggcggtaccgcgctcgcaggggctaggcaacgagacggcagcaatggcggatcgggaccgcagagggatttaggggggggcccccgccccctaggggaagcctcccccccctggacggaggccggcgcccccatgggttgagcaaggtggagcgcttggttccaccaactagggggccgaccggggttcgcatgccgctttacggggggttgactccttgttccccgatgggggcggggcacgcccggcctgggggccttctcccggcctcggcgggccttcactggccctccgcctgggggggggggagttgggcgccccggggaccaccagaccgcgcgttcgtcccctggacaaccttttcagcgagccgccggcgggggggggggggccccacgcccgcccggcgctggccttcttaactacgccacccgacgccccaccaagaggagggtggtacctccacaccatccggggggggcggcgttatgggggcttcgcgggcggggccccggggcggccgctgggtaacggtgaggggcgccccgaacaacgggggtgtgggtccggcggtttttctcaagcactcacaccccgtcgtgtgacggactgcaagggggggcccacccccgctctggctgtctcggaggggcccgttcggcggctcgggtggtgtgatan

SEQ ID NO: 17309 - DNA, 612 bp, Zea mays
  misc_feature: Ceres CLONE 1382170-F
  misc_feature: Encodes the peptide sequence at SEQ ID NO. 17310
aaagctggagctccccgcggtggcggccgctctagaactagtggatcccccgggctgcaggaattcgcacgagaccattacctagaacatcctaatcgaaaaaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcagatctgattgctggattcggcatcttacgggcttgaatagagctacggactggagaaaacaacaaacccgcgtttggatctgtatcggttagtcttgccttcagggtcatggtgttttgtttcggaggaaagcatcgcatgttctggtttctggtccagatctggagaaatttcttagtcgtcgtcgtcgtcgtcgtttcgttccggaggggattctaggccaccatggctgggaggcgcgggaatctcttgggctggaacccggtttcccctccaggggaggaggcccctggcctgaaaattaatgggaccaatttccataattttttaggaaatttttggg

SEQ ID NO: 17310 - protein, 35 aa, Zea mays
  misc_feature: Ceres CLONE 1382170-F
MLCRLRSDCWIRHLTGLNRATDWRKQQTRVWICIG

SEQ ID NO: 17311 - DNA, 711 bp, Zea mays
  misc_feature: Ceres CLONE 1382172-F
  misc_feature: Encodes the peptide sequence at SEQ ID NO. 17312
  misc_feature (404)..(404): n is a, c, t, g, unknown, or other
  misc_feature (429)..(429): n is a, c, t, g, unknown, or other
  misc_feature (507)..(507): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggaccctgcggtggtgcaagcaggcgtgcgagtggcagtacggagagacaccccggcgaagagggaatgcnagagcgagtggcgcgagcggcacancaaagctgacccgggcgaggacggcaaacggggcttggacccctacttctccggctcccgaaagggggagtggccggncccagtgctggcccccccccaagggcccgcccgggggaaaacccaggaagtgatgggggggggcgccccccccgggggaattgggcccccaaattggagaaaaaagatacacgccccggaaaaaaaaaggccggggaaaaggcgccgggaaagggggcaaacgcgcccccccccccggggaaatgtggtggaaaaaaccgctcc

SEQ ID NO: 17312 - protein, 165 aa, Zea mays
  misc_feature: Ceres CLONE 1382172-F
  misc_feature (64)..(64): Xaa is any aa, unknown, or other
  misc_feature (72)..(72): Xaa is any aa, unknown, or other
  misc_feature (98)..(98): Xaa is any aa, unknown, or other
MGKGSVGASWWAFLLLAGVLLVVAATAGAEDGVVERDRKEDPAVVQAGVRVAVRRDTPAKRECXSEWRERHXKADPGEDGKRGLDPYFSGSRKGEWPXPVLAPPQGPARGKTQEVMGGGAPPGGIGPPNWRKKIHAPEKKRPGKRRRERGQTRPPPRGNVVEKTA

SEQ ID NO: 17313 - DNA, 653 bp, Zea mays
  misc_feature: Ceres CLONE 1382176-F
  misc_feature: Encodes the peptide sequence at SEQ ID NO. 17314
agagctggagctccccgcggtggcggccgcacttacactactggatcccccgggctgcaggtattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaggctgtgcgcgagaacctagctgccagagaattgctataccaacaccagcataacaaaaggatgagctgccctgccatggcacagctcctctcccataccctgtactacaagcgcttcttcccatattacgccttcaatgtgctcggtgggcttgacagcgaggggaaagggtgtgttttcacctatgatgcagtaggttcctaccaagagaactggttatagtggtcagggaactggatctactttgattatcccggccctggacaatcatttaaattcc

SEQ ID NO: 17314 - protein, 139 aa, Zea mays
  misc_feature: Ceres CLONE 1382176-F
  misc_feature (10)..(139): Pfam Name: Proteasome Pfam Description: Proteasome A-type and B-type
  misc_feature: SWISSPROT Homolog: EC 3.4.25.1 Proteasome endopeptidase complex
MSRRGDWVYENNGGTCVAIAGADYCVVAADTRLSVGYSILTRDHSKICDLADKCVLASSGFQGDIKAVRENLAARELLYQHQHNKRMSCPAMAQLLSHTLYYKRFFPYYAFNVLGGLDSEGKGCVFTYDAVGSYQENWL

SEQ ID NO: 17315 - DNA, 675 bp, Zea mays
  misc_feature: Ceres CLONE 1382179-F
  misc_feature: Encodes the peptide sequence at SEQ ID NO. 17316
  misc_feature (483)..(483): n is a, c, t, g, unknown, or other
  misc_feature (571)..(571): n is a, c, t, g, unknown, or other
  misc_feature (578)..(578): n is a, c, t, g, unknown, or other
  misc_feature (600)..(600): n is a, c, t, g, unknown, or other
aaagctggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtttcaacaatcgccagccctatctttggtgcagtcattggtacaaacccatcaggcacaacagctgcagcaactcgtgctacctctgatcaccnagtagctctggaaaactttctccctactctcagaaacaacaatttcttccattcaacaactggctaccctgaaacctgctgcttattngcagcancaactattaccatttagccggntaggtactgcctactctcaggaaaaacaattctttcaattaaaccaatgggccgactgaaccccgtttggtaatt

SEQ ID NO: 17316 - protein, 104 aa, Zea mays
  misc_feature: Ceres CLONE 1382179-F
MATKIFSLLMLLALSTCVANATIFPQCSQAPIASLLPPYLPSIIASICENPALQPYRLQQAIAASNIPLSPLLFQQSPALSLVQSLVQTHQAQQLQQLVLPLIT

SEQ ID NO: 17317 - DNA, 654 bp, Zea mays
  misc_feature: Ceres CLONE 1382180-F
  misc_feature: Encodes the peptide sequence at SEQ ID NO. 17318
  misc_feature (441)..(441): n is a, c, t, g, unknown, or other
aaagctggagctccccgcggtggcggccgctctagaactagtggatcccccgggctgcaggaattcgcacgagaccattacctagaacatcctaatcgaaaagacgctcgacgcctctcctcctctcctcccccacccgtccatcgcccctccctccggtctgcgctcccacagcctcacccctgcgaccccgccgattcgcatcgccctttgttggaaggaacgatggagcagaccttcatcatgatcaagcccgacggcgtccagcggggtctgatcggggacatcatcagtcgcttcgagaagaaagggttctacctcaaggggatgaagttcatgaacgtggagagatccttcgcgcagcagcactacgctgacctttccgacaagcctttcttccccgggttggtggagtacatcatttccgggcccgtgatgccnatggtgtgctagcgcaacgacgtcatgttgactggccgtaggatcattggcgccaccacgccttggaagggagcccccgataccattcgggaggactacgccggtgcaagtcgggaagatgaccatcccctttctttgtactcgatcagctgggcttttgctgcgaaatgtttaaagttgcacacttttatagccatgctctactgttggacc

SEQ ID NO: 17318 - protein, 75 aa, Zea mays
  misc_feature: Ceres CLONE 1382180-F
  misc_feature (2)..(74): Pfam Name: NDK Pfam Description: Nucleoside diphosphate kinase
  misc_feature: SWISSPROT Homolog: EC 2.7.4.6 Nucleoside-diphosphate kinase
MEQTFIMIKPDGVQRGLIGDIISRFEKKGFYLKGMKFMNVERSFAQQHYADLSDKPFFPGLVEYIISGPVMPMVC

SEQ ID NO: 17319 - DNA, 687 bp, Zea mays
  misc_feature: Ceres CLONE 1382182-F
  misc_feature: Encodes the peptide sequence at SEQ ID NO. 17320
  misc_feature (471)..(471): n is a, c, t, g, unknown, or other
aaagctggagctccccgcggtggcggccgctctagaactagtggatcccccgggctgcaggaattcgcacgagaccattacctagaacatcctaatcgaaaaaacccagccgccgccgccgccaccgccaccgccaccgccacctgccccagcgcgccgccgccgcagccaccatgggtcgcgtccgcaccaagaccgtgaagaagacctccaggcaggtgatcgagaagtactactcccgcatgaccctcgacttccacaccaacaagaaggtgctggaggaggtctcgattctgccctcgaagcgcctccgcaacaaggtggctggcttcagtacccacctgatgcgccgcatccagcgcggcccagtccgcggcatctcgctcaagctgcaggaggaggagcgcgagcgccgcatggacttcgtgccggagaagtccgcgctcgaggtcgaagagatccgcgtcgacnaggagaccatggagatgctcgctgccctcggcatggccgacctgcccggcgttgagcgccaggctgaggtctccaacgcccccgcctacggccgcccgcagtacggtggtcccccgccgtgaccgcgttaaaacttcgcggtgggttgcctcttgatcgcactgctatttcggaagtgttggcctactatgctaaacttcttttaaatcgtttggg

SEQ ID NO: 17320 - protein, 139 aa, Zea mays
  misc_feature: Ceres CLONE 1382182-F
  misc_feature (1)..(122): Pfam Name: Ribosomal_S17e Pfam Description: Ribosomal S17
  misc_feature (100)..(100): Xaa is any aa, unknown, or other
MGRVRTKTVKKTSRQVIEKYYSRMTLDFHTNKKVLEEVSILPSKRLRNKVAGFSTHLMRRIQRGPVRGISLKLQEEERERRMDFVPEKSALEVEEIRVDXETMEMLAALGMADLPGVERQAEVSNAPAYGRPQYGGPPP

SEQ ID NO: 17321 - DNA, 688 bp, Zea mays
  misc_feature: Ceres CLONE 1382186-F
  misc_feature: Encodes the peptide sequence at SEQ ID NO. 17322
  misc_feature (688)..(688): n is a, c, t, g, unknown, or other
aaagctggagctccccgcggtggcggccgctctagaactagtggatcccccgggctgcaggaattcgcacgagaccattacctagaacatcctaatcgaaaacttccgaaatctcgtgcggcggccggtaagttcgtacttcgcagtgtattcaccactcagcttcactcccaactaccgctgatctcactcacggtcaccccaggcggccagtcccgtccccatgcgggtagaggttcacatcacctgcgcgacgatcaacatccgcttccaaaacgtagtcgagcccgtgcccaaaaccctagcgaccgccggagagatcgtccgaatcgaggacaccgaggggaaattatatcgagctggacgatggagagccctgcgaaagaggaggacgacggagagctgctaatggagatcgagtcgtctttcacggcggaggactggcgccgcgcgctttctcgcgtcgtgccgtccgtcgtcgtcctccgcaccactgcgccgcgcgcctttgacaccgaggtcgcgggagccagctacgccacgggttttcgtagttgactagtcgcgcggaataatgctcactaaccgtcatgacgactagccaggacctgtggtcgcgcagggcatgatcgagaacaggaatagatccctgagtacccctgcacagagatcgtggacatgatgttan

SEQ ID NO: 17322 - protein, 63 aa, Zea mays
  misc_feature: Ceres CLONE 1382186-F
MESPAKEEDDGELLMEIESSFTAEDWRRALSRVVPSVVVLRTTAPRAFDTEVAGASYATGFRS

SEQ ID NO: 17323 - DNA, 663 bp, Zea mays
  misc_feature: Ceres CLONE 1382192-F
  misc_feature: Encodes the peptide sequence at SEQ ID NO. 17324
  misc_feature (385)..(385): n is a, c, t, g, unknown, or other
  misc_feature (402)..(402): n is a, c, t, g, unknown, or other
  misc_feature (403)..(403): n is a, c, t, g, unknown, or other
  misc_feature (441)..(441): n is a, c, t, g, unknown, or other
  misc_feature (447)..(447): n is a, c, t, g, unknown, or other
aaagctggagctccccgcggtggcggccgctctagaactagtggatcccccgggctgcaggaattcgcacgagaccattacctagaacatcctaatcgaaaaatcacccataatattttgagcattcagaaacacaccaagcgaagcgcactagcaacgacctaacaacaatggctaccaagatattagccctccttgcgcgtcttgccctttttgtgagcgcaacaaatgcgttcattattccacaatgctcacttgctcctagtgccattattccacagttcctcccaccagttacttcaatgggcttcgaacacctagctgtgcaagccaacatgcaacaacaagcgcttgcggcgagcgtcttacaacaaccaattgcccnaattgcacaacaatccnnttgcacatctaaacatacaagcccatcacaaacggcancaaggnaaaaaacagggttttcctaaccccagatgtgtggggggcccccccccccccccctggggggggggacacccccccccgcccccccccccctttttttttattaaaaaaaaaaaattatagttttgttttttttttttaaccacccccccacccaccccctttttttttttttttggtggggaggaggaaaaaaaaaataatggtgtggggccaccc

SEQ ID NO: 17324 - protein, 98 aa, Zea mays
  misc_feature: Ceres CLONE 1382192-F
  misc_feature (72)..(72): Xaa is any aa, unknown, or other
  misc_feature (78)..(78): Xaa is any aa, unknown, or other
  misc_feature (91)..(91): Xaa is any aa, unknown, or other
  misc_feature (93)..(93): Xaa is any aa, unknown, or other
MATKILALLARLALFVSATNAFIIPQCSLAPSAIIPQFLPPVTSMGFEHLAVQANMQQQALAASVLQQPIAXIAQQSXCTSKHTSPSQTAXRXKTGFS

SEQ ID NO: 17325 - DNA, 685 bp, Zea mays
  misc_feature: Ceres CLONE 1382196-F
  misc_feature: Encodes the peptide sequence at SEQ ID NO. 17326
  misc_feature (334)..(334): n is a, c, t, g, unknown, or other
  misc_feature (437)..(437): n is a, c, t, g, unknown, or other
  misc_feature (472)..(472): n is a, c, t, g, unknown, or other
aagctggagctccccgcggtggcggccgctctagaactagtggatcccccgggctgcaggaattcgcacgagaccattacctagaacatcctaatcgaaaatagcccagcaccgcagaggcgcagagacaggcgtcttcgtactcgcctatctccgcgactcagagcttcttccatttcctaccgccgccgctgcagctccaccccattccgtcgacaccatgagggagtgcatctcgatccacatcggccaagccggtatccaggtcggaaacgcgtgctgggagctctactgcctcgagcatggcattcaggccgatggtcagatgcccggntgacagaccattgggggtggtgatgatgcttttcacaccttctcagtgagactggtgctgggaagcacgtcccctcgtgctggttttgttgaccttgaaccanctgtcatcgatgaggtgaggactgggacctaccgncagttctttccacctggagaggttattcggggccaggggggatgcagccaaaaatttcccccggggggccctaccccattggaaagggaattggtgaccttgggccctgaacccaataaggaattttggccaaaatgggccggggtccccaggggtttccccgcttttaaacgttttgggggaagaaaaagggtcctgtgctcttggtccccc

SEQ ID NO: 17326 - protein, 38 aa, Zea mays
  misc_feature: Ceres CLONE 1382196-F
MRECISIHIGQAGIQVGNACWELYCLEHGIQADGQMPG

SEQ ID NO: 17327 - DNA, 682 bp, Zea mays
  misc_feature: Ceres CLONE 1382198-F
  misc_feature (647)..(647): n is a, c, t, g, unknown, or other
aaagctggagctccccgcggtggcggccgctctagaactagtggatcccccgggctgcaggaattcgcacgagaccattacctagaacatcctaatcgaaaattttccataactgcaaaaatctccccggacagagaagcgttcgcctgactcgcccccactcccgagtggccgaagccccgaccggcgaccccgcagatctgtcccattgttctccgtcctccccggcgtgtcctccttgatccttcttcgagtggcaagtgctgacctcgcctcctattcctccggtagccctactggagcgccgggcgcacagatctgcccacccctggacgctaggcgctgcccagctcttccctgccagccggtcgcggcggctgccagccagcacggcagggctgctgttgcctgctcttgtcctccggcacagcgcagggtgtcggagtcgctcccagctggccatcctctcggcccccttggtgcacagcgagtcagtcggatacatcttttatcagatttggtgaatccccctcccctctcacggtccaccactgatcatggggctactcagcattatcccgcagatcaagcgcaaggagtaggagatgcgcatcctcatgtttggcctggacaactcagggaagacnaccatcgttctcaggagtcatggggaggacacagc

SEQ ID NO: 17328 - DNA, 673 bp, Zea mays
  misc_feature: Ceres CLONE 1382199-F
  misc_feature: Encodes the peptide sequence at SEQ ID NO. 17329
  misc_feature (540)..(540): n is a, c, t, g, unknown, or other
aaagctggagctccccgcggtggcggccgctctagaactagtggatcccccgggctgcaggaattcgcacgagaccattacctagaacatcctaatcgaaaaatcccaaatctcaacccaagaacaaaaatggccaccgccaccactgaagccgaagtccgtgagtccctcggcacgaagttcggtcgcctcaaggaacaggcgaaagacatggcctccaggcaccccgtcgctggagccgcggccgtcatcgctgtcagcgccgtgggcgcctacttcttgtggcccgtggcggccccggccgtggccatgatgaaggcgcctggatccggcggagtgctcgtctcccgcgcggcgtttctcgcgaataaggagctgtacttcaagctcttgcgcaccgggagcgttgcggagccgctcgccgctttggcgtagctgcgcatgcagtagtggtacatgctgttcgtgaacgagcggctgaccggacgtttcaggttgtatgttgaccaagaggttattagtactttccttgtcgatggngttgagtctcgactctcgagtttgtattatctgtcaaagacctatgtatgcgagcatgatcagtttgatgaataatggcactctttctagaacataagaagttatagtccagataaacatccaaaaaaaaaaa

SEQ ID NO: 17329 - protein, 101 aa, Zea mays
  misc_feature: Ceres CLONE 1382199-F
MATATTEAEVRESLGTKFGRLKEQAKDMASRHPVAGAAAVIAVSAVGAYFLWPVAAPAVAMMKAPGSGGVLVSRAAFLANKELYFKLLRTGSVAEPLAALA

SEQ ID NO: 17330 - DNA, 663 bp, Zea mays
  misc_feature: Ceres CLONE 1382201-F
  misc_feature: Encodes the peptide sequence at SEQ ID NO. 17331
  misc_feature (359)..(359): n is a, c, t, g, unknown, or other
  misc_feature (360)..(360): n is a, c, t, g, unknown, or other
  misc_feature (479)..(479): n is a, c, t, g, unknown, or other
  misc_feature (488)..(488): n is a, c, t, g, unknown, or other
aagctggagctccccgcggtggcggccgctctagaactagtggatcccccgggctgcaggaattcgcacgagaccattacctagaacatcctaatcgaaaaaagcattcaagcatcgacagtcgacgctgcagcaggaagccaaagaggagagaatccatcgagtcgaccatccgagcacggcttagggcggcggggctcgccgtgcccacagctcaggaatccaatcccccactcctcaccggcgcccgcggttttataaatagattccctcgtcactgtcgcggtcgcggcttgatcggattcaactcagctaccccaccccctcgattccttcccagctctggctacttcgtacgnncacacagcacgctccgggctcgggtcatcgagcaagctgccatgggctgccgcgcgctgaaggagaaactcaacggtctcctctcctccatgtcgccctcgggcctggtggacgagcantttcagcanctgcaaaggttgcaggaaaaagggggaaccccgggtttcttccccaaggtggccccctttttggggggaagccgaggggatatttcccagttccccctttgtttacccaacactgggggatttgaaagggggagcccaggggccccctcaaggggaagcccgggggggggctaaa

SEQ ID NO: 17331 - protein, 86 aa, Zea mays
  misc_feature: Ceres CLONE 1382201-F
  misc_feature (26)..(26): Xaa is any aa, unknown, or other
  misc_feature (29)..(29): Xaa is any aa, unknown, or other
MGCRALKEKLNGLLSSMSPSGLVDEXFQXLQRLQEKGGTPGFFPKVAPFLGGSRGDISQFPLCLPNTGGFERGSPGAPSRGSPGGG

SEQ ID NO: 17332 - DNA, 754 bp, Zea mays
  misc_feature: Ceres CLONE 1382203-F
  misc_feature (192)..(192): n is a, c, t, g, unknown, or other
  misc_feature (206)..(206): n is a, c, t, g, unknown, or other
  misc_feature (218)..(218): n is a, c, t, g, unknown, or other
  misc_feature (241)..(241): n is a, c, t, g, unknown, or other
  misc_feature (285)..(285): n is a, c, t, g, unknown, or other
  misc_feature (322)..(322): n is a, c, t, g, unknown, or other
  misc_feature (331)..(331): n is a, c, t, g, unknown, or other
  misc_feature (340)..(340): n is a, c, t, g, unknown, or other
  misc_feature (354)..(354): n is a, c, t, g, unknown, or other
  misc_feature (366)..(366): n is a, c, t, g, unknown, or other
  misc_feature (367)..(367): n is a, c, t, g, unknown, or other
  misc_feature (396)..(396): n is a, c, t, g, unknown, or other
  misc_feature (397)..(397): n is a, c, t, g, unknown, or other
  misc_feature (458)..(458): n is a, c, t, g, unknown, or other
  misc_feature (468)..(468): n is a, c, t, g, unknown, or other
  misc_feature (489)..(489): n is a, c, t, g, unknown, or other
  misc_feature (496)..(496): n is a, c, t, g, unknown, or other
  misc_feature (497)..(497): n is a, c, t, g, unknown, or other
  misc_feature (512)..(512): n is a, c, t, g, unknown, or other
  misc_feature (513)..(513): n is a, c, t, g, unknown, or other
  misc_feature (546)..(546): n is a, c, t, g, unknown, or other
  misc_feature (554)..(554): n is a, c, t, g, unknown, or other
  misc_feature (570)..(570): n is a, c, t, g, unknown, or other
  misc_feature (571)..(571): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (746)..(746): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (752)..(752): n is a, c, t, g, unknown, or other
  misc_feature (753)..(753): n is a, c, t, g, unknown, or other
  misc_feature (754)..(754): n is a, c, t, g, unknown, or other
aagctggagctccccgcggtggcggccgctctagaactagtggatcccccgggctgcaggaattcgcacgagaccattacctagaacatcctaatcgaaaagagaactccatttcgatctcatttgaaatcaacccatcctcgtttcctccgtctagcagcctctcaccctcatggccaagatcaagatcgnggatcaatgggttntggcaggatcgngaaggctgggtggccagggtggnccctgcagaagcgacgacgtcgagctttcgtcgccgtgaacganccccttcatcagcagccgattacagtgacctacatgnttcaagtantgacactgntgcacgggacagtnggaagcaccatnngaggtcaaggtgaaggactccaagacccnnttctctttggtgagaaaaggagggttgctgtgtttgggctgcaggaaacccctgaggagantcccatgggnggttcggttgggcgctgaaantatgttnngttgagtctactggnntgttttcactgggaccaggagaagggctgcagnctcacttngaaagggtgggtgccnnaggagagggtggtcatttctacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17333 - DNA, 680 bp, Zea mays
  misc_feature: Ceres CLONE 1382207-F
  misc_feature: Encodes the peptide sequence at SEQ ID NO. 17334
gctctggaactagtggatcccccgggctgcaggaattcgcacgagaccattacctagaacatcctaatcgaaaaaattcgtctcgttttctcccttcccctgcgggctggagagcggcggcgaacgagacaaggtcaccggtgacgctcctcacctactccctgccgcctttcgctttccggcccggcctgccgcaagctcgcgcgccgcctacatcgacccctccccgcgccgcaggccgcctcccacagacgcggggcaggcacgtcgcccgggtcggagggattcggttcgggccgtcgtggtcccctccgcactcttctattggcctggaaaacacccgagatccagcagcgatttggattggcttctcctttttcttggatatacttggcctcctccggggtggctagggaatccagctttccaaggggggatccgacagggtttattttgggtcctgagaaggggtgatgaggactcatcccaacttcacctttttggaggggttaggtttgcaaaaagaggaccggcaacccggattctcctaaaagcctttcctaatggaaagaatgaaccgctcggggaatgtctccggttaaaaaggggcagaatccttccaaaaaataaggggggtggaaaaactggttgactcgaaaaaaaagaaaagggccggggaa

SEQ ID NO: 17334 - protein, 136 aa, Zea mays
  misc_feature: Ceres CLONE 1382207-F
SGTSGSPGLQEFARDHYLEHPNRKNSSRFLPSPAGWRAAANETRSPVTLLTYSLPPFAFRPGLPQARAPPTSTPPRAAGRLPQTRGRHVARVGGIRFGPSWSPPHSSIGLENTRDPAAIWIGFSFFLDILGLLRGG

SEQ ID NO: 17335 - DNA, 635 bp, Zea mays
  misc_feature: Ceres CLONE 1382208-F
  misc_feature: Encodes the peptide sequence at SEQ ID NO. 17336
  misc_feature (402)..(402): n is a, c, t, g, unknown, or other
  misc_feature (464)..(464): n is a, c, t, g, unknown, or other
  misc_feature (604)..(604): n is a, c, t, g, unknown, or other
aagctggagctccccgcggtggcggccgctctagaactagtggatcccccgggctgcaggaattcgcacgagaccattacctagaacatcctaatcgaaaactccgtctccgtccgcccggcgtaaagaaaagcctccctcaccacagccgccacgccatggccgaggagaccgactccaggcctgcctccgcgggctcccgaggccgccccgtgcccgaggacgacgacggggaggagggcgagatcaccgacatcgcctgcgctccttccccgcccgccacgcacccgctcgagcactcctggaccttctggttcgacaacccgcagagcaagtccaagcaggccgcctgggggagctccatccgccccatacacaccttctccaccgtcgaggaattcntgggggctttacaataacattaatcaccctagcaaattgatcgggggagctgatttccattngctcaagaacagatcgagccaaaatgggaagaccctatttgtgcggatggtggtaatggaccatcagctgtggaagaggaaatctgatacttttggctgcacactctgctggctatgaatggggacaattcgaccatggngatgaattttggggcccaattgccagtgggg

SEQ ID NO: 17336 - protein, 86 aa, Zea mays
  misc_feature: Ceres CLONE 1382208-F
  misc_feature (82)..(82): Xaa is any aa, unknown, or other
MAEETDSRPASAGSRGRPVPEDDDGEEGEITDIACAPSPPATHPLEHSWTFWFDNPQSKSKQAAWGSSIRPIHTFSTVEEFXGALQ

SEQ ID NO: 17337 - DNA, 691 bp, Zea mays
  misc_feature: Ceres CLONE 1382209-F
  misc_feature: Encodes the peptide sequence at SEQ ID NO. 17338
  misc_feature (366)..(366): n is a, c, t, g, unknown, or other
  misc_feature (397)..(397): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaatttttttccccgctctgctctgcacgcccctctcctccctagtccctccccctacccccgcccgtcaaagcgagagcgccgtatcacctgtctctccgtccaccgccgtctcgatccgcgcccaaagatacctttcccccaccccttcctcgcgccgccgttttggtgcgaccatgacggcggagggggaggccaagaacccgtcggccggtggcggaggggataacccccagcaccagcaggctgcgccggcgccggcgccgncacaggggggaagtggcgcaggaggctgcantgcaggggacgggacaagagcaggagccggacaaggtggatcgagagtgcaggggcggcgcgggggaaaaaggacgacggcgcgtgcagagatctggtcctggtcgaggatccgggaggtctccgccgtccaagatcccggagaagctgcaacacccgcagcactccaggaagaaatgaaagcgctggtggcatcgatcccctgatggggctggaacaaaatttcccagccatgcagctttaggagctagagcagcacttccggggtgtaccagaaactgggtggcccgagaan

SEQ ID NO: 17338 - protein, 108 aa, Zea mays
  misc_feature: Ceres CLONE 1382209-F
  misc_feature (31)..(31): Xaa is any aa, unknown, or other
  misc_feature (41)..(41): Xaa is any aa, unknown, or other
MTAEGEAKNPSAGGGGDNPQHQQAAPAPAPXQGGSGAGGCXAGDGTRAGAGQGGSRVQGRRGGKRTTARAEIWSWSRIREVSAVQDPGEAATPAALQEEMKALVASIP

SEQ ID NO: 17339 - DNA, 830 bp, Zea mays
  misc_feature: Ceres CLONE 1382210-F
  misc_feature (1)..(1): n is a, c, t, g, unknown, or other
  misc_feature (15)..(15): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (52)..(52): n is a, c, t, g, unknown, or other
  misc_feature (54)..(54): n is a, c, t, g, unknown, or other
ntttttccccccccnccnnnnccccccccccccacgaaaannnntttaaatntnttcatagctggagctccaccgcggtggcggccgctctagaactagtggatcccccgggctgcaggaattcgcacgagaccattacctagaacatcctaatcgaaaaactcggcacgcaggtggaggcggcacagcagcagccggctccatccatcctctttcccctcctcgtttcgcttcctcgggggattcctcgtccctcggacgtcccccgtcccctttttcgggcgcgagctcgcccgagatgggaaccgcaagatcgggtgtccgttggaatgaccaggggatgctctaggtccggcgaggttgaattggaagaggggtggcccgcttcctaaattgtcaaggagcgacgaaaaagtcccaagggaaatcccccccgggggggaggggggggggggtcgccccttatcgagggaaggagagggactttcaccaaagaggggcctccccccaaaaaaaggggcgggggccaaaaaccgcggaggggttattgaattttccgggcctttggggcacatgggggcgaaaggaggggccccagaagaaaggggggggatcctctctaaaaaaccccaaggggggccgcccagtcccctcccacccagaggtgagagaaacaagaagaaattttgtttatttccacaccctccaaagcccgagagaatttccccgaggggggggctccacgggggcgttttgcgggggggaaacgcggcggcgcgacacggggggcggagcgggagaaaggcgtcctgtggaggggggggaggggg

SEQ ID NO: 17340 - DNA, 682 bp, Zea mays
  misc_feature: Ceres CLONE 1382219-F
  misc_feature: Translation starting site: 172
  misc_feature: SWISSPROT Homolog: EC 2.7.11.7 [Myosin heavy-chain] kinase
  misc_feature (380)..(380): n is a, c, t, g, unknown, or other
aaagctggagctccccgcggtggcggccgctctagaactagtggatcccccgggctgcaggaattcgcacgagaccattacctagaacatcctaatcgaaaaaaccgcatcatcctttccctcgcgccgccgccaacgcaacccttgcagccccaatccctcacagcaaccatggctggcgcgcaggagtccctctctctggtgggcacgatgcgcggccacaacggcgaggtgacggcgatcgcgaccccgatcgacaactcgccgttcatcgtctcctcctcccgcgacaagtccctgctggtgtgggacctgaccaacccggtccactccaccccggaatccggcgccaccgccgactacggcgtccccttcggccnctcaccgggcactcccacttcgtccaggacgtcgtcctcagttccgacggccagttcgccctttccggctcctgggatggagagctccgcctctgggacctctccaccgggctcaccaccccgccgcttcgtcgggcacggagaggatgtcctctccgttgcccttctccgttgacaaccggcagatcggtctccgcgtcccgcgacaagaccattaagctctgggaccaccctcggggagggaaagtacaccatcggaggggaacctccgggggcggcgaaggccaacaccgggtgggtcc

SEQ ID NO: 17341 - DNA, 662 bp, Zea mays
  misc_feature: Ceres CLONE 1382220-F
  misc_feature: Encodes the peptide sequence at SEQ ID NO. 17342
  misc_feature (327)..(327): n is a, c, t, g, unknown, or other
  misc_feature (386)..(386): n is a, c, t, g, unknown, or other
  misc_feature (421)..(421): n is a, c, t, g, unknown, or other
aaagctggagctccccgcggtggcggccgctctagaactagtggatcccccgggctgcaggaattcgcacgagaccattacctagaacatcctaatcgaaaagaccgatctgtccgatctctctcccgagtccactccaagccttttcgccttttcctccgccttctcgcgatggcgccgccgcgccgcgctctactcgtcctcgccgctctcctcctctccctctcccttggggccgcctccttccattccgacgagctcctcctcaacgatgacgaagagttcgaggggcgtcgtcgcccgcccctccgccccctcccccgcggnggccccggtggtctcctccctcccgcgcagatcagcgcacgcgccgttgcccgggtcangcgagtccactgatctgcggcaggaggaggccggncaggggtaccacaccatccgggcgcggctgtcaccgggcacggggttcgtggtgcccgcgggccacccgttcgtcgcggtggcgtcccgggacagcaacctccagatcgtgtgcttcgaggtcacggccgacagaaacgagaagtgttcctggcggcgccgacaagtgctgaaaagctcgaccgggtcgccaagggctgtcatccgctccagggggagggagggaccaggggctcgttccg

SEQ ID NO: 17342 - protein, 130 aa, Zea mays
  misc_feature: Ceres CLONE 1382220-F
  misc_feature (19)..(19): Xaa is any aa, unknown, or other
  misc_feature (39)..(39): Xaa is any aa, unknown, or other
MTKSSRGVVARPSAPSPAXAPVVSSLPRRSAHAPLPGSXESTDLRQEEAGQGYHTIRARLSPGTGFVVPAGHPFVAVASRDSNLQIVCFEVTADRNEKCSWRRRQVLKSSTGSPRAVIRSRGREGPGARS

SEQ ID NO: 17343 - DNA, 686 bp, Zea mays
  misc_feature: Ceres CLONE 1382222-F
  misc_feature: Encodes the peptide sequence at SEQ ID NO. 17344
  misc_feature (489)..(489): n is a, c, t, g, unknown, or other
  misc_feature (589)..(589): n is a, c, t, g, unknown, or other
  misc_feature (610)..(610): n is a, c, t, g, unknown, or other
aaagctggagctccccgcggtggcggccgctctagaactagtggatcccccgggctgcaggaattcgcacgagaccattacctagaacatcctaatcgaaaaatccgctgcctccgcctctcgagtctcgtccacccgtcatcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgancaggacaaggctgctgcacatctcaagggtggtgccaagaaggttgttatctctgccccaagcaaagacgcacccatgttttggtgttggtgtcaatganggacagtacacctcggatggntacattgtttccaatgctagctgcaccacaaactggctggctcccctttgctaggtcattcatggacacttcggca

SEQ ID NO: 17344 - protein, 138 aa, Zea mays
  misc_feature: Ceres CLONE 1382222-F
  misc_feature (4)..(135): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (106)..(106): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTXQDKAAAHLKGGAKKVVISAPSKDAPMFWCWCQ

SEQ ID NO: 17345 - DNA, 683 bp, Zea mays
  misc_feature: Ceres CLONE 1382225-F
  misc_feature: Translation starting site: 245
  misc_feature: SWISSPROT Homolog: EC 5.3.99.6 Allene-oxide cyclase
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
aaagctggagctccccgcggtggcggccgctctagaactagtggatcccccgggctgcaggaattcgcacgagaccattacctagaacatcctaatcgaaaaaaaatgcctagtaaataaacacaccactgaccaacttgcctgcttctagagttctagtgccgggccagccaccaacctcctcctcttccgcatcgcatcgagagcggggctgtaccgtgcgagactctactgctcgatcgccatggccgccgcgctcaggtgcccggcatccgtcagggtctcgggccccgcccgcgcgggctcgccaaggtgcgtcaggcgtccagagtcgtcgcggtgagcggggccccggagagcccannncgcgcctcgccgtggggcggtccttgtctccccaaagccggcggggcaaagaccccggccaaccaagtggcagagcttgacctgaaccaaatcaacgagggggaccgggaaagccccgggaccttgcccttagggccaaaaaaagggaacgcgttgggggaatttttccccctcccccaaaaaggttaaaaaacggaaccgggaaaaaggggttgggggtacccgggggattttggggtttttattcagagccccccccagcgaagggggacctgtaaagaggcttttaattttttttttaaaaaaaaccgccccct

SEQ ID NO: 17346 - DNA, 754 bp, Zea mays
  misc_feature: Ceres CLONE 1382226-F
  misc_feature: Encodes the peptide sequence at SEQ ID NO. 17347
  misc_feature (604)..(604): n is a, c, t, g, unknown, or other
  misc_feature (754)..(754): n is a, c, t, g, unknown, or other
aaagctggagctcaccgcggtggcggccgctctagaactagtggatcccccgggctgcaggaattcgcacgagaccattacctagaacatcctaatcgaaaatcacgcaatcgagaaaaacacaaaccgaaaaacctcctctacagtcccatctaggcgcccctcctcggctccgatccagtttcgccggcggccatgtcgcagccggcggcgacggtggccgcggcggcgcagccgcagggtcgcggccccgcggggcgcccaggcggcctggggcagagcatcgcaggcatcgtgcggatggcgttgttctggtactttgcgtccaagttcttcgggcccaagcgcccacccgcggaccccgggatgctcatgtccaacctcttccagaagggcgagccaatggatatggggatgtatttgtcagagaacgagaaagtcaacgattttgctaatgaggatgcacttattgggcacgaggcaaaaataccatatgcagtctggggacctaccagtactaaaacaccgggcattaacgaactatccggcaaaggctctcaggataaaggggtctttggaatgctcatggttaattccgcccggntcgggtttatcctggggaaccctaccgaatccaaaaatatgggcagaaattcttcgttttggaaggaccccatcctggtgggggggtattcttggcaaaaatcaaaaagttggagaaaaaagaaaaactttggctttgaaaaatacacan

SEQ ID NO: 17347 - protein, 186 aa, Zea mays
  misc_feature: Ceres CLONE 1382226-F
  misc_feature (137)..(137): Xaa is any aa, unknown, or other
MSQPAATVAAAAQPQGRGPAGRPGGLGQSIAGIVRMALFWYFASKFFGPKRPPADPGMLMSNLFQKGEPMDMGMYLSENEKVNDFANEDALIGHEAKIPYAVWGPTSTKTPGINELSGKGSQDKGVFGMLMVNSARXGFILGNPTESKNMGRNSSFWKDPILVGGYSWQKSKSWRKKKNFGFEKYT

SEQ ID NO: 17348 - DNA, 783 bp, Zea mays
  misc_feature: Ceres CLONE 1382228-F
  misc_feature: Encodes the peptide sequence at SEQ ID NO. 17349
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
nnnnnnnnccccnnnnnnnnncccccccaaagcaggagggnnntttcaaannnnccaaagctggggctccccgcggtgggggccgctctagaactagtggatcccccggggctgcgggaattcgcacgagaccattacctagaacatcctaatcgaaaagttcactagcttcggagtttctttcgaataattaaaacgaaaacaatgggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaaaaacgagttggatcccggagacgagctgcagccaggagtctggtctatttgagtggggaagtgaacaatcccaatccgtggaaaaaagacgagggtcctcaagaagatcggtggggggggatttccttgaacgggaacaaaacccggggggtttgaggcgcatcggagcggggaccaaaaggcccgagaatcccggaaaattaaatcccacccgggttcggaggtccaaaaaaagcctaaagcccgggtttcccccccggggggtttccttttccctctccaaagggggaaaaggggggacccctcgcggaaaacaatttggttggggggggggtttgggccccccgtgggtgtttcccccaaaggggaaccgccgggccggttaaaaa

SEQ ID NO: 17349 - protein, 81 aa, Zea mays
  misc_feature: Ceres CLONE 1382228-F
MSTLTRRPLFSPGEFAVSRADFRVRVIDAEKRVGSRRRAAARSLVYLSGEVNNPNPWKKDEGPQEDRWGGISLNGNKTRGV

SEQ ID NO: 17350 - DNA, 812 bp, Zea mays
  misc_feature: Ceres CLONE 1382230-F
  misc_feature: Encodes the peptide sequence at SEQ ID NO. 17351
aagctggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagccaagcgcgcacctcggtgacctagctagttcaggcgacgatatggcgtcaggtcaggaaagcaggaaggagctggaccgcaaggcccgcgagggcgagaccgtcgtccccggcgggaccgggggcaagagcgtcgaggcccaggagcacctcgccgaaggggcgcacccgcggaggccagactcgcaggcagccaactgggggcagcaggggtaccagcgaagatgggggaaaaaagggcggtctgaagaaccacgggacaattcccggcggcgaagcgcgcccccccagggaagggcggtcagcaatccgacggagtcccaagtttccccaaggaagtcccttattcggggtggcggtgcggtacggcaggggtttggtaaaattgtcctggggaaagtggaacctttgcggccggtaacttaggggctaactccccctaattttggaagtaacttcgaattgataaaaaattggtaaccttagcaaccattggatgtgagaggcgatttctttactttacctgacggaacccagggtgaacgggggggggggaaccttgcgaaggctctcccaaaagggggtttccctacctttataacagttccccggctcccaagatccgcacaaaag

SEQ ID NO: 17351 - protein, 127 aa, Zea mays
  misc_feature: Ceres CLONE 1382230-F
  misc_feature (1)..(99): Pfam Name: LEA_5 Pfam Description: Small hydrophilic plant seed protein
MASGQESRKELDRKAREGETVVPGGTGGKSVEAQEHLAEGAHPRRPDSQAANWGQQGYQRRWGKKGRSEEPRDNSRRRSAPPQGRAVSNPTESQVSPRKSLIRGGGAVRQGFGKIVLGKVEPLRPVT

SEQ ID NO: 17352 - DNA, 771 bp, Zea mays
  misc_feature: Ceres CLONE 1382233-F
  misc_feature: Encodes the peptide sequence at SEQ ID NO. 17353
aagctggagctccccgcggtggcggccgctctataactagtggatcccccgggctgcaggaattcgcacgagaccattacctagaacatcctaatcgaaaaacaagcaccagaccaattagctagcttcttctagctctagctaggctcgtctgctgcaagaaggtaacagtaacagcaggcatggaggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggaatcgccgagttcgtcgccaccttcctcttcctctacatctccatccttcaccgtcatgggccgctccaagtccaccccccaagtgcgccaccgttcggaatccaggggaatcccctggtgccttcggcgggcatgatccttccccctcgtctaattgcaccgccggcattctccggggggtaaaatcaaccccggggggggaccttccgggttggtccctgggggggaaaattggcccccccaccaagggcggggggttttcaactcatcctggcaagggcctgggaggcccatctggcgggcgggggccggtcctccaagggggttcccaccaggggcttcgtatatggggaaaaacgggggggcgggggacacaacgtgtgccagggccccggtttaaccacagggggggacggggtct

SEQ ID NO: 17353 - protein, 116 aa, Zea mays
  misc_feature: Ceres CLONE 1382233-F
MEGKEEDVRLGANKFSERQPIGTAAQGTDDKDYKEPPPAPLFEPGELKSWSFYRAGIAEFVATFLFLYISILHRHGPLQVHPPSAPPFGIQGNPLVPSAGMILPPRLIAPPAFSGG

SEQ ID NO: 17354 - DNA, 679 bp, Zea mays
  misc_feature: Ceres CLONE 1382234-F
  misc_feature (206)..(206): n is a, c, t, g, unknown, or other
  misc_feature (211)..(211): n is a, c, t, g, unknown, or other
  misc_feature (232)..(232): n is a, c, t, g, unknown, or other
  misc_feature (233)..(233): n is a, c, t, g, unknown, or other
  misc_feature (263)..(263): n is a, c, t, g, unknown, or other
  misc_feature (264)..(264): n is a, c, t, g, unknown, or other
  misc_feature (278)..(278): n is a, c, t, g, unknown, or other
  misc_feature (280)..(280): n is a, c, t, g, unknown, or other
  misc_feature (292)..(292): n is a, c, t, g, unknown, or other
  misc_feature (326)..(326): n is a, c, t, g, unknown, or other
  misc_feature (327)..(327): n is a, c, t, g, unknown, or other
  misc_feature (330)..(330): n is a, c, t, g, unknown, or other
  misc_feature (331)..(331): n is a, c, t, g, unknown, or other
  misc_feature (359)..(359): n is a, c, t, g, unknown, or other
aaagctggagctcaccgcggtggcggccgctcaataatagtggatcccccgggctgcaggaattcgcacgagaccattacctagaacatcctaatcgaaaacccggcccgcgcctcgctctctcttgtctcgcccgctagctcccatcccagccctccaccggcacccgctggcccaacatccccctttcccgctccgctccacgnacggntccagatctgctaacgcggcnnggcgtggacgccgcgccgcgcgtgccgaanngcgtgacgtgagcngngaatcctgcccngccgtgccatctggcgagatgacagcgtaagggnnggnngacgacgcgcccccccggccctactccngagtcattgggtggtgtccttggagaaaatgcatgatggtgatcccccaatggatggcagcaaggaagcatacatactatgtggcaacctgttgagatcacacaagacgtgcgatcaagccatcgagagagctacggatcgttgctctctgtaacgggaaccaatgaaaagccgaaaaaaaataaccacgtcttgaacacgggtggatgcctaagaccctgaaagagtcaaactcttccccactgagggacaaaatggtttcgttcaaagaactaatgatgcctcgaataaaagaggtcaaggaggtttattggtttata

SEQ ID NO: 17355 - DNA, 751 bp, Zea mays
  misc_feature: Ceres CLONE 1382237-F
  misc_feature: Translation starting site: 199
  misc_feature: Pfam Name: Reticulon Pfam Description: Reticulon
  misc_feature (567)..(567): n is a, c, t, g, unknown, or other
aaagctggagctccccgcggtggcggccgctctataactagtggatcccccgggctgcaggaattcgcacgagaccattacctagaacatcctaatcgaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgttggcgtcggcggcggaagccatgaaggccaagatctaccgcctttttcggccgggagaggcccgtccactccgtcctcggcggcggcaagcctgccgatcttatcctatggaggaacaggaagatctctggcggggtacttgctggggccacggccatctggctcctattcgaggtcatggagtaccatctcctcaccttggggggcactgtctcatcctctcggtggccatcctcttcctgtgncccatggcctcccctttcatcaacaagtccccaccgaaacattcctgaggtcaaaaacccccaaggaatgtggctggtaaatggttgccctggcccctgaaataatgagaacaaccgggggttttgctcaccttaagggaaaattggggcatggcccgggattctaaaaaaaatcccatattgg

SEQ ID NO: 17356 - DNA, 723 bp, Zea mays
  misc_feature: Ceres CLONE 1382238-F
  misc_feature: Encodes the peptide sequence at SEQ ID NO. 17357
  misc_feature (429)..(429): n is a, c, t, g, unknown, or other
  misc_feature (490)..(490): n is a, c, t, g, unknown, or other
  misc_feature (493)..(493): n is a, c, t, g, unknown, or other
  misc_feature (494)..(494): n is a, c, t, g, unknown, or other
  misc_feature (697)..(697): n is a, c, t, g, unknown, or other
aaagctggagctccccgcggtggcggccgctctagaactagtggatcccccgggctgcaggaattcgcacgagaccattacctagaacatcctaatcgaaaaaaggaaggagaggggagcgagcgagcgagcaaccggcggcgacagccatggcggagcagcacaaggaggagtcgggcgtgacagtgctggacaagatctccgacaagctccacgggcgagggggcggctcgtcctcgtcgtcggactcggacgacgagcgctcgtcggcgacggccgccgtgaaggccaagatctaccgcatcttcgggcgcgagaagcccgtgcactccgtcctcggcggcggcaagccggccgatctgtttctatggaggaacaagaggatctctggtggggtgctcgcaggcgcaactgccttctggctgctgnttgaggtcatgaattaccacctccctcacctggctatgcactggctcatcctcaccctggncanntctgtcctctggtcaatggcacgactttcatcaacaagtctcctcctaacatccccgaggtgaagatcccagatgacctggctgtgaatggtgcacgtccctgagaatgagatcacaggggtttttctacctggaggagattggcagggcatgacctcagaaattctgattgtgatgcagactgtggatctttctggtctggnagctgtgcaattcctcacttggctaa

SEQ ID NO: 17357 - protein, 135 aa, Zea mays
  misc_feature: Ceres CLONE 1382238-F
  misc_feature (94)..(94): Xaa is any aa, unknown, or other
  misc_feature (114)..(114): Xaa is any aa, unknown, or other
  misc_feature (115)..(115): Xaa is any aa, unknown, or other
MAEQHKEESGVTVLDKISDKLHGRGGGSSSSSDSDDERSSATAAVKAKIYRIFGREKPVHSVLGGGKPADLFLWRNKRISGGVLAGATAFWLLXEVMNYHLPHLAMHWLILTLXXSVLWSMARLSSTSLLLTSPR

SEQ ID NO: 17358 - DNA, 738 bp, Zea mays
  misc_feature: Ceres CLONE 1382240-F
  misc_feature: Translation starting site: 221
  misc_feature (336)..(336): n is a, c, t, g, unknown, or other
aagctggagctccccgcggtggcggccgctctagaactagtggatcccccgggctgcaggaattcgcacgagaccattacctagaacatcctaatcgaaaaacgcctcccaacctcctctgctctcccccacctcccggtccggcagcagagagcgggggtgcagagagatcgagatccggaggccgcgagtgtgagcgccaccaccagcgactgcggcaatggcgggcacggtgacggtcccggggtcgtcgaccccctccacgccgctgctcaaggacgagctcgacatcgtgatcccgaggatccggaacctcgactttctggagatggtggnggtccttctttcaggccctaccacctcatcatcgtgggggggggggggacccgacccaaaaccatccggggggccggaggggctttgaactacaaacgtctaacaagcgggaacgaactttcgaccggcatccctccggggcccaagggcctccctgggatttcccctttcgagggacctccggccctggccgcgtgggtttcggggttaattggggccctcccaaggaaaaaaggttatttctaaccccctttggaggggagaatggggtttcgtttggccagggggacccgatcgtggggaaagggaaattcaagtggggtcttgggggcaggccattgttaggaaagtgtccttgaggcgggatgccgcccgcgggtttttttttgtaaaacccgtggg

SEQ ID NO: 17359 - DNA, 722 bp, Zea mays
  misc_feature: Ceres CLONE 1382241-F
  misc_feature: Encodes the peptide sequence at SEQ ID NO. 17360
  misc_feature (388)..(388): n is a, c, t, g, unknown, or other
  misc_feature (470)..(470): n is a, c, t, g, unknown, or other
  misc_feature (558)..(558): n is a, c, t, g, unknown, or other
  misc_feature (618)..(618): n is a, c, t, g, unknown, or other
aaagctggagctccccgcggtggcggccgctctagaactagtggatcccccgggctgcaggaattcgcacgagaccattacctagaacatcctaatcgaaaaacatcccagttggaagggcagccaataaggtaaggggtgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgtcgtcgccaccctccggcgccgccatcccggtggtggacctctcggtgacgncgcgcgaggacctaatcgagcaggtgaggcacgcggccgggacggtgggcttcttctggctggtgaaccacgcgtgccggangagctgatgggccgcatgctccgcggggtggcgcagttcaacaagggcccggtggagcgaaacaggcgctctactccagggacttggnttcgaaacttgggcttccctccaaattcgaccttcttcaaggccgttgcggccgattggnccaaaccctctttctggagggggctcccaacccccccccgcggaaggacttccggaacccctgaggaacggttgttggaaaccggcggggggaaaaaaaagtgg

SEQ ID NO: 17360 - protein, 109 aa, Zea mays
  misc_feature: Ceres CLONE 1382241-F
  misc_feature: SWISSPROT Homolog: EC 1.14.11.20 Desacetoxyvindoline 4-hydroxylase
  misc_feature (81)..(81): Xaa is any aa, unknown, or other
  misc_feature (108)..(108): Xaa is any aa, unknown, or other
MAPTTATKDDSGYGDERRRELQAFDDTKLGVKGLVDSGVKSIPSIFHHPPEALSDIISPAPLPSSPPSGAAIPVVDLSVTXREDLIEQVRHAAGTVGFFWLVNHACRXS

SEQ ID NO: 17361 - DNA, 744 bp, Zea mays
  misc_feature: Ceres CLONE 1382242-F
  misc_feature: Encodes the peptide sequence at SEQ ID NO. 17362
  misc_feature (234)..(234): n is a, c, t, g, unknown, or other
aaagctggagctccccgcggtggcggccgctctagaactagtggatcccccgggctgcaggaattcgcacgagaccattacctagaacatcctaatcgaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggnccaggtcgccctccagagcgaggatgtcgagctcgtcgccgtcaacgaccccttcatcaccacggactacatgacctacatgtttcagtacgacaccgtccacggccactggaagcacagcgacatcacactcaaggactccaagacccttctcttcggtgacaagccggtcacccgtctttggcatcaggaaccctgaggaaaatcccgtggggtggaggctggcgctgaatatgttctggagtccaccggcgtcttccactgaaaggaacaaggctgctgcacatctcaagggtgggggcaaaaaagtttgttatctctggccccaagcaagatgcacccatggtttgttgttgggggcaatgaggacaaggaaccccccggaggttaacattgttccaaatggtagctggacccacaaactggcctggctcccctttggtaagggtcattccttgaaaactttcggaatgggttgaggggtttgaagaacaactggttcctgcccac

SEQ ID NO: 17362 - protein, 84 aa, Zea mays
  misc_feature: Ceres CLONE 1382242-F
  misc_feature (4)..(85): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (19)..(19): Xaa is any aa, unknown, or other
MGKIKIGINGFGRIGRLVXQVALQSEDVELVAVNDPFITTDYMTYMFQYDTVHGHWKHSDITLKDSKTLLFGDKPVTRLWHQEP

SEQ ID NO: 17363 - DNA, 701 bp, Zea mays
  misc_feature: Ceres CLONE 1382244-F
  misc_feature: Translation starting site: 198
  misc_feature: Pfam Name: LEA_5 Pfam Description: Small hydrophilic plant seed protein
  misc_feature (428)..(428): n is a, c, t, g, unknown, or other
  misc_feature (701)..(701): n is a, c, t, g, unknown, or other
gctctagaactagtggatcccccgggctgcaggatcaaaaattcgcacgagaccattacctagaacatcctaatcgaaaaaagcaaagcagcagcaacagccaacacctaaactaaagaacagtagtagtccctgtgtacgtctagcaacgatccgcaccgagctcgccagttttgctcgttagtttggggacggcgatggcgtccggtcaggaaagcagggaggagctggcgcgcatggccgaggaggggcagaccgtcgtccccggcggcaccggcggcaagaccctcgaggcgcaggagcacctcgccgaagggcgcagtcacggcgggcagacccggagtgagcaggtgggccatgaggggtacagcgagatgggcagcaagggcgggcagacccgcaaagagcagctgggcacagaaacaccnggggggggggggggttttagagagccccttccttgagcgccctggagggggttcctggccggcagagccaggcggcccgggagggtgttcgggtatccggcggaggcgcgggttcctgggggcggggtgcgggagggcgtggattgcggagcccccctcttcaagatggagacagcctaggcgtcgaggggacggctagtggtctgcctgtgaggaggaagggggaagtgggggcggagtgtgcccgcttccgtgcgatgtgggggccgggcn

SEQ ID NO: 17364 - DNA, 774 bp, Zea mays
  misc_feature: Ceres CLONE 1382247-F
  misc_feature (300)..(300): n is a, c, t, g, unknown, or other
  misc_feature (348)..(348): n is a, c, t, g, unknown, or other
  misc_feature (382)..(382): n is a, c, t, g, unknown, or other
  misc_feature (384)..(384): n is a, c, t, g, unknown, or other
  misc_feature (420)..(420): n is a, c, t, g, unknown, or other
  misc_feature (471)..(471): n is a, c, t, g, unknown, or other
  misc_feature (472)..(472): n is a, c, t, g, unknown, or other
  misc_feature (476)..(476): n is a, c, t, g, unknown, or other
aaagctggagctccccgcggtggcggccgctctagaactagtggatcccccgggctgcaggaattcgcacgagaccattacctagaacatcctaatcgaaaaacagtgcctctcgctcactgactgactgtaataccagagatcgaacaacttggtcctgcagctcaagaagagagtttttgtgcatttgggggccgggggcaagagagagagagagagccatggcggcggaccagcagccgcagctgcaggaggagatgaacgacgctgccggcggcggcctcaggctgcctccagggntccgcttcccaccgagcgacttcgagattgtcagcttctacctcaccnacaaggtgctcaacacgcgcttcacctgcaccgncntcacgggaggccgactaaaacagattgagcctgggnacctccctagccagggcaaaaatgggcaaaaaaaaaggggtccttctttcnntccncccccccaaaaaaaggacccgcaagaaccccaaggggctggaggggaaaaccggccccccggggcccgttttctggaaagggcccggcaaagaaaaagggggttcccaccgccccccaaaagggggggggggggtccttggcccaataaaaaaaaaacctcttcctttaacgggggggggcgccccccgggggggaaaaaaacaaaatgggggttttgcccaaaaaaagggccttaaaagagggggggggtgtccccccccgcgctctctgtgttaaaaaaagggtttttcccccccc

SEQ ID NO: 17365 - DNA, 668 bp, Zea mays
  misc_feature: Ceres CLONE 1382250-F
  misc_feature: Encodes the peptide sequence at SEQ ID NO. 17366
  misc_feature (341)..(341): n is a, c, t, g, unknown, or other
  misc_feature (373)..(373): n is a, c, t, g, unknown, or other
  misc_feature (394)..(394): n is a, c, t, g, unknown, or other
  misc_feature (457)..(457): n is a, c, t, g, unknown, or other
  misc_feature (460)..(460): n is a, c, t, g, unknown, or other
  misc_feature (508)..(508): n is a, c, t, g, unknown, or other
caaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggagggacggagtggtcgaacgggaccgcaaggaggaccntgcggtggtgcaagcaggcgtgcgagtggcantacggaaagacacccccgcgnaagagggatgcaaagagcgagtggcgcgagcgcaccagcaagctgacgcggggcgaggacgcnacngcggggtggacgcctactctcccgctcggaaagggggggaagggccgncgccagtgcctgcgccgcacgaggggcagccgtgggagaaccccagagtgcatggaggcggtgccgccgccgcgggactgggccgcgacatggaaaaaagagtaccgtcgcggcagcgagagcgcgggcaggtgcccggaaggagtgcgagcgcccccac

SEQ ID NO: 17366 - protein, 142 aa, Zea mays
  misc_feature: Ceres CLONE 1382250-F
  misc_feature (34)..(34): Xaa is any aa, unknown, or other
  misc_feature (44)..(44): Xaa is any aa, unknown, or other
MVGVPPARRRAAGRSSHGRGGGTEWSNGTARRTXRWCKQACEWXYGKTPPRKRDAKSEWRERTSKLTRGEDATAGWTPTLPLGKGGKGRRQCLRRTRGSRGRTPECMEAVPPPRDWAATWKKEYRRGSESAGRCPEGVRAPP

SEQ ID NO: 17367 - DNA, 780 bp, Zea mays
  misc_feature: Ceres CLONE 1382251-F
aaagctggagctccccgcggtggcggccgctctataactagtggatcccccgggctgcaggaattcgcacgagaccattacctagaacatcctaatcgaaaacccattcatcgagtctacgctcttcgtctttctccggtccgaattccccaatcggactctcctcttcttgccggatctccacaccccattccaccccgcccatgggtgcccccacccctcgacgctgacctgtgggtacactgccccctgatcccccgtcccgatcccgctcgcccatgcgaaccctaggcagttaggctttgctgctagaagagctccagcgaccgacgagggagaggagaatacagctcaaatcttggatgcgcccgaaccgatggcgacacctgccgcatataaatcggaagatgtagagatccgtgaggtttggggagaacaaactcgagacaaagttcgccgagatccgacgaattcgtcgacgaataatccgaatggggctattggacactgagtttcccgggcgttggggggcctgccgctccggacttaaacagggggggggcccaatttcacttacccccccttttaaaagctaacggggaatatggtgaaccttaattcggtctccggtccccccttgtcccgaaaaaaaattgtggggtttgcccgcctttatgcccaaaaaggcgcgcccaagagggctgggatatttaaatttttggagggatttgccccctcccaatccaaggatggctttgaaccgggccctccaccaaaata

SEQ ID NO: 17368 - DNA, 616 bp, Zea mays
  misc_feature: Ceres CLONE 1382256-F
  misc_feature: Encodes the peptide sequence at SEQ ID NO. 17369
aagctggagctccccgcggtggcggccgctctagaactagtggatcccccgggctgcaggaattcgcacgagaccattacctagaacatcctaatcgaaaaatggaatcctgtagcttccgtgccgcaaccgcgccttctccctttccctccgctccttcttcatcttcatccccgcgcgccccatgccccatactccgatttcccaggccaagaaaaggcaggcacattggggtgcgcaggaggacgtccggatttgatgccttcgcgtctttcgccggaaaggtcttcgtggatgaggcgattggagcgcaatatggagagggcttcaaaacatttcgaatgcatggaccactcaaggatgatgtggattatctgaggtgaggattgcaagagtgcttccttacaaaggataaggcatgctatgaagtcggatgaggcgtttggtctatttatttcgagagacaatgttattgctgatacagactcgctaaagtgaatgcttggagacacttgctttgcaggaagtaaggatatcccaagtggtgctcatgtccggacaacattattcatgtgctgctgacatgttcttaggaaggttttgtactgggcaaaag

SEQ ID NO: 17369 - protein, 93 aa, Zea mays
  misc_feature: Ceres CLONE 1382256-F
MESCSFRAATAPSPFPSAPSSSSSPRAPCPILRFPRPRKGRHIGVRRRTSGFDAFASFAGKVFVDEAIGAQYGEGFKTFRMHGPLKDDVDYLR

SEQ ID NO: 17370 - DNA, 727 bp, Zea mays
  misc_feature: Ceres CLONE 1382261-F
aaagctggagctccccgcggtggcggccgctctagaactagtggatcccccgggctgcaggaattcgcacgagaccattacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggggccgcaaagctcaccgataacggctaacgcctgctggcatgcagactcttcccatggcggggtgctttcatcccccgcgaccagaaggggcgacttggacccggctctgcctgggggggggggggggggagcgcccaagtataccaccacgccgccgaaagaccggaaaagaataaggcgaaagtaccaggtccgcggcggaagacgctaaagccgccccgggggacccccagggacaccccaaaaatgatggcggggaaaaaacaaaaaccgggtccagagaaaagggccggccccagggggggaaccagggctccggggttggcccaagcgcgccaaaaaaacacaggaaaagggcgttgggggagagagagacccccaaggaacagggggcttcccggggggtttttgttgtgcgggagaaaaagaaaaacgggggtacccccgcccggcgaaaaagccccgcgg

SEQ ID NO: 17371 - DNA, 616 bp, Zea mays
  misc_feature: Ceres CLONE 1382262-F
  misc_feature: Translation starting site: 344
  misc_feature (357)..(357): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatgcccggaattgncaggaacatggtggcgccggtggctggtggctcacctcatcatgtacatcatcgtcatcggcttcgcgagctgggacctggaccacttcatcaacgggcagacaactaccccggcgtggccggcaacggcgcgacgttctacttcctgggtgtcgccatcctggccggcgtggtggaccccgcgtccaagctggcgggcgtgcaccagtgcgcgcctggggccacgacgcctggccaccaacgccggtcgtcgctcatg

SEQ ID NO: 17372 - DNA, 731 bp, Zea mays
  misc_feature: Ceres CLONE 1382266-F
  misc_feature: Encodes the peptide sequence at SEQ ID NO. 17373
  misc_feature (435)..(435): n is a, c, t, g, unknown, or other
aagctggagctccccgcggtggcggccgctctagaactagtggatcccccgggctgcaggaattcgcacgagaccattacctagaacatcctaatcgaaaagaaaatatacgtcagaataaaccgcagcaaatcttctccggcaccggcagcgcccaaatccggcaatccgctgctccgaatggactcaggttacaatccccggacggtggaggaggtgttccgggacttcaagggccgtcgtgccgggataatccgcgcgctcaccactgatgcggaggatttcttcaagcaatgcgacccggaaaaagaaaacttgtgcctgtatgggtttcctaatgagagctgggaagtaaatttgcctgctgaagaggtgccacctgacctcccagaaccagcattaggcataaactttgcaagagatggaatgcagganaaagagtggttgtccatggttgctgcacacagtgatgcatggttactttctggtgcattttacttcggtgctcgattcggtttcaataaaatgacaggaagcgcctctacagtttgattgatgatcttcccatggcttttgaaaatgttagtgggaagagtgaaaccagggcacagcaccacccagcagtagtaccacagcaatatcaaaccgaagtctaacacaaaaagaaccaccggagcctaaggtgagcagccaaagcgcgtgccctgcagagaaagccgagagaaaatgcc

SEQ ID NO: 17373 - protein, 123 aa, Zea mays
  misc_feature: Ceres CLONE 1382266-F
  misc_feature (85)..(85): Xaa is any aa, unknown, or other
MDSGYNPRTVEEVFRDFKGRRAGIIRALTTDAEDFFKQCDPEKENLCLYGFPNESWEVNLPAEEVPPDLPEPALGINFARDGMQXKEWLSMVAAHSDAWLLSGAFYFGARFGFNKMTGSASTV

SEQ ID NO: 17374 - DNA, 683 bp, Zea mays
  misc_feature: Ceres CLONE 1382267-F
  misc_feature: Encodes the peptide sequence at SEQ ID NO. 17375
  misc_feature (357)..(357): n is a, c, t, g, unknown, or other
  misc_feature (381)..(381): n is a, c, t, g, unknown, or other
  misc_feature (439)..(439): n is a, c, t, g, unknown, or other
  misc_feature (563)..(563): n is a, c, t, g, unknown, or other
  misc_feature (581)..(581): n is a, c, t, g, unknown, or other
  misc_feature (675)..(675): n is a, c, t, g, unknown, or other
aaagctggagctccccgcggtggcggccgctctagaactagtggatcccccgggctgcaggaattcgcacgagaccattacctagaacatcctaatcgaaaagtcgtctcattctcatggaggtggaaacaccggcgcaggcgcagggcaccactcatgtcgccggcactacgaggacactccgcaacccactcctcgtcgtcaacttcgtcctcatggtcgtgggctcagcgggcggcccgctgttcctccgcgcctacttcctccacggcggcgcccgcaagtggctctcggccttgctccagaccgccggcttcccgctcctgctcgtgccgctctgcgtctccttctcccggngccgccgccgccgcccccgccggnccgacgacggcgcgccggcaatggcgccgttcttcctcatgacgccccgcctcctggncggcgtccgcgggcatcggcctcatgaccgggctcgacgacctgctctacgcctacgggctggctaccctggcgggtgccacgtcctccatcctcatctccacgcagttgggcttcacggccgncttcgcgctgctgctcgnggcgggaagcggttcacggcccttctcgggggaacgccggggccgttgcttcagccgccgcgcggcattggttcgggaggaaaaccggggaacnaccccccc

SEQ ID NO: 17375 - protein, 189 aa, Zea mays
  misc_feature: Ceres CLONE 1382267-F
  misc_feature (81)..(81): Xaa is any aa, unknown, or other
  misc_feature (89)..(89): Xaa is any aa, unknown, or other
  misc_feature (108)..(108): Xaa is any aa, unknown, or other
  misc_feature (187)..(187): Xaa is any aa, unknown, or other
MEVETPAQAQGTTHVAGTTRTLRNPLLVVNFVLMVVGSAGGPLFLRAYFLHGGARKWLSALLQTAGFPLLLVPLCVSFSRXRRRRPRRXDDGAPAMAPFFLMTPRLLXGVRGHRPHDRARRPALRLRAGYPGGCHVLHPHLHAVGLHGRLRAAARGGKRFTALLGGTPGPLLQPPRGIGSGGKPGNXPP

SEQ ID NO: 17376 - DNA, 737 bp, Zea mays
  misc_feature: Ceres CLONE 1382268-F
  misc_feature: Encodes the peptide sequence at SEQ ID NO. 17377
  misc_feature (601)..(601): n is a, c, t, g, unknown, or other
  misc_feature (701)..(701): n is a, c, t, g, unknown, or other
aaagctggagctccccgcggtggcggccgctctagaactagtggatcccccgggctgcaggaattcgcacgagaccattacctagaacatcctaatcgaaaaaccatctccagcggcttcttccaaagctccaactccgacgagaaccgccacacctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgaggggtgcgtcggccgcgtcgccgccaagctcgagtccatggagccctgctccagcgtcaaggataggattggctacagcatgatcacggacgcagaggagaaagggctgattactccaggcgtgagtgttctgattgaaccaactagcggcaacacaggcattggactggcctttatggctgctgccaagggctacaaacttacactcacaatgcctgcctccatgagcatggagaggaggatcatattgaaggcttttggtgctgaacttgtccttactgacccactcctgggaatgaaagagctgtncagaaagcggaaagagatacagcaaagacacccaactcttacatcctttcacaatttgaaaatccagctaacccaaagattcactatgagactactgggnctgaaatctggaaagctacagcagaaaaaattgatg

SEQ ID NO: 17377 - protein, 177 aa, Zea mays
  misc_feature: Ceres CLONE 1382268-F
  misc_feature (12)..(174): Pfam Name: PALP Pfam Description: Pyridoxal-phosphate dependent enzyme
  misc_feature: SWISSPROT Homolog: EC 2.5.1.47 Cysteine synthase
  misc_feature (132)..(132): Xaa is any aa, unknown, or other
MGEASPSIAKDVTELIGNTPLVYLNKVTEGCVGRVAAKLESMEPCSSVKDRIGYSMITDAEEKGLITPGVSVLIEPTSGNTGIGLAFMAAAKGYKLTLTMPASMSMERRIILKAFGAELVLTDPLLGMKELXRKRKEIQQRHPTLTSFHNLKIQLTQRFTMRLLGLKSGKLQQKKLM

SEQ ID NO: 17378 - DNA, 726 bp, Zea mays
  misc_feature: Ceres CLONE 1382269-F
  misc_feature: Encodes the peptide sequence at SEQ ID NO. 17379
  misc_feature (394)..(394): n is a, c, t, g, unknown, or other
  misc_feature (616)..(616): n is a, c, t, g, unknown, or other
  misc_feature (663)..(663): n is a, c, t, g, unknown, or other
caaagctggagctccccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcaggagcgggggcagcacgcccgtgggcggnaagccgccacgccaccacctcacgtccatccgccactgcgccagcagtgcccgcatcgccgctgcctccgccgaattcgtaagcaagctcgctgccacccaagccatctatccctaacacgaatttgatgtctgcccttctgttctcctgcaggggctggagtcggggacgctcagcttgatttcacctaccgcagacatccgtccgggcttcttgcctgtngtcagggtcgggagtttcgcggatattggaccccaatccttcatggnagacgagcatgtctgtgtggacaactcgtcgagcaccttggactccgtggcccgggcatccct

SEQ ID NO: 17379 - protein, 66 aa, Zea mays
  misc_feature: Ceres CLONE 1382269-F
MSGGVEPDTPPGSSSSSSRSGGSTPVGGKPPRHHLTSIRHCASSARIAAASAEFVSKLAATQAIYP

SEQ ID NO: 17380 - DNA, 671 bp, Zea mays
  misc_feature: Ceres CLONE 1382270-F
  misc_feature: Translation starting site: 201
  misc_feature (366)..(366): n is a, c, t, g, unknown, or other
  misc_feature (369)..(369): n is a, c, t, g, unknown, or other
  misc_feature (370)..(370): n is a, c, t, g, unknown, or other
  misc_feature (389)..(389): n is a, c, t, g, unknown, or other
  misc_feature (397)..(397): n is a, c, t, g, unknown, or other
  misc_feature (401)..(401): n is a, c, t, g, unknown, or other
  misc_feature (484)..(484): n is a, c, t, g, unknown, or other
  misc_feature (529)..(529): n is a, c, t, g, unknown, or other
  misc_feature (550)..(550): n is a, c, t, g, unknown, or other
  misc_feature (600)..(600): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
aaagctggagctccccgcggtggcggccgctttagaactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatgggcttcagcaagctgaccggcggcggcccgacgaccccgncgnntctgatcgcggcggcgtgncgcacgcnttcncgctgttcgtgggcgtgtctggtggcgcgaacatctcccggcggcacgtgaaccctggcgtggactttcggcgctttctgggncgcaacatcaccctgttccgggggctcctgtactgggtggcgcanctgctggggtccaccgggggngtgcttcctggtccgcttctcgacgggggggcaggccacggcacttcggnctagggnnngtggnnnnnnggggaagggctggnnncttggaaatctgatgaccttccggggtgggggaacg

SEQ ID NO: 17381 - DNA, 730 bp, Zea mays
  misc_feature: Ceres CLONE 1382271-F
  misc_feature: Encodes the peptide sequence at SEQ ID NO. 17382
  misc_feature (353)..(353): n is a, c, t, g, unknown, or other
  misc_feature (396)..(396): n is a, c, t, g, unknown, or other
aagctggagctccccgcggtggcggccgctctagaactagtggatcccccgggctgcaggaattcgcacgagaccattacctagaacatcctaatcgaaaaaatagttcggtgcctttttctagcggggaggaggcaggcggcgcgatctggcaccggccatcacgttccctcccgccgcttccccctccctgccctcccgttccccagatctgaagccattaaaaccagcggatctcacctcggggcgcgtccgcggcatctgggcaagcgagtggtagagccagcagccatgagatggtatgcatcggtagcctcctgagggcgctggtcctgagtgcggcggcgtctgcnggcaggcgccgggggcccaggatcctgtgtggccacgaggcgnatgtacgcgtgactcctcggcacggacacggctggcgcggattcccggcagcacgggaaggatgatgctggactcctctgactgtgcctctgctgccgcgccgcggaggcggggcaggtgcagccgcagcgcgccgcggtgggggccgtgccctggcgcacgacggtggctacgccagcgggggagggaaaaaaaaaatgccaactggattggggaactcaagttttagagggagaaaactacgatggaaatttccatgatggaaacaaactgaatggtggacagctggtacctggttggggttttcacggcatgggagatcccgtgggggtga

SEQ ID NO: 17382 - protein, 54 aa, Zea mays
  misc_feature: Ceres CLONE 1382271-F
  misc_feature (34)..(34): Xaa is any aa, unknown, or other
MVCIGSLLRALVLSAAASAGRRRGPRILCGHEAXVRVTPRHGHGWRGFPAAREG

SEQ ID NO: 17383 - DNA, 732 bp, Zea mays
  misc_feature: Ceres CLONE 1382272-F
  misc_feature: Translation starting site: 218
  misc_feature (356)..(356): n is a, c, t, g, unknown, or other
caaagctggagctccccgcggtggcggccgctctagaactagtggatcccccgggctgcaggaattcgcacgagaccattacctagaacatcctaatcgaaaaacttcattcggtttccggatagcttacctcacatcgacggtcggtgagccgttcgtgagtggcgaggcagtgcgtgcgctgcagcctgcagggcaagaacaggcgacgaagaagatgagcacgctggacacgcggacgctcaaggacgagctgacgagcatggacaggaagtgcctcgtggaccttggccacccgctgctcaaccgcgtcgccgacagcttcatccgcgcccgccgggtcggggcggccaggnccgtctccagggaggctacgtcgtcaccgtcgaagggctttcaggagactcgtccgggctggacgcccgacgcggcaagcgaagccatttctccagcatcagaggtgacgacgggccaaggtccctccacgcagtggtaaaaacgggcggcaggaagcctaccagggggggttggaaacccggaatctactcggggttccctacccccttgggggagcccggggtttccccccatggaaaaaagggccctcccagggcccttccttgggggggggggaaagtttctccggggtgaccccggggccctccccaaaggtttgtaatttttgcaaaaccgggggcgggtttctcagggggggggggtgtttttccccat

SEQ ID NO: 17384 - DNA, 841 bp, Zea mays
  misc_feature: Ceres CLONE 1382276-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (18)..(18): n is a, c, t, g, unknown, or other
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnccccccccccccccncncccccccccccgcnnnnnttctatnnnccaatgctggagctccccgcggtggcggccgctctagaactagtggatcccccgggctgcaggaattcgcacgagaccattacctagaacatcctaatcgaaaaaaagaggagagaatccatcgagtcgaccaccgagcacggttagggcgggggggctcgccgtggccacagttcagggaatccaatcccccactcctcaccggcgcccggcggttttataaatagattcccctcgtcactgtcgcggtcgcggcttgatcggattcaactcacctaccccacccccctcgattccttcccagctctgggcttacttcctacgcccaccaccggccggctccggggcctcgggttcctcgagcaaggctgccatggcctgccgccgcgggtggggggaggaactcaagggttctcctcttccctcccatgttccccctccgggctccgggggggacaagcagtttcccagcaggttggaagatggctggaaggaaaaacgggggggaccgcccgggctttcccgtccccccgagggtccgtgcaccccttctttctggcggaagaacgcccgaacaggggatcatcctccggaggttcgcccggcttttggtttgacccaggcccccatgcgggggattttttgaacaaggcggggaaccgccctaaccggggattcacgcttccaaaagggggaggcggggcgcgcccggggggttgggcccctcccagaaaaagggggagggggtgaacttctggggggggagggcttccccggcaggtgttgtgtgggcg

SEQ ID NO: 17385 - DNA, 759 bp, Zea mays
  misc_feature: Ceres CLONE 1382277-F
  misc_feature: Encodes the peptide sequence at SEQ ID NO. 17386
  misc_feature (1)..(1): n is a, c, t, g, unknown, or other
naaaagctggagctccccgcggtggcggccgctctagaactagtggatcccccgggctgcaggaattcgcacgagaccattacctagaacatcctaatcgaaaaacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatggtcgaagacgaatgcattttggtggacgagcaggacaatgggtgtggccatgagtcaaagaccactgccatttgatggaaaaagatgaatctgaaaatctgctactaagggattcaggggggtccttttccacccaaatttgacttggaacttcacaaaggccccgaaaaaggaaccttcctttaattgggaaaaaactggtggggccccccctgggcgggggggtggggtttttccgggaaaattcctggggggaaaaaagggccccaaaaagaatctcggggggggtggggccccccaaaaaaagaccccccggggaaaaatcccccccccgggggggagggttttttagaggccccctctgctcaaaaggggggggggaaaaaaattttaaccccgccggtggcttcccccgggggggggggggggcccccccaccaaaaaaaacctccgtggggaaaaacacccccccccccccttttattttttttcttg

SEQ ID NO: 17386 - protein, 43 aa, Zea mays
  misc_feature: Ceres CLONE 1382277-F
  misc_feature: SWISSPROT Homolog: EC 5.3.3.2 Isopentenyl-diphosphate Delta-isomerase
MAAAVVDDAGMDAVQKRLMVEDECILVDEQDNGCGHESKTTAI

SEQ ID NO: 17387 - DNA, 670 bp, Zea mays
  misc_feature: Ceres CLONE 1382280-F
  misc_feature: Pfam Name: CDP-OH_P_transf Pfam Description: CDP-alcohol phosphatidyltransferase
  misc_feature: SWISSPROT Homolog: EC 2.7.8.11 CDP-diacylglycerol--inositol 3-phosphatidyltransferase
  misc_feature (316)..(316): n is a, c, t, g, unknown, or other
  misc_feature (360)..(360): n is a, c, t, g, unknown, or other
  misc_feature (424)..(424): n is a, c, t, g, unknown, or other
  misc_feature (451)..(451): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
tggagctccccgcggtggcggccgctctagaatagtggatcccccgggctgcaggaattcgcacgagaccattacctagaacatcctaatcgaaaagtgtttcttgtgaggttttatatattttcctgtttctctttgctgatgaggagtcaacaagcttgcttagtgtatgcaaaggcatcctgaaccaaagtcccgtcgttatcttggtgtttgtttccactctagttggctgggcagtgaagcaagccaccaacgtcatccagatgaaaactgctgcggacgcatgcgtggtgtatgatctgaagcgcagcanatgaagcatgaaggcagcttcacggtttagtatcgacatatccnagggaaaactctgcgagggggcgggctacgtcttgcgtgccttgacatctttctgatgatgcgncatatgtgggacagggagactgcgtgncatgcacatgttggacagctattcagagagatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17388 - DNA, 723 bp, Zea mays
  misc_feature: Ceres CLONE 1382282-F
  misc_feature: Encodes the peptide sequence at SEQ ID NO. 17389
  misc_feature (272)..(272): n is a, c, t, g, unknown, or other
  misc_feature (288)..(288): n is a, c, t, g, unknown, or other
  misc_feature (292)..(292): n is a, c, t, g, unknown, or other
  misc_feature (354)..(354): n is a, c, t, g, unknown, or other
  misc_feature (372)..(372): n is a, c, t, g, unknown, or other
aagctggagctccccgcggtggcggccgctctagaactagtggatcccccgggctgcaggaattcgcacgagaccattacctagaacatcctaatcgaaaagatactatcagattgtcacaagctggtgaaggagcttctttctgagcatgaatatggattcaacatcggaattttcaaacgccgtttttcccaggagtatggatacgagcttgaacaccggaagctcgggtatctggacccttgaacgctgctgcatattatgcctgatgntagggtgaaaattccnaggntcatgcgctcagaaacacggaacgggcaggctggcagcaaggggagacgaaaccgaagcagncgcgatgacttgatctgncaggagcttggtcctgtatctgccacaactgaaaccgccgccgccgccgctgatgcaggggccgacaaggaaacatgctatcgtcctcccactccttcagacgacgagttctcggacagcgacagcataaaagaccggcagcctaagaggaacgccgagcagcagagctcgcttctccagatcatttgagcttgaacaacagcaagggtggcgacgtctctaacaacaagctcaggaacatcgacgggtttggtggactggttcaaaaaccaaccccggcagtgctggcaccagcccaattttcagaaaggtgcaaacgttgtcttccaagctaccgcacaagcagtactc

SEQ ID NO: 17389 - protein, 99 aa, Zea mays
  misc_feature: Ceres CLONE 1382282-F
  misc_feature (4)..(4): Xaa is any aa, unknown, or other
  misc_feature (11)..(11): Xaa is any aa, unknown, or other
  misc_feature (31)..(31): Xaa is any aa, unknown, or other
  misc_feature (37)..(37): Xaa is any aa, unknown, or other
MPDXRVKIPRXMRSETRNGQAGSKGRRNRSXRDDLIXQELGPVSATTETAAAAADAGADKETCYRPPTPSDDEFSDSDSIKDRQPKRNAEQQSSLLQII

SEQ ID NO: 17390 - DNA, 725 bp, Zea mays
  misc_feature: Ceres CLONE 1382283-F
  misc_feature (588)..(588): n is a, c, t, g, unknown, or other
  misc_feature (715)..(715): n is a, c, t, g, unknown, or other
aaaagctggagctcaccgcggtggcggccgctcttaaactagtggatcccccgggctgcaggaattcgcacgagaccatttccttaaacttcctaatcgaaaaagtgcccttctgtctcctaactccccggagtccccgcttgcccagcccggtctcactttccagtctccgaaactccgagtctcgcttcgcaccccgtcccctgcagcctgtgcttctgggttggagggaggtgagctgcgagggagcgcggagggggcgaggagatggaggcagattcggcgaggaagaaaacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggttgaactcatttcagcaggccaacaccagggtggcatgatcctgattgttccacagggggaccatgcagtaaggctagggaatgatgctagcgttgggcagggtggtgacgnttgaaaaagggttcggagtatgctatcacattcagtgctgccccgacatgtgcacaactggaggcctttgaatgtttccgtggctaagtgggcgtgtctcaaacagaaaaactgtgcgacgtgttancacatagaaa

SEQ ID NO: 17391 - DNA, 740 bp, Zea mays
  misc_feature: Ceres CLONE 1382284-F
  misc_feature: Encodes the peptide sequence at SEQ ID NO. 17392
  misc_feature (341)..(341): n is a, c, t, g, unknown, or other
  misc_feature (349)..(349): n is a, c, t, g, unknown, or other
  misc_feature (357)..(357): n is a, c, t, g, unknown, or other
  misc_feature (358)..(358): n is a, c, t, g, unknown, or other
  misc_feature (363)..(363): n is a, c, t, g, unknown, or other
  misc_feature (411)..(411): n is a, c, t, g, unknown, or other
  misc_feature (447)..(447): n is a, c, t, g, unknown, or other
aaaagctggagctccccgcggtggcggccgctctagaactagtggatcccccgggctgcaggaattcgcacgagaccattacctagaacatcctaatcgaaaaagcgaatcacgtgacttcccctccccttctcccctctccactccatcgtcaaggaaggaacacggccctaactaaaccctagctaagggaagggaaacaagaccatggatgcctccaagctccgcgagcttcgcgacttcgtcgaggcgtgcaagaagaatccttcgctccctcgcgaccccaacctctccttcttccgggattaccctcagagtttgggtgccaaaattccccgcgncgcccccntcttcaanngtccnagagatcttccatggacgacattgatgacgacggtgatgaccacaacnatttgaatatgagggatcccactcctgagcgaaacnactcgatgaaaaaattgttgagtctgactttgagctccaagggaaattggaccggttgaccttgttgccccccccaaaaagtggaaacccttccgggggggggcttgggaaaacccgggtttttccccaaaaaaaaaggggagggttttaaaactttttttggaggaaacttgaaggtttttttagaccccttccacccgggggggggggggaccccccccccccaaaattgtgggtggaaaaaaaccttttgttaaaaaaaaaaaaaaaaactttttgtcctttttgggtgt

SEQ ID NO: 17392 - protein, 69 aa, Zea mays
  misc_feature: Ceres CLONE 1382284-F
  misc_feature (45)..(45): Xaa is any aa, unknown, or other
  misc_feature (48)..(48): Xaa is any aa, unknown, or other
  misc_feature (50)..(50): Xaa is any aa, unknown, or other
  misc_feature (51)..(51): Xaa is any aa, unknown, or other
MDASKLRELRDFVEACKKNPSLPRDPNLSFFRDYPQSLGAKIPRXAPXFXXPRDLPWTTLMTTVMTTTI

SEQ ID NO: 17393 - DNA, 750 bp, Zea mays
  misc_feature: Ceres CLONE 1382285-F
  misc_feature (342)..(342): n is a, c, t, g, unknown, or other
  misc_feature (350)..(350): n is a, c, t, g, unknown, or other
  misc_feature (369)..(369): n is a, c, t, g, unknown, or other
  misc_feature (376)..(376): n is a, c, t, g, unknown, or other
  misc_feature (382)..(382): n is a, c, t, g, unknown, or other
  misc_feature (384)..(384): n is a, c, t, g, unknown, or other
  misc_feature (480)..(480): n is a, c, t, g, unknown, or other
  misc_feature (483)..(483): n is a, c, t, g, unknown, or other
  misc_feature (486)..(486): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaaaaattagcaaagccgcgcgcattacattacattacatacaaacatacacagtttggccgttaattagccagcgctgacaaattaaccctcgtcttcgtcgcctgacccgccgccgaccgccgtacgtgaccaccaaccaggctatagagctacctccagccgccggcccgcgcgtcgtccgccgcggtgtacgtacgtctgccgcgaagccacgcgcgcggacatggctcagctgaaggncgcgcgcngcaccgacgtcccgcccgncatggcnggaccngnacccggacgtcgtcgccgccgacctcggggcggtgcgtacgggcacgggcgcgttgaacgttttggaagcaggaagcggcagggcgggaggggacngcnaangccaacaaccaaccggggggggggcccaatcaggaaaaacaaccgccgccccttgggggtggtaaggccaccccggaaagggaaataacggttgggttcccaaaacccgggttggggggggaaataggggagaaaacccccccgggtttaaaaggcggggcgggaaaacacccccgggggataatatnggagtttcaaaccccggggaaaaggggggggtgccctgttttttttaagaaaatttttttcaacaaaaaaaagggg

SEQ ID NO: 17394 - DNA, 773 bp, Zea mays
  misc_feature: Ceres CLONE 1382287-F
  misc_feature: Encodes the peptide sequence at SEQ ID NO. 17395
  misc_feature (247)..(247): n is a, c, t, g, unknown, or other
  misc_feature (270)..(270): n is a, c, t, g, unknown, or other
aaagctggagctccccgcggtggcggccgctctagaactagtggatcccccgggctgcaggaattcgcacgagaccattacctagaacgtcctaatcgaaaagcccccagcagatcttgtgaccctccctcagccgcgtcgcgtcgcatcctacgatccaaagctctctctggtcgcaggtcgcagccatggcgaagaactacccgaccgtgagcgccgagtacagcgaggctgtggacaaggccanggcgcagctccgagccctcatcngcgagaagagctgcgccccgctcatgctccggctcgcgtggcactccgcggggacgttcgacgtgtcgtcgaggacccggcgtcaattcggaagatgaagcatcagtcggatttggctcccgggggataccgggggctggaacttcggggggggttgcttcaggccataaggaagagagtcccaatccttttttaccccgattcttaacaattcccggagattttgccccgggaagcacccgggggccttaaattcccttcccccccggagggggagaaacccccccccccccggggggcgcccttcctggggccacaaaggtgttcccccccgggagaaattttttgaaaaaaaaggggttgtgaagaaaaaaaattttttccccccttggggccccccctggggggggcgccaaaaaaaggtggttttttttagggggccggaaaaacaaccctgtgtggtgcaaccctctcgagaaaaaaattttggggggggagaggct

SEQ ID NO: 17395 - protein, 59 aa, Zea mays
  misc_feature: Ceres CLONE 1382287-F
  misc_feature: SWISSPROT Homolog: EC 1.11.1.11 L-ascorbate peroxidase
  misc_feature (20)..(20): Xaa is any aa, unknown, or other
  misc_feature (28)..(28): Xaa is any aa, unknown, or other
MAKNYPTVSAEYSEAVDKAXAQLRALIXEKSCAPLMLRLAWHSAGTFDVSSRTRRQFGR

SEQ ID NO: 17396 - DNA, 790 bp, Zea mays
  misc_feature: Ceres CLONE 1382288-F
  misc_feature: Encodes the peptide sequence at SEQ ID NO. 17397
  misc_feature (249)..(249): n is a, c, t, g, unknown, or other
  misc_feature (274)..(274): n is a, c, t, g, unknown, or other
  misc_feature (339)..(339): n is a, c, t, g, unknown, or other
  misc_feature (442)..(442): n is a, c, t, g, unknown, or other
aaagctggagctccccgcggtggcggccgctctagaactagtggatcccccgggctgcaggaattcgcacgagaccattacctagaacatcctaatcgaaaaaacctcgtgttgttcggagcgcacacacacacaaccagatctcccccaaatccacccgtcggcacctccgcttcaagatgcagatctttgtgaaaaccctgactggcaagactatcaccctcgaggtggagtcgtctgacaccattngacacgttaagggcaagatcccagnacaggagggcatcccccccagaccagcagcggctcatctttgctggcaaacagcttgaggacggncgcacgcttgctgactacaacatcccgaaaggaaagcaccctccaccttggggctccgttttcagggaggcattgaaatttttgtggaaaaccgtgaaccggnaaaaattcaccccctcaggggggagccccttgaaccctttggaaaagtcaagggccaaaatccggaaaagggggggttcccccccaaaaaaaagggggttcattttttgtgggaaaaaatttggggaacggggcacttttttcaaaacaaaactccaaaggagaaacccccccccctgggggggtccccccagggggggggagtatatttttttgaaaacctcgcggggaaaaaaaccccccgcggggggggttttcaaaccccccaacaagggggggagaaaaaaaaaaagagggggtttcccccacaacaagaggtttttttttttgaaaaaaaaagaggggggcg

SEQ ID NO: 17397 - protein, 50 aa, Zea mays
  misc_feature: Ceres CLONE 1382288-F
  misc_feature (24)..(24): Xaa is any aa, unknown, or other
  misc_feature (32)..(32): Xaa is any aa, unknown, or other
MQIFVKTLTGKTITLEVESSDTIXHVKGKIPXQEGIPPRPAAAHLCWQTA

SEQ ID NO: 17398 - DNA, 732 bp, Zea mays
  misc_feature: Ceres CLONE 1382292-F
  misc_feature: Encodes the peptide sequence at SEQ ID NO. 17399
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (527)..(527): n is a, c, t, g, unknown, or other
  misc_feature (548)..(548): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaatccaacccacacacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctaacaacgagcacgcgcgccgcaagaccgtcacagccatgggacgtcgtctacgcactcaagcgccagggccgcaccctctctacgcttcggcggctaggctaggccggtcgcgcctcgttgtcgnnnncgtnctggcggtctattgttttgcnaatttgcaagttgtggctgggtggcgaaaatgctggttactgtacactagatcagcatggttgtgcgtgtctgagaaatgccaatggtgacttgggctgtttgttaaacatgctccacatttcaacacccgtccgcccctgggagggagttaattagcgccntgaaatggcctggcgcgcatcc

SEQ ID NO: 17399 - protein, 72 aa, Zea mays
  misc_feature: Ceres CLONE 1382292-F
MSGRGKGGKGLGKGGAKRHRKVLRDNIQGITKPAIRRLARRGGVKRISGLIYEETRGVLKIFLENVIRDAVT

SEQ ID NO: 17400 - DNA, 728 bp, Zea mays
  misc_feature: Ceres CLONE 1382295-F
  misc_feature: Translation starting site: 294
agagctggagctccccgcggtggcggccgctctataactagtggatcccccgggctgcaggaattcgcacgagaccattacctagaacatcctaatcgaaaaactactccgtcactttgtttgcaaagctcctcctcgaatccatcgatcactgcaccggccggcggcaccgcgctcgcaggggctagccaacgagacggcagcaatggcggaccgtgaccgcagcggcatctacggcggcgcccacgccacctacgggcagcagcagcagcagggagggaggcggccgcccgatgggtgagcaggtgaagggcatgctccacgaacaggggccgacggcgccgcaagcgctgacgggggcgacgctgctcccccctgggcgggctggtggtggtgttgccggggctggcccttacggcctccctggtggggctggccgggggcaccgccggtgttcctgatcttcagccccggggctgggccccgccggggttgctcattcggaaggcccgcatgggggtcctcacgtcgggcgcgcctggggttcgggggcctgtcctccgctcacgggcctcccaaacacggggggggaaggggttccagcgcaccccgggattacgtggaggaggcgcccccacagaatggggaaaggccccgggccacaccggccaaaaaaaccgggaggaaggcccaggcattccagggaagggcgcaagaaggccccccct

SEQ ID NO: 17401 - DNA, 731 bp, Zea mays
  misc_feature: Ceres CLONE 1382296-F
  misc_feature: Encodes the peptide sequence at SEQ ID NO. 17402
  misc_feature (465)..(465): n is a, c, t, g, unknown, or other
  misc_feature (556)..(556): n is a, c, t, g, unknown, or other
  misc_feature (652)..(652): n is a, c, t, g, unknown, or other
  misc_feature (670)..(670): n is a, c, t, g, unknown, or other
aaagctggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctgnctggagagcagtttacatgaaaagataaattgagcatgcaacaaccttatttgcaagctcaagtaagtgaggtagtcacgaatggctcagntgatgaattccctgaatcacatttcccatatggctcggaacaacggttgggtggaaatgccccactggagtatgcaagctttacaataagatttgnctcattgaatgtgacccnatgctttactcggtcacaaacattcttgaagcaagctcagcgaagtaggtaaaagtctccc

SEQ ID NO: 17402 - protein, 38 aa, Zea mays
  misc_feature: Ceres CLONE 1382296-F
MRSEPKPAYNESKAIPDAFFLEKASAEAFTERVESVLA

SEQ ID NO: 17403 - DNA, 720 bp, Zea mays
  misc_feature: Ceres CLONE 1382297-F
  misc_feature: Encodes the peptide sequence at SEQ ID NO. 17404
  misc_feature (484)..(484): n is a, c, t, g, unknown, or other
  misc_feature (485)..(485): n is a, c, t, g, unknown, or other
  misc_feature (488)..(488): n is a, c, t, g, unknown, or other
  misc_feature (489)..(489): n is a, c, t, g, unknown, or other
  misc_feature (513)..(513): n is a, c, t, g, unknown, or other
  misc_feature (605)..(605): n is a, c, t, g, unknown, or other
aaagctggagctccccgcggtggcggccgctctagaactagtggatcccccgggctgcaggaattcgcacgagaccattacctagaacatcctaatcgaaaaaacattctccacgcgttccttccttccctccatctcctctctgttcatagcctcccaagaaacaagagccaaacagcgcttgcgaagctcaagcgccgcagcaatgtctctggccccgtccatcccttccatcaaggtgaaggtgggggccgtctcggtcgctcctccacaccgcgcatgccgatccttcgcggtgatcaggagctccaaggcagagggccccatccggagacctgcggcgcctccgctgtcgccaccgccgccgatgccacccaagacgccggctctgtccactcctcccaccctgtcgcagcctccgacgcccgtgaagcccgctgctcccaccacgtcgtcgcagccgatgccaccttctcctgagccnnagnncagtgacgccacagcccaaatgcngaaagccgtggctggggccatgacgcttgagtaccagaggaagggtggcaaggacctgcaggagtacttcaagaagaagaagctggaggagnccgacccaggtccggttcttcgggttctgccaaagaatgagattttccacggagggtggcccattgttggggttgccagtagggatgctaacagatatgcacaaggcttcggatt

SEQ ID NO: 17404 - protein, 171 aa, Zea mays
  misc_feature: Ceres CLONE 1382297-F
  misc_feature (94)..(94): Xaa is any aa, unknown, or other
  misc_feature (95)..(95): Xaa is any aa, unknown, or other
  misc_feature (103)..(103): Xaa is any aa, unknown, or other
  misc_feature (134)..(134): Xaa is any aa, unknown, or other
MSLAPSIPSIKVKVGAVSVAPPHRACRSFAVIRSSKAEGPIRRPAAPPLSPPPPMPPKTPALSTPPTLSQPPTPVKPAAPTTSSQPMPPSPEPXXSDATAQMXKAVAGAMTLEYQRKGGKDLQEYFKKKKLEEXDPGPVLRVLPKNEIFHGGWPIVGVASRDANRYAQGFG

SEQ ID NO: 17405 - DNA, 728 bp, Zea mays
  misc_feature: Ceres CLONE 1382298-F
  misc_feature: Encodes the peptide sequence at SEQ ID NO. 17406
  misc_feature (324)..(324): n is a, c, t, g, unknown, or other
  misc_feature (354)..(354): n is a, c, t, g, unknown, or other
  misc_feature (575)..(575): n is a, c, t, g, unknown, or other
  misc_feature (636)..(636): n is a, c, t, g, unknown, or other
aaagctggagctccccgcggtggcggccgctctagaactagtggatcccccgggctgcaggaattcgcacgagaccattacctagaacatcctaatcgaaaaatacttttcctccttcagtttttatcacacgtcaatggagtggggctagcaatggcatggtaacttttccaatctttttgcattaaaaaagaaatcctaaagaaaaaggattactaaacgagcacgctcgccggcgctgggaccaggctctgggtctcgcatcacgatcagatccaatccaggccgcgccccagcccggcggatggattccgccgccgtggncatcgtgacggtgccgttccccgcgcaggnccacctgaaccagctgctgcacctgtccctgctcctggcatcgcgggggcttcctggtcacttcgccgcgccggagccgcacctccgggaggcccgcgcgcgcctgcacggttgggggcccgacccccgcgtcgtgtgcttccgcgcgctggacgtgcccgggcacgactccccctccccgggaccatcctcccccgtcccggggacatgcagcccctggntcgaggcttctgcaccggcgcggggcctcgctagccggctccttggggaagctggcgcgtncaccgccgcgtcttcgtctctacgacgatgggggcccttccggggggccgaggccggcgctacccaagcgaagggccttcgggtgactgccc

SEQ ID NO: 17406 - protein, 141 aa, Zea mays
  misc_feature: Ceres CLONE 1382298-F
  misc_feature: SWISSPROT Homolog: EC 2.4.1.215 Cis-zeatin O-beta-D-glucosyltransferase
  misc_feature (7)..(7): Xaa is any aa, unknown, or other
  misc_feature (17)..(17): Xaa is any aa, unknown, or other
  misc_feature (91)..(91): Xaa is any aa, unknown, or other
  misc_feature (111)..(111): Xaa is any aa, unknown, or other
MDSAAVXIVTVPFPAQXHLNQLLHLSLLLASRGLPGHFAAPEPHLREARARLHGWGPDPRVVCFRALDVPGHDSPSPGPSSPVPGTCSPWXEASAPARGLASRLLGEAGAXTAASSSLRRWGPFRGAEAGATQAKGLRVTA

SEQ ID NO: 17407 - DNA, 722 bp, Zea mays
  misc_feature: Ceres CLONE 1382300-F
  misc_feature: Translation starting site: 471
  misc_feature: Pfam Name: IGPD Pfam Description: Imidazoleglycerol-phosphate dehydratase
  misc_feature: SWISSPROT Homolog: EC 4.2.1.19 Imidazoleglycerol-phosphate dehydratase
  misc_feature (367)..(367): n is a, c, t, g, unknown, or other
  misc_feature (482)..(482): n is a, c, t, g, unknown, or other
  misc_feature (606)..(606): n is a, c, t, g, unknown, or other
aaagctggagctccccgcggtggcggccgctctagaactagtggatcccccgggctgcaggaattcgcacgagaccattacctagaacatcctaatcgaaaaaacccgttgtccactgcctccaggcaaaccggcagcgccgccgccggcgatgaccaccgcgcggctcgtctcaacatcccccgcccgcctaccctccacgtcggcttccccgattcccagaacctcgctgtgtgttgtcggtcgtgcccctgctttctccgctagggcgctcggcttctcgcttcgtctcaagccgtcgcctggcatgggcgccgccgggcccccctaccgcgcatggagactcaataggatcttctaggattgnagaggttaaagaggtgaccaaagagacaaatgtgcacgtgaagatcaaccttgatggcactggtgtcgccgagtgtagcacagggataccgttcttggatcacatgctcgatcangtggcatcacatggactctttgatgtctacgttaaagcaataggcgacacccatattgatgatcatcactcaaatgaggacattggctttggaaattggaacgggactacttgaagcacttggngatcgaaagggaattaaccgatttggtctttttacagcaccgccttgatgaagcagcgggttgaggttatacgggatctgggctggccgccctcatttaaggctgggggcttaaaa

SEQ ID NO: 17408 - DNA, 710 bp, Zea mays
  misc_feature: Ceres CLONE 1382301-F
  misc_feature: Encodes the peptide sequence at SEQ ID NO. 17409
  misc_feature (165)..(165): n is a, c, t, g, unknown, or other
  misc_feature (183)..(183): n is a, c, t, g, unknown, or other
  misc_feature (256)..(256): n is a, c, t, g, unknown, or other
  misc_feature (260)..(260): n is a, c, t, g, unknown, or other
  misc_feature (261)..(261): n is a, c, t, g, unknown, or other
  misc_feature (272)..(272): n is a, c, t, g, unknown, or other
  misc_feature (349)..(349): n is a, c, t, g, unknown, or other
  misc_feature (612)..(612): n is a, c, t, g, unknown, or other
aaagctggagctccccgcggtggcggccgctctagaactagtggatcccccgggctgcaggaattcgcacgagaccattacctagaacatcctaatcgaaaaaaaatcctccacaccctggactggagtggctgctgctcgtggccggcgatgagcggcggcggncccggaggtgcgtgcggnccggactccccgcgtggagacatctcccggctggcgcagtggcgcatcgataccttcggccctgctcctaccngcgnntcgaccctttntagctcgcatctggaactggtaccctgtcgtggagaagagccgctcccatcgtgtgcgcctcttccccgagcccggncgggtggccaaggagcagccccctctcgcgcgcttcctgctccgcgtctcctgggccggcccgccgcgacgctcctgcgtctcccctgtgcacgagcatcttctgcgtaccagcgatgattttgtatggcaagtcgatgcgatgtcccatgggcgttttacgattgatgttgagttcctagacctgaggatagccacgaacaatgctacggaatcgtcatcgttgtggccaaacgaaggcatggtgcaaaagatcgcgagcangagcgccctgggctgcctgtcgcgcatgctggcggactccctccacggggaacgggacatcaccccgacgagggggggctgaagcccacaaggggttt

SEQ ID NO: 17409 - protein, 67 aa, Zea mays
  misc_feature: Ceres CLONE 1382301-F
  misc_feature (41)..(41): Xaa is any aa, unknown, or other
MSHGRFTIDVEFLDLRIATNNATESSSLWPNEGMVQKIASXSALGCLSRMLADSLHGERDITPTRGG

SEQ ID NO: 17410 - DNA, 631 bp, Zea mays
  misc_feature: Ceres CLONE 1382320-F
  misc_feature: Encodes the peptide sequence at SEQ ID NO. 17411
  misc_feature (1)..(1): n is a, c, t, g, unknown, or other
  misc_feature (580)..(580): n is a, c, t, g, unknown, or other
natagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctggccgtggccacgccggtgttcctgatcttcagccccgtgctcgtccccgccgcgctgctcatcgggacggccgtcatggggttcctcacgtccggcgcgctgaggctcgggggcctgacctcgatcacgtgcctcgccaacacggnggcggtaggggttccagagcaccccggactacctgtaaggacgggcaccgc

SEQ ID NO: 17411 - protein, 141 aa, Zea mays
  misc_feature: Ceres CLONE 1382320-F
  misc_feature (44)..(141): Pfam Name: Oleosin Pfam Description: Oleosin
  misc_feature (125)..(125): Xaa is any aa, unknown, or other
MADRDRSGIYGGAHATYGQQQQQGGGGRPMGEQVKGMLHDKGPTASQALTVVTLFPLGGLLLVLSGLALTASVVGLAVATPVFLIFSPVLVPAALLIGTAVMGFLTSGALRLGGLTSITCLANTXAVGVPEHPGLPVRTGT

SEQ ID NO: 17412 - DNA, 655 bp, Zea mays
  misc_feature: Ceres CLONE 1382326-F
  misc_feature: Encodes the peptide sequence at SEQ ID NO. 17413
  misc_feature (485)..(485): n is a, c, t, g, unknown, or other
  misc_feature (603)..(603): n is a, c, t, g, unknown, or other
  misc_feature (604)..(604): n is a, c, t, g, unknown, or other
aaagctggagctccccgcggtggcggccgctctagaactagtggatcccccgggctgcaggaattcgcacgagaccattacctagaacatcctaatcgaaaaaacgaagaaccgaatgcccagtcctgaatcacgtcttcacccgtgctcgtgcgctgcgcccatcccttccgcctccacgctccccacgtgcaccgtgcacagcaccacacagccaggtccccatggcggcggcggcggcggttgcgtctgcgacgacggcggaagacgaagcgcgcctgctgcgcttggaggagcaggcggagcacggcggcggcggcgcctgggaatacctctgcctcgcccgccggctccgcgcccgccgccccgctcacgtcctccgcgtcggcctcgccctcctcaacaacgcctccgcgcgctccggccttgcctcagaacagtggacgctctacgagcaggtggccacgggggccatggattgcagncgtctcgatgtggcaaaggactttgtatttggagtcctttcaaaacaatttcctgggaggcacacgggttgcccggctagaaaagctcgtctgtttgaagcaaaaaaggtgaatgggnngctgaagctgaaagagcctaacgcgctaatcctgggaaaacaatccatttt

SEQ ID NO: 17413 - protein, 143 aa, Zea mays
  misc_feature: Ceres CLONE 1382326-F
  misc_feature (87)..(87): Xaa is any aa, unknown, or other
  misc_feature (127)..(127): Xaa is any aa, unknown, or other
MAAAAAVASATTAEDEARLLRLEEQAEHGGGGAWEYLCLARRLRARRPAHVLRVGLALLNNASARSGLASEQWTLYEQVATGAMDCXRLDVAKDFVFGVLSKQFPGRHTGCPARKARLFEAKKVNGXLKLKEPNALILGKQSI

SEQ ID NO: 17414 - DNA, 631 bp, Zea mays
  misc_feature: Ceres CLONE 1382342-F
  misc_feature: Encodes the peptide sequence at SEQ ID NO. 17415
  misc_feature (619)..(619): n is a, c, t, g, unknown, or other
  misc_feature (620)..(620): n is a, c, t, g, unknown, or other
aaagctggagctccccgcggtggcggccgctctagaactagtggatcccccgggctgcaggaattcgcacgagaccattacctagaacatcctaatcgaaaagtacaggaagcgctagaacaacgcgaccgccgccgcctcagctactcgcctggtgatgggcgtcgaactggcgcaaccgaccgccgccgcggctgcggtgaccaccgctgagcaggctcaggatctcatcgacgccgctaggtacgacgacttggaggacgtcgtcgccctgttctccgctggtgtctcgctggactccacagattcgcaaggccgcacagctcttcacatggcttctgccaatggtcaccttgctgtggtggaatacttgattcaaaatggagcgaatgttaacgccaccaacatggagaagaacacaccactccactgggcatgccttaatggacgtatagaggtaatcagggctttgatctcagcgggggctagcgtgagtgctctgaacagccacgagaaaacgccaatggacgaagcggtgaccacaggcaagatgcacgtgatcgacgcgatcggtgcggcagtagctcaagccgagctcaacggcgttactgtctcttannaggaactgatg

SEQ ID NO: 17415 - protein, 158 aa, Zea mays
  misc_feature: Ceres CLONE 1382342-F
  misc_feature (52)..(84): Pfam Name: Ank Pfam Description: Ankyrin repeat
  misc_feature (85)..(117): Pfam Name: Ank Pfam Description: Ankyrin repeat
  misc_feature: SWISSPROT Homolog: EC 2.4.2.30 NAD(+) ADP-ribosyltransferase
  misc_feature (154)..(154): Xaa is any aa, unknown, or other
  misc_feature (155)..(155): Xaa is any aa, unknown, or other
MGVELAQPTAAAAAVTTAEQAQDLIDAARYDDLEDVVALFSAGVSLDSTDSQGRTALHMASANGHLAVVEYLIQNGANVNATNMEKNTPLHWACLNGRIEVIRALISAGASVSALNSHEKTPMDEAVTTGKMHVIDAIGAAVAQAELNGVTVSXXELM

SEQ ID NO: 17416 - DNA, 579 bp, Zea mays
  misc_feature: Ceres CLONE 1382343-F
  misc_feature (191)..(191): n is a, c, t, g, unknown, or other
  misc_feature (209)..(209): n is a, c, t, g, unknown, or other
  misc_feature (387)..(387): n is a, c, t, g, unknown, or other
  misc_feature (511)..(511): n is a, c, t, g, unknown, or other
  misc_feature (533)..(533): n is a, c, t, g, unknown, or other
aaagctggagctccccgcggtggcggccgctctagaactagtggatcccccgggctgcaggaattcgcacgagaccattacctagaacatcctaatcgaaaaatcaccaccactggggtcttcagaccattagctttatctactccagagcgcagaagaacccgatcgacaccatgaaggtggttgctcgntagcctcgctctcctggntctcgctgcgagcgccacttcacgcatacaagcgggggttgcgggtggcagacaccggcggcaggtatcttacggcggcggtggatctggcacctcgggttactggcacttccgtggatttccaacggccggtcaactgcgccggcggtgcactgttaccgcgggtctgtgtgcgcgncggttatcttgctgcgccacatggtgctaccctaataatcgccgcggggtcatgatcatctcccaagccccccttgtcgtgtggaaagcgcattctaaccccgtcacatttaagaaactcgggngttgtgacacccccatactggncaaaggggccaaatttttaggattatagggaacccccaacggaaac

SEQ ID NO: 17417 - DNA, 628 bp, Zea mays
  misc_feature: Ceres CLONE 1382346-F
aagctggagctccccgcggtggcggccgctctagaactagtggatcccccgggctgcaggaattcgcacgagaccattacctagaacatcctaatcgaaaaatcaccaccactgggtcttcggaccattagctttatctactccagagcgtacaagaacccgatcgacaccatgagggtgttgctcgttgccctcgctctcctggatctcgctgcgagcgccacctccacgcatacaagcggcggctgcggctgccagccaccgccgccggttcatctaccgccgccggtgcatctgccacctccggatcacctggcacctccggtgcatctcccaccggcgggccacctgccgccgccggtccacctgccaccgccggtccatgtgccgccgccggttcatctgcagccgccacgatgccactaccctactcaagcgccccggactcagcctcatccccagccacacccatgcccgtgccaacagccgcatccaagcccgtgacagctgcagggaacctgcgccgttgacagcaccctgatcctgtgccagtgcgtcgagttcctgagggatcactgcagcccgacggtgacgccctactgctcgcctcagcgccagtcggtgcggc

SEQ ID NO: 17418 - DNA, 640 bp, Zea mays
  misc_feature: Ceres CLONE 1382351-F
  misc_feature: Encodes the peptide sequence at SEQ ID NO. 17419
  misc_feature (449)..(449): n is a, c, t, g, unknown, or other
  misc_feature (538)..(538): n is a, c, t, g, unknown, or other
tccccgcggtggcggccgctctagaactagtggatcccccgggctgcaggaattcgcacgagaccattacctagaacatcctaatcgaaaaattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctatattattaaccttggaaagacctgggacaagcttcagttggccgccagggtcatcgttgccattgagaatccgcaggacattatcgtgcagtctgctaggccctatggccagagggctgtcctcaagtttgcgcagtacactggtgcccatgccattgctggcaggcacactcctggtacattcaccaaccnagtgcaaacctccttcagtgagccacgccttcttatcctacttgaaccggaggactgatcacagccccattaaggagtctgcgcttggnaacattcccaccatcgcattcctgtgatactgactccctatgggctaagggtggaaatgggcattcccgcaataacaaggaacaaaaaattttgtgggtttt

SEQ ID NO: 17419 - protein, 134 aa, Zea mays
  misc_feature: Ceres CLONE 1382351-F
  misc_feature (23)..(134): Pfam Name: Ribosomal_S2 Pfam Description: Ribosomal protein S2
  misc_feature (116)..(116): Xaa is any aa, unknown, or other
MAAAPAGGGPRALSQREQDIQMMLAADVHLGTKNCDFQVERYVYKRRTDGIYIINLGKTWDKLQLAARVIVAIENPQDIIVQSARPYGQRAVLKFAQYTGAHAIAGRHTPGTFTNXVQTSFSEPRLLILLEPED

SEQ ID NO: 17420 - DNA, 632 bp, Zea mays
  misc_feature: Ceres CLONE 1382355-F
  misc_feature: Encodes the peptide sequence at SEQ ID NO. 17421
  misc_feature (211)..(211): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (233)..(233): n is a, c, t, g, unknown, or other
  misc_feature (234)..(234): n is a, c, t, g, unknown, or other
  misc_feature (263)..(263): n is a, c, t, g, unknown, or other
  misc_feature (326)..(326): n is a, c, t, g, unknown, or other
aaagctggagctccccgcggtggcggccgctctagaactagtggatcccccgggctgcaggaattcgcacgagaccattacctagaacatcctaatcgaaaaatggaatcctgtagcttccgtgccgcaaccgcgccttctccctttccctccgctccttcttcatcttcatccccgcgcgccccatgccccatactccgatttccccagncaagaannnaggagcagattgnngtgcggaagaaggcgtcccgaattgatgncttcgcgtctttccgccgcaaggtcttcgtggaatgagcgattggagcgaatatgggggaggncttcgaaacatttcgatgaatggacactccaaggtggaagtggattaactgtatgaaaaattggcagagtgcttccttcaagagataagcatgctatgaagcggatgaagggcgttggggctaaattttttccggggacaaaggtgattgctggatcagacctcctaaaagttgaatgcttggaacaactggcttttgggggaaaggtaggatatccccagggggggtcctgggcccgaaaacatatttactggggggggcggacaggcgttaaaaaaaaagaagtgttttcgggggaaaaaaaaa

SEQ ID NO: 17421 - protein, 65 aa, Zea mays
  misc_feature: Ceres CLONE 1382355-F
  misc_feature (37)..(37): Xaa is any aa, unknown, or other
  misc_feature (39)..(39): Xaa is any aa, unknown, or other
  misc_feature (40)..(40): Xaa is any aa, unknown, or other
  misc_feature (44)..(44): Xaa is any aa, unknown, or other
  misc_feature (54)..(54): Xaa is any aa, unknown, or other
MESCSFRAATAPSPFPSAPSSSSSPRAPCPILRFPQXRXXEQIXVRKKASRIDXFASFRRKVFVE

SEQ ID NO: 17422 - DNA, 630 bp, Zea mays
  misc_feature: Ceres CLONE 1382362-F
aaagctggagctccccgcggtggcggccgctctagaactagtggatcccccgggctgcaggaattcgcacgagaccattacctagaacatcctaatcgaaaaagccatctcctctccctcgttcaccacacagtccgccactcctttagttagcttgtgatttagtacgtctacgagatcactggtagatgtgtgggacgaccatatcatttcgaaggatagtgtggacgcatcatgccgttcgctcctcctgctcgccggctagctagctgtgctagcatccacaagacgaagcgaagtactcctcgctagaacgagaccgtctctagctacctgcgacgatgtcagcaagcgtgatagtgctagatacgcacactcctccccgcggaagagctaatgcaagaactagagccgccagagtactcaacaagctaactcgctcgagaatatggacatcgcctattacgactacgtctcccgctcgagaagttccgagagtcgcagccattgcatgttaccccacgaggatcagctatgttagacacagcagtgtatgatgtgcctccaaccttaacactgatcgtcgacatggagcaacagacggtctctgcattaaatcgcgctcagctc

SEQ ID NO: 17423 - DNA, 634 bp, Zea mays
  misc_feature: Ceres CLONE 1382369-F
  misc_feature: Encodes the peptide sequence at SEQ ID NO. 17424
  misc_feature (557)..(557): n is a, c, t, g, unknown, or other
  misc_feature (615)..(615): n is a, c, t, g, unknown, or other
  misc_feature (616)..(616): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
aagctggagctccccgcggtggcggccgctctagaactagtggatcccccgggctgcaggaattcgcacgagaccattacctagaacatcctaatcgaaaaaacggatagatacgcatcgaggcagagggcttggccgagatctccccactaccccgcagcgtctttaaaaccaggacctgcttgtttgattgtttcatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagacacntaacccccggcgtggcgaaaagggggcggagtctaaatttttcctgggtgccctgganncccnnnnnnnnnnnnnng

SEQ ID NO: 17424 - protein, 58 aa, Zea mays
  misc_feature: Ceres CLONE 1382369-F
  misc_feature (40)..(40): Xaa is any aa, unknown, or other
MAGIGRNMVAPLLVLNLIMYIIVIGFASWNLNHFINGQTXNPRRGEKGAESKFFLGAL

SEQ ID NO: 17425 - DNA, 657 bp, Zea mays
  misc_feature: Ceres CLONE 1382372-F
  misc_feature: Encodes the peptide sequence at SEQ ID NO. 17426
  misc_feature (355)..(355): n is a, c, t, g, unknown, or other
  misc_feature (445)..(445): n is a, c, t, g, unknown, or other
  misc_feature (482)..(482): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
tggagctccccgcggtggcggccgctctagaactagtggatcccccgggctgcaggaattcgcacgagaccattacctagaacatcctaatcgaaaaagagagagaaactcgaaggggagaggacagaagagggagatacaggttaatttttaggtaccagatcatctgatttctcagaagcaaaatgttgtttggagctcattaacaccatcctgtaatgcctgtgattttacgggaaatggaggatcattctgtccatcccatgtctaagtctaaccatggctccttgtcaggaaatggttacgagatgaaacattcaggccataaagtttgcgataggcattcatcatcggnagtctgatcggtctcaccaagaagcatcagcagcaagtgaaagcagtccaaatgaacacacatcaactcaatcagaacaatgatgaagantcatgggaaagataatcaggacacaatgaaagcagtnattgtccctggggggaaggaaggtcctgcctttttggccccaaaattaattacagcccatcttttgcttgattccttatactgtggtatatannnnnnggggggggggggggggggggttttgagagagtatatgcctcaacatggccattgtccatccccagcaaaatgaacaa

SEQ ID NO: 17426 - protein, 47 aa, Zea mays
  misc_feature: Ceres CLONE 1382372-F
  misc_feature (46)..(46): Xaa is any aa, unknown, or other
MPVILREMEDHSVHPMSKSNHGSLSGNGYEMKHSGHKVCDRHSSSXV

SEQ ID NO: 17427 - DNA, 639 bp, Zea mays
  misc_feature: Ceres CLONE 1382374-F
  misc_feature: Encodes the peptide sequence at SEQ ID NO. 17428
aagctggagctccccgcggtggcggccgctctagtactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcgtcaagtacgcggatgagctcatcaagaatgctgcctacatcggcacccctggaaagggtatccttgctgctgatgagtcaactggcaccattggcaagcgcctttccagaataaatggcgagaacgtggaggagaaccggcggactctccgtgagctcctgttctgctgccctggtgccctccagtacatcagcgatgtgatcctcttcgaggagaccctctaccagaagaccaaggatggctagccttttgtcgatgtcctcaaggagggaggcgtcctccctgccatcaaggtcgacaagggcaccattgaggttgttggcaccgaccaggagaccaccacccaggcccacgatgacctcggcaagcgctgcgctaagtactacgaggccggtgcccgctttgccaagtggcgtgctgttctccagatggcccccacga

SEQ ID NO: 17428 - protein, 86 aa, Zea mays
  misc_feature: Ceres CLONE 1382374-F
  misc_feature: SWISSPROT Homolog: EC 4.1.2.13 Fructose-bisphosphate aldolase
MSAYCVKYADELIKNAAYIGTPGKGILAADESTGTIGKRLSRINGENVEENRRTLRELLFCCPGALQYISDVILFEETLYQKTKDG

SEQ ID NO: 17429 - DNA, 666 bp, Zea mays
  misc_feature: Ceres CLONE 1382388-F
  misc_feature: Translation starting site: 469
  misc_feature: SWISSPROT Homolog: EC 6.3.2.19 Ubiquitin--protein ligase
  misc_feature (460)..(460): n is a, c, t, g, unknown, or other
  misc_feature (461)..(461): n is a, c, t, g, unknown, or other
  misc_feature (474)..(474): n is a, c, t, g, unknown, or other
  misc_feature (492)..(492): n is a, c, t, g, unknown, or other
  misc_feature (551)..(551): n is a, c, t, g, unknown, or other
  misc_feature (566)..(566): n is a, c, t, g, unknown, or other
  misc_feature (574)..(574): n is a, c, t, g, unknown, or other
  misc_feature (596)..(596): n is a, c, t, g, unknown, or other
  misc_feature (661)..(661): n is a, c, t, g, unknown, or other
aaagctggagctccccgcggtggcggccgctctagaactagtggatcccccgggcttgcaggaattcgcacgagaccatttacctagaacattcctaatcgaaaacccgatttccaagcttgcttctcgtccctagaaataaagcagcttcctccgcggggcggcgaactaactacccatcgccaaaaccctagccccgatccggtcgaggagcactaacttcttggcatggcgggcacccctagccaggcaagcctcctgcttccagaagcagcttcaaggatcttgcgaagaaccccgtggatgggttctccgcagggcttgtagacgatagcaacgtcttcgagtggcaggtcaccatcatcggcccgcccgacaccctatatgacggaggctacttcaatgcaataatgaccttcccccagaactatcccaacagcccgccatcagtaagatttannttctgggatgtgncatccgaatgtttatccnggaatgggcggtgtttgcatttctattcttcatccacctgtgagaaattcccaagtggnttatgagcttgcaangcgaacgntggacccagtgcaaacggttgnaaaaaagtaatagtttctgagcatcatttcaatgctctcctagtccggaatgacgagtctccagnaaaat

SEQ ID NO: 17430 - DNA, 652 bp, Zea mays
  misc_feature: Ceres CLONE 1382390-F
  misc_feature: Encodes the peptide sequence at SEQ ID NO. 17431
  misc_feature (480)..(480): n is a, c, t, g, unknown, or other
  misc_feature (569)..(569): n is a, c, t, g, unknown, or other
  misc_feature (587)..(587): n is a, c, t, g, unknown, or other
  misc_feature (590)..(590): n is a, c, t, g, unknown, or other
  misc_feature (591)..(591): n is a, c, t, g, unknown, or other
  misc_feature (594)..(594): n is a, c, t, g, unknown, or other
aaagctggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgacgcccgcgccgcagtcgacgcaggngctctccggggtttttttgcgacggcgaagcccgaagcaggcgcggacccatggtggcgcatcggtccccgcaggcggtcccccggggnttctgggggccgtgccanggnnccnaggggggggccgaaaaaataaggggccccccgcgtccccgaggggcccccccccgggt

SEQ ID NO: 17431 - protein, 93 aa, Zea mays
  misc_feature: Ceres CLONE 1382390-F
  misc_feature (36)..(36): Xaa is any aa, unknown, or other
  misc_feature (66)..(66): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
MTYVNPDPQPLAAATADDSATQHQAAVTPAPQSTQXLSGVFLRRRSPKQARTHGGASVPAGGPPGXLGAVPXXXGGGRKNKGPPASPRGPPPG

SEQ ID NO: 17432 - DNA, 640 bp, Zea mays
  misc_feature: Ceres CLONE 1382393-F
  misc_feature: Encodes the peptide sequence at SEQ ID NO. 17433
  misc_feature (352)..(352): n is a, c, t, g, unknown, or other
  misc_feature (389)..(389): n is a, c, t, g, unknown, or other
  misc_feature (452)..(452): n is a, c, t, g, unknown, or other
  misc_feature (472)..(472): n is a, c, t, g, unknown, or other
  misc_feature (483)..(483): n is a, c, t, g, unknown, or other
  misc_feature (599)..(599): n is a, c, t, g, unknown, or other
  misc_feature (600)..(600): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (615)..(615): n is a, c, t, g, unknown, or other
aaagctggagctccccgcggtggcggccgctctagaactagtggatcccccgggctgcaggaattcgcacgagaccattacctagaacatcctaatcgaaaaatatctctcgtctgcttctcactctcctcccacccactccagaaaacctcacaaaaaccctcgctccccacaacccgccgccgcccacgccgccgcctgtaccagcggcgtcaagatgagtcggcaccctgaagtgaagtgggctcagaggatcgacaaggtttacatcactgtacagttacctgatgccaaggacgctaaggtcaatttggaaccagatggtgtcttcacattctctggcagtgttggntacaacttatatgaattgaaactagatctgaatgacnaagtaaacgttgaggctagcaaaataagtgtgggtgtcaggtccatattctggattgtagaanaagctgaggccaaatggtgnaagaaaactgntcgagatgatcaaagggcacctcactttttgtgaaaagtgattgggacaaatgggttgacgaaaatgatgatgggtgctgatgtcaacttgggatggggatggacttctcgaattnntgcggatggnnnggnaattgggtgggcatggggggaaaaa

SEQ ID NO: 17433 - protein, 99 aa, Zea mays
  misc_feature: Ceres CLONE 1382393-F
  misc_feature (5)..(79): Pfam Name: CS Pfam Description: CS domain
  misc_feature (58)..(58): Xaa is any aa, unknown, or other
  misc_feature (79)..(79): Xaa is any aa, unknown, or other
  misc_feature (85)..(85): Xaa is any aa, unknown, or other
  misc_feature (89)..(89): Xaa is any aa, unknown, or other
MSRHPEVKWAQRIDKVYITVQLPDAKDAKVNLEPDGVFTFSGSVGYNLYELKLDLNDXVNVEASKISVGVRSIFWIVEXAEAKWXKKTXRDDQRAPHFL

SEQ ID NO: 17434 - DNA, 619 bp, Zea mays
  misc_feature: Ceres CLONE 1382401-F
  misc_feature: Encodes the peptide sequence at SEQ ID NO. 17435
  misc_feature (543)..(543): n is a, c, t, g, unknown, or other
aagctggagctccccgcggtggcggccgctctatcctagtggatcccccgggctgcaggaattcgcacgagaccattacctagaacatcctaatccaaaaacggtaaaggcacaacgaagaagagagatcaactactcatgcaagcactgcggtatttaatttaggttcttaggaacaaaaacaccaagcaccaactttgtacatattaatggacgccatgcacatggtgatcgatcggtctatatagaaagacaggcgggtactagagaggttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgctcccctacggcggctccagtcgcggacggagaggtgcaggtgcttgcctgccgccagcatctccaccgcttgccgaggcgtcaggatctccgtcgccagcgcccgcgccgtcgccatcctcagntcgtcggcctccaccagcagccgcgacagcgcggccttgtagctgtccagcgccgcgtccacctcgggggtccgcg

SEQ ID NO: 17435 - protein, 106 aa, Zea mays
  misc_feature: Ceres CLONE 1382401-F
  misc_feature (82)..(82): Xaa is any aa, unknown, or other
MLLTSCRQGRGMASLSCARADGVVRSGALPAKLLLCASCCSPTAAPVADGEVQVLACRQHLHRLPRRQDLRRQRPRRRHPQXVGLHQQPRQRGLVAVQRRVHLGGP

SEQ ID NO: 17436 - DNA, 628 bp, Zea mays
  misc_feature: Ceres CLONE 1382403-F
  misc_feature: Encodes the peptide sequence at SEQ ID NO. 17437
  misc_feature (528)..(528): n is a, c, t, g, unknown, or other
  misc_feature (565)..(565): n is a, c, t, g, unknown, or other
aaagctggagctccccgcggtggcggccgctctagaactagtggatcccccgggctgcaggaattcgcacgagaccattacctagaacatcctaatcgaaaaacccgaagcacatcccgtcgcatcccatcccactaccacccatctcgtcgtccgccgattcgatccggttcttccaacccaggggcagtgatggcgacgaagaggagcgtgggcaccctcggcgaggcggatctgaaggggaagaaggtgttcgtgcgcgccgaccctcacgtcccgctcgacgatgcccagaagatcaccgacgacacccgcatccgcgcctccgtccccaccatcaagttcctcctcgagaagggcgccaaggtcatcctcgccagccacctgggtcgtccaaaaggtgtcaccccaaagtacagcttgaagcctcttggtccacgcttgtctgagctccttggagttgaagtcgtgatggccaatgattgcattggtgaagaagttgagaaagtggctgccgctttgcagaangggtggagtctgctcctagagaatggtagattctacnaggagggaagagaagacgaacctgagtttgctaagaagctagcatctggtgctgacctttatg

SEQ ID NO: 17437 - protein, 145 aa, Zea mays
  misc_feature: Ceres CLONE 1382403-F
  misc_feature (3)..(145): Pfam Name: PGK Pfam Description: Phosphoglycerate kinase
  misc_feature: SWISSPROT Homolog: EC 2.7.2.3 Phosphoglycerate kinase
  misc_feature (112)..(112): Xaa is any aa, unknown, or other
  misc_feature (125)..(125): Xaa is any aa, unknown, or other
MATKRSVGTLGEADLKGKKVFVRADPHVPLDDAQKITDDTRIRASVPTIKFLLEKGAKVILASHLGRPKGVTPKYSLKPLGPRLSELLGVEVVMANDCIGEEVEKVAAALQXGWSLLLENGRFYXEGREDEPEFAKKLASGADLY

SEQ ID NO: 17438 - DNA, 631 bp, Zea mays
  misc_feature: Ceres CLONE 1382407-F
  misc_feature: Encodes the peptide sequence at SEQ ID NO. 17439
  misc_feature (453)..(453): n is a, c, t, g, unknown, or other
  misc_feature (490)..(490): n is a, c, t, g, unknown, or other
  misc_feature (524)..(524): n is a, c, t, g, unknown, or other
  misc_feature (614)..(614): n is a, c, t, g, unknown, or other
aaagctggagctccccgcggtggcggccgctctagaactagtggatcccccgggctgcaggaattcgcacgagaccattacctagaacatcctaatcgaaaaacagacaacaacgagttaacgaaagccttttatccaagctcagggaagggaagctcacagtttcgttggatccaatcttttatccaagctcagcgatggcttctcgtcagcagcatcctactagctaccacgccggcgagaccaaggcccgtgccgaggagaagacgggtcaagtgatgggggcgacgcaggagaaagggagggaggccaagcacaaggcgtccgacgcctccgaccgcgccatgggaatgggccacgacgccatggaggcgaccagggagaaggcgcgcgccgccgcggaccgaaccatggggatgggccacgacgccggggaggcggccaaggacaggncgtaccgggccaaggacgcggcctccggtgccgctgnccgcgccagggacactgcgtccgacgcgggcggngctggccgggaccgcgcccgcgacggcgcgcagcaaaccgggagctaactcccgcagacggccgaggcccccaggaaaaaagagggcggnagccgggctttaaacca

SEQ ID NO: 17439 - protein, 124 aa, Zea mays
  misc_feature: Ceres CLONE 1382407-F
  misc_feature (86)..(86): Xaa is any aa, unknown, or other
  misc_feature (98)..(98): Xaa is any aa, unknown, or other
MASRQQHPTSYHAGETKARAEEKTGQVMGATQEKGREAKHKASDASDRAMGMGHDAMEATREKARAAADRTMGMGHDAGEAAKDRXYRAKDAASGAAXRARDTASDAGGAGRDRARDGAQQTGS

SEQ ID NO: 17440 - DNA, 698 bp, Zea mays
  misc_feature: Ceres CLONE 1382408-F
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (38)..(38): n is a, c, t, g, unknown, or other
  misc_feature (42)..(42): n is a, c, t, g, unknown, or other
  misc_feature (59)..(59): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (423)..(423): n is a, c, t, g, unknown, or other
gggggggggggnnnnnnnnnnnggnnngggnnnngggngggnggggggggggggggggngggggnnnnnnnnnggnnnnncccaaagtggagctccccgcggtggcggccgctctagaatagtggatcccccgggctgcaggaattcgcacgagaccattacctagaacatcctaatcgaaaaaactacggccaccagtcttctcccactcccagtgccagccgccttgcgcttgccctctctgcgacgactgggtgcgccgccgccgccgctgtcctacgtcaggtgtcgaagccttcgccggcgaagagcgctcaccagattatccatctactagattcacccctgggtggaggaggagaagaagggtagcgaagatgctacggcggaacatacgtcagcgtcgggagtacctgtactccnagagcctcgagggcccccagcgggcgctgttcgagaagagcgccggatccgggcggcgctcgaggagggcaagccccatccccaccggagctcggcacgaggagcacgacctggcggaggcagatcggacctcgaggggacaggagcgtcaaggtccccaagaggatcggttgacaacggagtacgctactgccaccatttcgggaggcccagaaaactattgacccacttctcggaaatcctagcgcgccccttaacttcagttgggttagggg

SEQ ID NO: 17441 - DNA, 646 bp, Zea mays
  misc_feature: Ceres CLONE 1382412-F
  misc_feature: Encodes the peptide sequence at SEQ ID NO. 17442
  misc_feature (485)..(485): n is a, c, t, g, unknown, or other
  misc_feature (486)..(486): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (578)..(578): n is a, c, t, g, unknown, or other
  misc_feature (621)..(621): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatcctaatcgaaaaaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgccgcctccctcgaggagctctccgtcgcgggggcgcgcctctcctcgctcgcgggcctgccccgcctcccggcgctccggcgcctctccctccccgacaaccgcctctcgggggccgccgccctcgccgccgtcgccgaggcatgcggcgccacgctgcgccacctcgacctaaggaacaccgnnttcgcggaggtccaggagctcggcacctcgcccggggtccggggtcgagtcgctcgacctgttcccagtgcccgtcacannnggtcaagggntacaagggaaatgaggtcttcgcgctgatttcccagctcaggntaccctcgatgggcgctgacgctgn

SEQ ID NO: 17442 - protein, 153 aa, Zea mays
  misc_feature: Ceres CLONE 1382412-F
  misc_feature (114)..(114): Xaa is any aa, unknown, or other
  misc_feature (141)..(141): Xaa is any aa, unknown, or other
  misc_feature (142)..(142): Xaa is any aa, unknown, or other
  misc_feature (145)..(145): Xaa is any aa, unknown, or other
MAAAAAGEDDAAWERAISAATKSTSAPKTLTLDGAVKSSTGGLPSAALLERFAASLEELSVAGARLSSLAGLPRLPALRRLSLPDNRLSGAAALAAVAEACGATLRHLDLRNTXFAEVQELGTSPGVRGRVARPVPSARHXXSRXTREMRSSR

SEQ ID NO: 17443 - DNA, 613 bp, Zea mays
  misc_feature: Ceres CLONE 1382419-F
  misc_feature: Encodes the peptide sequence at SEQ ID NO. 17444
  misc_feature (360)..(360): n is a, c, t, g, unknown, or other
  misc_feature (387)..(387): n is a, c, t, g, unknown, or other
  misc_feature (403)..(403): n is a, c, t, g, unknown, or other
  misc_feature (579)..(579): n is a, c, t, g, unknown, or other
aaagctggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacngtctacttctgggaggccaaggggcangactcccgtgttcccntcggatctttggccacgaggctggaggatcatagagagtttgggaaaggggtgtgactgacgtagctccgggcgacatgtcccttcctgtgttcactggggagtggcaagagtgtgcccactgcaagtcggcagagagcaacatgtgtgatctgctcaggatcacaccggacgcgnttgggatgattgccgaggcaaagtcgcggttttt

SEQ ID NO: 17444 - protein, 75 aa, Zea mays
  misc_feature: Ceres CLONE 1382419-F
  misc_feature: SWISSPROT Homolog: EC 1.1.1.1 Alcohol dehydrogenase
  misc_feature (51)..(51): Xaa is any aa, unknown, or other
  misc_feature (60)..(60): Xaa is any aa, unknown, or other
  misc_feature (65)..(65): Xaa is any aa, unknown, or other
MATAGKVIKCKAAVAWEAGKPLSIEEVEVAPPQAMEVRVKILFTSLCHTDXLLLGGQGAXLPCSXRIFGHEAGGS

SEQ ID NO: 17445 - DNA, 710 bp, Zea mays
  misc_feature: Ceres CLONE 1382427-F
  misc_feature: Encodes the peptide sequence at SEQ ID NO. 17446
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (317)..(317): n is a, c, t, g, unknown, or other
  misc_feature (347)..(347): n is a, c, t, g, unknown, or other
  misc_feature (392)..(392): n is a, c, t, g, unknown, or other
  misc_feature (491)..(491): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnaaaaaaagagnnnnnnnnnnnnnnnnnnnnncccaagctggggctccccgcggtggcggccgctctagactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcngaccgtgaccgcagcggcatctacggcggncgccacgccacctacgggcagcagcagcagcagggaggaggcggncgccccatggggtgagcagtggaaggcatgctccacgacaaggggccgacgccgtcccagggggttgacgggggcgaccctgtttccccttgggccggnctgctgcctggggttttccgggctggcgcctaacagcctcccggggggggggttggcccgggcccccccccggggtttccggatttttaacccccgggtttgggcccccgcggggtggttattgggggaaggcggcccatgggggttcctcccccccgggggccgtgggggttccccgggggcctttctccccccccagggggcccgccacacaggggg

SEQ ID NO: 17446 - protein, 31 aa, Zea mays
  misc_feature: Ceres CLONE 1382427-F
MADRDRSGIYGGRHATYGQQQQQGGGGRPMG

SEQ ID NO: 17447 - DNA, 632 bp, Zea mays
  misc_feature: Ceres CLONE 1382434-F
  misc_feature: Translation starting site: 155
  misc_feature (427)..(427): n is a, c, t, g, unknown, or other
  misc_feature (582)..(582): n is a, c, t, g, unknown, or other
  misc_feature (632)..(632): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactaacgccgggtgtgggcagccgagcgccatgttccagccgctccggcaacagtgctgccagcagcngaatgaggatgatgggacgtgcagtccgtcgcgcagcagctgcagaatgatgatgcagcttgagcgtgccgctgccgccagcagcagcctgtacgagccagctctgatgcagcagcagcagcagctgctgggcagcccagggctcaccccatggnccatgaaggatggcgcagaaatgcccgggcccagtgggtgcactctaccn

SEQ ID NO: 17448 - DNA, 632 bp, Zea mays
  misc_feature: Ceres CLONE 1382438-F
  misc_feature: Encodes the peptide sequence at SEQ ID NO. 17449
  misc_feature (333)..(333): n is a, c, t, g, unknown, or other
  misc_feature (426)..(426): n is a, c, t, g, unknown, or other
  misc_feature (486)..(486): n is a, c, t, g, unknown, or other
  misc_feature (494)..(494): n is a, c, t, g, unknown, or other
  misc_feature (542)..(542): n is a, c, t, g, unknown, or other
  misc_feature (545)..(545): n is a, c, t, g, unknown, or other
  misc_feature (564)..(564): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaccaactgcaaccccaccccataccgccgccgcctccgctagggttttggagtgaggatcgccgatgtcgacggctcacaggcgccccttccgaggccgcggcgccccgccccctggcaccggctacgtccgccgcggccccgcccctgccccaggccccgccgacggcgccaagaccctgcgcaagcccgtcttcaccaccgtcgaccagctgcgcccccagacgcacggncacaccctcaccgcccgcgtcatctccgcccgcaccgtcctcgacaagccctccacgcacatcggccgcacccgcgtcgcagagtgcctcgtncgagacagcaccggcaccgtcctcgtcaccgcccgcaacgaacaggttgaccttctgaangcagatancacagtgatcttccgcaacgctaagattgacatgttcaaggtaccatngangctgggtgtgacaagtggngccggattgaggtgactcagcctgctgatttcaaggtgaaccagacacaacatgtccctggtggagtn

SEQ ID NO: 17449 - protein, 137 aa, Zea mays
  misc_feature: Ceres CLONE 1382438-F
  misc_feature (107)..(107): Xaa is any aa, unknown, or other
  misc_feature (110)..(110): Xaa is any aa, unknown, or other
  misc_feature (126)..(126): Xaa is any aa, unknown, or other
  misc_feature (127)..(127): Xaa is any aa, unknown, or other
MSTAHRRPFRGRGAPPPGTGYVRRGPAPAPGPADGAKTLRKPVFTTVDQLRPQTHGHTLTARVISARTVLDKPSTHIGRTRVAECLVRDSTGTVLVTARNEQVDLLXADXTVIFRNAKIDMFKVPXXLGVTSGAGLR

SEQ ID NO: 17450 - DNA, 635 bp, Zea mays
  misc_feature: Ceres CLONE 1382441-F
  misc_feature: Translation starting site: 472
  misc_feature (502)..(502): n is a, c, t, g, unknown, or other
  misc_feature (527)..(527): n is a, c, t, g, unknown, or other
  misc_feature (586)..(586): n is a, c, t, g, unknown, or other
  misc_feature (607)..(607): n is a, c, t, g, unknown, or other
aaagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtggcaacagccgcatccaagcccngtgcagctgcaggaaacctgcggcngtggcagcaccccgatccctgggcagtgcgtcgagttccctgagcatcagtgcagcccngacgcgacgccctactgctcngctcagtgccagtcgtttgcgcagcagt

SEQ ID NO: 17451 - DNA, 644 bp, Zea mays
  misc_feature: Ceres CLONE 1382447-F
  misc_feature: Encodes the peptide sequence at SEQ ID NO. 17452
aaagctggagctccccgcggtggcggccgctctattctagtggatcccccgggctgcaggaattcgcacgagaccattacctagaacatcctaatcgaaaagtcatcacaaactcactacacgatcggctatagcgagctaacagaagctctatcaagtactgtgtaggccatggccggagccctcgtcttcgtcgctgttctcctcgccgcaagcgtcggcgctacgacggctaccacgctgaccatccacaacctctgcccccacccggtgtggccgctggtgaccccgagctcgggcttcccctccatctccaccaacaccgcgcggctgggccccaacgcgctgctctccctctccttcccgcccaccttctgggccggccgcgtcgccgcgcgcacgggctgcgacgccgccgcgtccggctgctggacggtgaccacgccgcccgccaccgtcgtgcaggtcaccgtccacgacggcgggaacctggaccaggccacctacagcgtgtctctcgtccacggttcaacgtgcccatggtggtcagcccgcaagccgtcggcgggcgggaagtgcccggcgctcgggtgccccatcaatctccactgcgactgccctccccaagacccgaacggccgagg

SEQ ID NO: 17452 - protein, 157 aa, Zea mays
  misc_feature: Ceres CLONE 1382447-F
MAGALVFVAVLLAASVGATTATTLTIHNLCPHPVWPLVTPSSGFPSISTNTARLGPNALLSLSFPPTFWAGRVAARTGCDAAASGCWTVTTPPATVVQVTVHDGGNLDQATYSVSLVHGSTCPWWSARKPSAGGKCPALGCPINLHCDCPPQDPNGR

SEQ ID NO: 17453 - DNA, 573 bp, Zea mays
  misc_feature: Ceres CLONE 1382449-F
  misc_feature: Encodes the peptide sequence at SEQ ID NO. 17454
  misc_feature (234)..(234): n is a, c, t, g, unknown, or other
  misc_feature (235)..(235): n is a, c, t, g, unknown, or other
  misc_feature (315)..(315): n is a, c, t, g, unknown, or other
  misc_feature (546)..(546): n is a, c, t, g, unknown, or other
aaagctggagctccccgcggtggcggccgctctagaactagtggatcccccgggctgcaggaattcgcacgagaccattacctagaacatcctaatcgaaaaatgctcttcgccccctcgcgcttaccgctgccgcgcctcccgactcgccgcctccgcctagctccgggctctccaatggcctccatgctcgccatcctcaggccctcggcgccggccccgctcgcggggacnngccgggccaggggctggccgcgcccggcgaaccgcgaagggttgggcgcctatcctacccaggatctagggaatttcgtncaagccaggggggggccccttcggggttccccaaggttgcaaaggggggggccccaaaaagggtttttttttgcgcgaaaaaaaaaaaccccccccacccccggtttttttctcttttttcccccggggggggggggggggggcccccacaacaacccctttgtataaaaaagggggggggcaaaaaaaaaaaacccccccaaaagggggggggggtccccccccgggggnttttcaccaaccacaaaaaatgggtgg

SEQ ID NO: 17454 - protein, 126 aa, Zea mays
  misc_feature: Ceres CLONE 1382449-F
  misc_feature (45)..(45): Xaa is any aa, unknown, or other
MLFAPSRLPLPRLPTRRLRLAPGSPMASMLAILRPSAPAPLAGTXRARGWPRPANREGLGAYPTQDLGNFVQARGGPLRGSPRLQRGGPQKGFFFARKKKTPPTPGFFLFFPPGGGGGGPHNNPFV

SEQ ID NO: 17455 - DNA, 626 bp, Zea mays
  misc_feature: Ceres CLONE 1382454-F
  misc_feature: Translation starting site: 270
  misc_feature: Pfam Name: G-alpha Pfam Description: G-protein alpha subunit
  misc_feature (436)..(436): n is a, c, t, g, unknown, or other
aagctggagctccccgcggtggcggccgctctagaactagtggatcccccgggctgcaggaattcgcacgagaccattacctagaacatcctaatcgaaaatcactcgctctctcccctctggctctgagtggcgctagtgggcgaccgccgccgcgtccctccgtcaggtgcccaggtgtagcctcgtcagcccctccgtcaggtcttcgtcggccccctcgccgacgagcacccaccagccaggcatgagagcgcgcttctagaataatgtctgtgcttacctgcgtgattgaaagcatgggctcatcctgtagcagatcccattctttcgacgaggctgaagcagctgaaaatgcaaagtctgcagacattgaccgaaggatttttgcagaaaacaaagccgaaacacacatccacaagctcttacttctcgntgctggagaaatcggggagtctaccatattttaacaataaagcttcttttccaaactggctttgacgaagcaaagcttaggaggtacccatcaggcatccatgctatggggatcagacattaaaatatatatgagggagctaaagaagtagcccaggggaacagatccttcaaatattgcttacttccga

SEQ ID NO: 17456 - DNA, 855 bp, Zea mays
  misc_feature: Ceres CLONE 1382461-F
  misc_feature: Encodes the peptide sequence at SEQ ID NO. 17457
  misc_feature (71)..(71): n is a, c, t, g, unknown, or other
  misc_feature (72)..(72): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
gtgggttttgcacgcaacgggccgcccggagggggggaggggagccgcggaggggggagaaggccgggggnnttggannncccccaaagctggactccaccgcggtggcggccgctctataactagtggatcccccgggctgcaggaattcgcacgagaccattacctagaacatcctaatcgaaaaaatcaacccagccagcttctcaccatcgttcacctcacaccccaggactcccttaatctcttgggattggtacgtcgacaatatcactggtctatgggcggacgaccacccctggggaatgttcttgggctggcaccatcgtgcaagcgtttgcatatgggccggcgtcctgagggctacacgcatccacggcgcattaagggggagggaaaggggagaagggggacggcaaagtaaccacctccgtcccctgacaacccaaccaaccgcctattttctcaattcccgtaaagggccaggcggcggggcgaaggacccaaaagggcccaaaggggagggaacctttgaaagcgggacacgcgtgcaaaactcgcccgcctacggcgcaaggagggtgagtgaggggaggcgaggtgcgaagcaggtatcacccgcccccctccccccccgcgaaatgccctacaaacggccgccacccctcccccctcccccggcccccaccccccaacccccgccccccaccccctcccacccaccccccacactcgcgcgccggcgggccggcccggcccgcccctggctgccccccccccccccccaccacggcacacctgccacagcaccggccccccccgcccacccacccccgccgccccccccacgcgccg

SEQ ID NO: 17457 - protein, 183 aa, Zea mays
  misc_feature: Ceres CLONE 1382461-F
MFLGWHHRASVCIWAGVLRATRIHGALRGRERGEGGRQSNHLRPLTTQPTAYFLNSRKGPGGGAKDPKGPKGEGTFESGTRVQNSPAYGARRVSEGRRGAKQVSPAPLPPREMPYKRPPPLPPPPAPTPQPPPPTPSHPPPTLARRRAGPARPWLPPPPPHHGTPATAPAPPAHPPPPPPPRA

SEQ ID NO: 17458 - DNA, 779 bp, Zea mays
  misc_feature: Ceres CLONE 1382464-F
  misc_feature: Encodes the peptide sequence at SEQ ID NO. 17459
  misc_feature (67)..(67): n is a, c, t, g, unknown, or other
  misc_feature (82)..(82): n is a, c, t, g, unknown, or other
gggtttgtgcgtgccccccggggcgcggccgccgggggggggaggggggtcacgcaaataccggggngatggtggcccccancaccacgatcccggcggtggcggccgctctagactagtggatcccccgggctgcaggaattcgcacgagaccattacctagaacatcctaatcgaaaactccccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcggccgtccgccttgagctgtttacgcgtggatgggggcaacactggctgatttttatggtaatgttattgcaacctcgggttggggttatctacaaggaagcaaacctgggttagttcctgctgggggggggggttcctgtggttttgcttttggcaggggttggcacctttgggtttaattttggtacgaaacttccttgaaggaacattctggaggggtcatccccaaggaccttcttgaccctttatttttttcgggggagggtaaatcctttccccaagaaaaggggccctttagggtgggaaattgggaaagggtttatttttcacacttttttgggggaaaaattcctgggggttggggggggggcccaaaaaaatccgggggcctctcccgggggggggggcccccccttttttaagggagaaggaaattggtggcaaccccc

SEQ ID NO: 17459 - protein, 71 aa, Zea mays
  misc_feature: Ceres CLONE 1382464-F
MAAQGSLVMWRAVFAALGLLMVATLVYTLATDGSAVRLELFTRGWGQHWLIFMVMLLQPRVGVIYKEANLG

SEQ ID NO: 17460 - DNA, 732 bp, Zea mays
  misc_feature: Ceres CLONE 1382487-F
  misc_feature: Translation starting site: 346
  misc_feature (30)..(30): n is a, c, t, g, unknown, or other
  misc_feature (33)..(33): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (545)..(545): n is a, c, t, g, unknown, or other
ttttcccccccccctcccccccccattctnttntttattaagggnncnncccaaagctggagctccccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggnctcggcacctgcgtctacctctggtccgcgtccaatagcaaggtcaccaagctcctgcgatttggggcctagggacagcgtatgcgcagtgcattggtcacgggaaggctcttatctttccattggcccggcccttggagatgtccagaaattgggataagctctcgcttgtaagcgaattagaaaa

SEQ ID NO: 17461 - DNA, 660 bp, Zea mays
  misc_feature: Ceres CLONE 1382488-F
  misc_feature: Encodes the peptide sequence at SEQ ID NO. 17462
  misc_feature (461)..(461): n is a, c, t, g, unknown, or other
  misc_feature (466)..(466): n is a, c, t, g, unknown, or other
  misc_feature (467)..(467): n is a, c, t, g, unknown, or other
  misc_feature (479)..(479): n is a, c, t, g, unknown, or other
  misc_feature (501)..(501): n is a, c, t, g, unknown, or other
  misc_feature (506)..(506): n is a, c, t, g, unknown, or other
  misc_feature (520)..(520): n is a, c, t, g, unknown, or other
  misc_feature (534)..(534): n is a, c, t, g, unknown, or other
  misc_feature (535)..(535): n is a, c, t, g, unknown, or other
  misc_feature (540)..(540): n is a, c, t, g, unknown, or other
  misc_feature (578)..(578): n is a, c, t, g, unknown, or other
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaaacccccacgccccaccccaccaaacaatggcgccggcggcgacttccacagcctctgcgccctcctccttccactccactggtaggcatagggccagggtcggggcccggccatcgctcgtctctctccgcgtcagagcagccaatcccaacgttaccgccgatcccgcaccggccttccagtccgtcacggccttcgcgccagccaccgtcgccaacctcggcccgggcttcgacttcctcggatgcgccgtcgccgacgcctccctctccctgggtgacaccgtcaccgcaaccctggacccgtcactcccgcccggcacgtctcccatcgctcatcacatccccgtcccgccccaactcgncgagnngctctctagggnaccgctccgaactggcgcgggngtcgnccgcatcgccgcgntccgggccctcggnngtcgntcccaagcggggtcatccacctcaccagggcctgccgntccggttcgggttcggntcctccgggggctcgcccgcgcggcgcccaagggcggtgaagccccttttgggtcggggcccggc

SEQ ID NO: 17462 - protein, 179 aa, Zea mays
  misc_feature: Ceres CLONE 1382488-F
  misc_feature: SWISSPROT Homolog: EC 2.7.1.39 Homoserine kinase
  misc_feature (113)..(113): Xaa is any aa, unknown, or other
  misc_feature (115)..(115): Xaa is any aa, unknown, or other
  misc_feature (119)..(119): Xaa is any aa, unknown, or other
  misc_feature (128)..(128): Xaa is any aa, unknown, or other
  misc_feature (133)..(133): Xaa is any aa, unknown, or other
  misc_feature (138)..(138): Xaa is any aa, unknown, or other
  misc_feature (152)..(152): Xaa is any aa, unknown, or other
  misc_feature (158)..(158): Xaa is any aa, unknown, or other
MAPAATSTASAPSSFHSTGRHRARVGARPSLVSLRVRAANPNVTADPAPAFQSVTAFAPATVANLGPGFDFLGCAVADASLSLGDTVTATLDPSLPPGTSPIAHHIPVPPQLXEXLSRXPLRTGAGVXRIAAXRALGXRSQAGSSTSPGPAXPVRVRXLRGLARAAPKGGEAPFGSGPG

SEQ ID NO: 17463 - DNA, 714 bp, Zea mays
  misc_feature: Ceres CLONE 1382491-F
  misc_feature: Translation starting site: 188
  misc_feature (549)..(549): n is a, c, t, g, unknown, or other
  misc_feature (607)..(607): n is a, c, t, g, unknown, or other
tggagctccccgcggtggcggccgctctagaactagtggatcccccgggctgcaggaattcgcacgagaccattacctagaacatcctaatcgaaaactctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtaaatctgcctgcgggatcagctcctgcggcagctgctcctgcggatgaggctgaggacgatgatgaccttgatctttttgggtgatgaaactgaggaggacaagaaggcagctgatgagcgtgcccgcgctgccaagncctcttctaaaagaaagaaggtggtaatcctcccgtcctatggatgtcaaaccatggnacgatgaaactgatatgaaaagctgggagaggctgtccgcaatgtcaaaatggaaggtctgacttgggggcatcaaagctggtgccggttggatacggatcaaaaaa

SEQ ID NO: 17464 - DNA, 682 bp, Zea mays
  misc_feature: Ceres CLONE 1382493-F2
  misc_feature: Pfam Name: TolA Pfam Description: TolA protein
  misc_feature (459)..(459): n is a, c, t, g, unknown, or other
tggagctccccgcggtggcggccgctctagaactagtggatcccccgggctgcaggaattcgcacgagaccattacctagaacatcctaatcgaaaagctgaacaagcagcagtggaaagggctgctgctgaggctcgggaaagacaggctgctgctgcaagagataaaacgagcaaaccagatgatctagagtccttctttggtatgggtgctcgagctaatagtgctccgaagcaaagggctccgactgtggactctatgtttcattctcaaacgcaaaatagagggacttccacttcgacatcaatgaaaaaggcatcatcaacacaaatattgctgatgactggtctgcgatatttggaggagctcctacatcagaagaatttcaagaaatagatggggagagcgaagaaagaagacgcgctaggatggaacggcatcaaaaaactcgtgacgancgcaaagcttttgctgaaaaaatgaccccaactgcaccacaaggaagcaggctgaaaaattaggctggcggaaacctgcacttggaataagggcggggcggtggaaaaaaagcatttgggggcttggaaaaattttaaaaaagcctttggcaaaaggggggggaaaccgggccccccccgattttgacccgggcggggggttaaaaaggggcaaaaaaacccc

SEQ ID NO: 17465 - DNA, 682 bp, Zea mays; identical to SEQ ID NO: 17464
  misc_feature: Ceres CLONE 1382493-F
  misc_feature: Encodes the peptide sequence at SEQ ID NO. 17466
  misc_feature (459)..(459): n is a, c, t, g, unknown, or other

SEQ ID NO: 17466 - protein, 131 aa, Zea mays
  misc_feature: Ceres CLONE 1382493-F
GAPRGGGRSRTSGSPGLQEFARDHYLEHPNRKAEQAAVERAAAEARERQAAAARDKTSKPDDLESFFGMGARANSAPKQRAPTVDSMFHSQTQNRGTSTSTSMKKASSTQILLMTGLRYLEELLHQKNFKK

SEQ ID NO: 17467 - DNA, 675 bp, Zea mays
  misc_feature: Ceres CLONE 1382495-F
  misc_feature: Encodes the peptide sequence at SEQ ID NO. 17468
aagctggagctccccgcggtggcggccgctctagaactagtggatcccccgggctgcaggaattcgcacgagaccattacctagaacatcctaatcgaaaaaagtccggagcaagagcaaccaaccaaccacctcctcccctctccgtctcccagtccggcctcgctcgccactcggagtctcggagtcaaccgccagcgcctcgatccggcgaagccagcccagcccatggcctccggcgccgtaccaccgcagcgggtcgccctgctggcgctcgccgccgccctctccgtcgtctcattcccgcacctgtccctcctcgcctcgtcccatccgctcccgcaggaagctgctgctgctgctgcgggtgcggcggcgggaggcgaggcgtccgagcctcacggcaccgccgccgatggtgccgccgtggcgcggcgcgcgtgcacgtacacggtgcagatcaagacgagctgcgcgtccccgcggagctccgcggacgcgggaagcctcgcgttcggggacgcgtacccgcaacgaggtgaacgccggcgacggtgacgccgcggccgcgggttctcagggctgcgccccgggaaacgtttcggagtaaccaggaacctgcgggaaacgggagctccgacaactacaccctggtaccgcgacacttccctaacc

SEQ ID NO: 17468 - protein, 109 aa, Zea mays
  misc_feature: Ceres CLONE 1382495-F
MASGAVPPQRVALLALAAALSVVSFPHLSLLASSHPLPQEAAAAAAGAAAGGEASEPHGTAADGAAVARRACTYTVQIKTSCASPRSSADAGSLAFGDAYPQRGERRRR

SEQ ID NO: 17469 - DNA, 653 bp, Zea mays
  misc_feature: Ceres CLONE 1382501-F
  misc_feature: Encodes the peptide sequence at SEQ ID NO. 17470
tggagctccccgcggtggcggccgctctagaactagtggatcccccgggctgcaggaattcgcacgagaccattacctagaacatcctaatcgaaaactccccattgtttccatccgcaccggagggaggtccgatacaagcaacggcaaagactcccctctcctccacctccccacctatattgattctgattcatccacccagcaggcagcagctacagcaagatggtgcacccgatcgcggaggccgacgagcggagccccttcggccgcctgacgccggacgagttctacgcgcgccacggcgagacccactccgcctcgtccttcgtcaacccgcgggggctccgcatcttcacccagcgctgggtgcccagtggggacgcccccgtcctgggcgccgtcgccgtcgtgcacggcttcaccggagagtctagctggacaatccagctcaccgccgtccacctcgccgccgcgggattcgacgtcgccgaggtcgatgaccaggaccacggcttctccgagggcctccaggagcacctccgcgacatcaagcaccgtggtcgacgactgcgacgtcgccttcgtgtcgttacgcgccgactagccgacgccgctcccctgattccgctacggcgaggcggtcggagtag

SEQ ID NO: 17470 - protein, 142 aa, Zea mays
  misc_feature: Ceres CLONE 1382501-F
MVHPIAEADERSPFGRLTPDEFYARHGETHSASSFVNPRGLRIFTQRWVPSGDAPVLGAVAVVHGFTGESSWTIQLTAVHLAAAGFDVAEVDDQDHGFSEGLQEHLRDIKHRGRRLRRRLRVVTRRLADAAPLIPLRRGGRS

SEQ ID NO: 17471 - DNA, 640 bp, Zea mays
  misc_feature: Ceres CLONE 1382503-F
  misc_feature: Encodes the peptide sequence at SEQ ID NO. 17472
tggagctccccgcggtggcggccgctctagaactagtggatcccccgggctgcaggaattcgcacgagaccattacctagaacatcctaatcgaaaactcttcttttccccctcctcccgctgccctcggctcccacgacgcccggctagggttttgcctccttcccgctgccgccgtctcagcgagcgagactgagctgtgcttagtaagccatgtcgctgcgcccgagcgagcgggtcgaggtgcggcggaaccgctacaaggtggcggttgacgcggaggaggggcggcggcggcgcgaggacaatatggtggagatccgcaagagccgccgcgaggagagccttctcaagaggcgccgcgaggggctccaggcccaggtccctgcccctccctcgggggtcgagaagaagcttgaaagcctcccagctatggtgcagtggggtttattcggatgacaataaccttcagcttgaggccaccacacagtgtcgcaagttgctatcctatagagaggagccctcccattgaagaagtatcaagtcaggtgtagttccagtatttgtgcagtgctcacaagagaggatttgtcccagctgcagatcgaagcagcatgggctctcaccattattgcttctg

SEQ ID NO: 17472 - protein, 81 aa, Zea mays
  misc_feature: Ceres CLONE 1382503-F
  misc_feature (4)..(76): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVQWGLFG

SEQ ID NO: 17473 - DNA, 632 bp, Zea mays
  misc_feature: Ceres CLONE 1382507-F
  misc_feature: Translation starting site: 232
  misc_feature (162)..(162): n is a, c, t, g, unknown, or other
  misc_feature (333)..(333): n is a, c, t, g, unknown, or other
  misc_feature (428)..(428): n is a, c, t, g, unknown, or other
  misc_feature (475)..(475): n is a, c, t, g, unknown, or other
aaagctggagctccccgcggtggcggccgctctagaactagtggatcccccgggctgcaggaattcgcacgagaccattacctagaacatcctaatcgaaaaaccctacactgagaaccgcagagacaggcgtcttcgtactcgcctatctccgcgactcanagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcaggctgatggncagatggccggtggacagacattggggggagtgatgatgctttcaacaccttcctcagtgagactggcgctgggaagcacgcccccgtgcctggntttggtgaacttgaggccactggcatcgatgaggtgtaggaatgggnaactaacggcaggtcttccattctgaggaggtcatcagggggaagggaggatggaggcaacactttcgctcggggtcactacacattgggaaagaggaattggtgaaccggggccctgaaccgcatcaaggagcttggagataaattggactgggcc

SEQ ID NO: 17474 - DNA, 725 bp, Zea mays
  misc_feature: Ceres CLONE 1382510-F
  misc_feature: Encodes the peptide sequence at SEQ ID NO. 17475
  misc_feature (469)..(469): n is a, c, t, g, unknown, or other
  misc_feature (619)..(619): n is a, c, t, g, unknown, or other
  misc_feature (710)..(710): n is a, c, t, g, unknown, or other
tccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcggtcgaggacggcgacaggcggcgtggacgcctacgtctcccgctcggnaaagggggcgaagtggccggcgccagtgcctgcgcccgccacgagggccaggccgtgggagaacccaggagggccattgagggcggtgccgccgccgccggactggccgtcgacatgaggcaaaagagtaccggtcgcggcagcgagagncgcgggcaaggtccccggaaagaggtgcgagcgccccaccgcgggggaaatggggggggaagaaggcagcgctgcctgagatgaaaaaaancccgcggcgggggca

SEQ ID NO: 17475 - protein, 169 aa, Zea mays
  misc_feature: Ceres CLONE 1382510-F
  misc_feature (142)..(142): Xaa is any aa, unknown, or other
MGKGSVGASWWAFLLLAGVLLVVAATAGAEDGVVERDRKEDLRWCKQACEWQYGKDTPRKRECESECRERHQQADAVEDGDRRRGRLRLPLGKGGEVAGASACARHEGQAVGEPRRAIEGGAAAAGLAVDMRQKSTGRGSEXRGQGPRKEVRAPHRGGNGGGRRQRCLR

SEQ ID NO: 17476 - DNA, 712 bp, Zea mays
  misc_feature: Ceres CLONE 1382515-F
  misc_feature: Encodes the peptide sequence at SEQ ID NO. 17477
  misc_feature (712)..(712): n is a, c, t, g, unknown, or other
tggagctccccgcggtggcggccgctctagaactagtggatcccccgggctgcaggaattcgcacgagaccattacctagaacatcctaatcgaaaagtgttacctcacccatacatggcaccatctactgcttccctatcccccgcctgctgtgttcactaacccacctccgtcccccgttgcgggtccccctccccgtcagaaggttccccagatttatagcccggagtagcggcggcgacggggcatgcgctcggagcccaaaccagcttacaacgagagcaaggccatccctgatgccttcttccttgagaaggcctccgcggaggcgttcacggagcgagtcgagtcggtattggcctagtgggcgaggtattcaacatcgtcaggcagtggcaaactcagcagcagaagcaggtctaggagttccagaagtagcaaagttttattatttcctggctggagagcagtttacatgaaaagataattgaggcatgcaacaaccttattgcaaagctcaagtaagtgaggtagtcacgaatggctcagttgatgaattccctgaatcacatttcccatatggctcggaacaacggttgggtggaaatgccccactggagtatgcaagctttacaataagatttggctcattgaatgtgaccccatgctttactcggtcaccaaacatcttgaagcaaagctcagcggagn

SEQ ID NO: 17477 - protein, 38 aa, Zea mays; identical to SEQ ID NO: 17402
  misc_feature: Ceres CLONE 1382515-F

SEQ ID NO: 17478 - DNA, 766 bp, Zea mays
  misc_feature: Ceres CLONE 1382518-F
  misc_feature: Encodes the peptide sequence at SEQ ID NO. 17479
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (15)..(15): n is a, c, t, g, unknown, or other
  misc_feature (18)..(18): n is a, c, t, g, unknown, or other
  misc_feature (39)..(39): n is a, c, t, g, unknown, or other
nnnnnccccccccnnccnccccacccccccccccccccncccccccccccggcgatagctggtgctccccgcggtggcggccgctctagaactagtggatcccccgggctgcaggaattcgcacgagaccattacctagaacatcctaatcgaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagccaggcgctgagtttcctaatgccgcccgctggtacgagaccgtctctgcggctgtagcctcaagattccctggcaaggctgttgctgtaaatctggctgcgggaatcagctcctggcggagctgctcctgcggatgacgctgaggccaatgatgacccttgatcttttttggggtgaaactgaggagcccaagaacgcagttgatggaacgcgccgcccgctgccaaggccctcttcttaaaaaagaaaggaaagggggtaaatcccctccgctcccttaaggaattgcccaaaccccagggcgcacatcggagacctcgctcattgaccgcaaaccttggcgccgggtgggtttttctttcctacagttgattccccaacc

SEQ ID NO: 17479 - protein, 90 aa, Zea mays
  misc_feature: Ceres CLONE 1382518-F
MAVFSDLHTADGLKSLEAHLAGKTYVSGDSITKDDIKVFAAVPSKPGAEFPNAARWYETVSAAVASRFPGKAVAVNLAAGISSWRSCSCG

SEQ ID NO: 17480 - DNA, 849 bp, Zea mays
  misc_feature: Ceres CLONE 1382520-F
  misc_feature: Encodes the peptide sequence at SEQ ID NO. 17481
  misc_feature (20)..(20): n is a, c, t, g, unknown, or other
tgcccccttcccccccccgngtgggtgttacttttttttttaccaacacaaagctggagctccccgcggtggcggccgctctttcaatagtggatcccccgggctgcaggaattcgcacgagaccattacctagaacatcctaatcgaaaagtgcgtgccagtcctccggctcaacccccccgcacccaacccccagccccggttaacgatggtggggtccgcgcccgacccggatcacgagcaaaagcgggcaccagcggcggtgtacgactacaagggcgacgcgcgctggggagagtactgcacgaaaggactcgtaccgccagacctcgcctcccgccccgacgtcggacaaacactttgaacgaaaggtatagcatgggataataagacatggagccggtccggcgacgacaaggtccgttccacagggtgccacccctcgctcataaggccaatatgccaacgctctttgctcctacacccctcccccctccccaaccccccccccgcgcccgcagctctcccgcaatcccaccagtcgaaagcccaaatataccatctccctacttccagcgccagattgacatagtcgacgacaagtggtccaatacccacccccttatcaccaccacctggacaggcacttcctctgcgtaaactactactcttcctgtctgtccttccgaccaacctcgccccacgagctcgacgacgagtcgtatagacagtacaatatgagatcggagcgccctcccccccgccccaccgcaacccccccaccacccgtgctccagtaattgatatatgagcccaactgcgttctctttcctaaaatggttttgccc

SEQ ID NO: 17481 - protein, 51 aa, Zea mays
  misc_feature: Ceres CLONE 1382520-F
MVGSAPDPDHEQKRAPAAVYDYKGDARWGEYCTKGLVPPDLASRPDVGQTL

SEQ ID NO: 17482 - DNA, 714 bp, Zea mays
  misc_feature: Ceres CLONE 1382528-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (41)..(41): n is a, c, t, g, unknown, or other
  misc_feature (45)..(45): n is a, c, t, g, unknown, or other
  misc_feature (46)..(46): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnnnnnnnnnnnnnnnnnnnaaccacccccccccccccnattnnatnnntatatggagaggacccgagcaagccgcaagctggagatccccgcggtggcggccgctctagaactagtggatcccccgggctgcaggaattcgcacgagaccattacctagaacatcctaatcgaaaaatctccagcggcttcttccaaagctccaactccgacgagaaccgccactcctcgaaatctcgaaggattttctgcgggcgaaacccctttcgtgacggtgaacccaatgggagagggcctccgccggtccaatcggccaagggaccggcaacccgaggttggatccgggaaaacacccgcccggctggggggaaccccccaaccaagggggccccgattggggggggggttccggcccggggtcccccccccccaaaagtcccagggccccatggggaaaggccccggggtgtcccccaggggtggataaacgggcataaaagaggggaatgtggggggacaacacccccccggggggtaaacacgggcggggcgaccaaatagaggggaaaaaaaaagggggggccgcgcgaaaaaataataccccccaaagaggagggagaaaaaaaggccacatcctctaggtagtgcgggtggctcccccaccccgttgtgggcgggggggtgtatagaacaaataggggggggtgtggtg

SEQ ID NO: 17483 - DNA, 622 bp, Zea mays
  misc_feature: Ceres CLONE 1382533-F
  misc_feature (293)..(293): n is a, c, t, g, unknown, or other
tggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccgtnggcggaggacggagtggtcgaacggggaccgcaaggatggacctgcggtgggtgcaaaacacaagtctttgggaaggggaaaaacgaagacccccccgaaaaggaaaggaaaaaaagggcccaggggccccaaatttaccggggaaaacgcaaacgggggggaccccaccccccctcccgagggggagagggggcaaaattcggccccccaaagagaaccggggaaaaaaaattttttaggggggccccccccccttttttccccaatataaaaaaaaaaaacccccccaaaaaaaaatggcctctttcccccaaaaagggggcccccc

SEQ ID NO: 17484 - DNA, 752 bp, Zea mays
  misc_feature: Ceres CLONE 1382539-F
  misc_feature (614)..(614): n is a, c, t, g, unknown, or other
  misc_feature (674)..(674): n is a, c, t, g, unknown, or other
  misc_feature (737)..(737): n is a, c, t, g, unknown, or other
aagctggagctccccgcggtggcggccgctctagaactagtggatcccccgggctgcaggaattcgcacgagaccattacctagaacatcctaatcgaaaaaacaacggtcaagggcctagctatttgttaactctggcccctcacctgctccccttctgtccagcccacgggagggcgactagggttaggggcgaccggaggtccccgcgcctgcccaaatccacccatcccttccgttcaagccgccggagctcccaggccgctggtgtcgaagccgtcgccccttccttccaggcccgcctcctctctgtccgttctgtcttggtcgccgaagctcaagaccacagtgtcaggaagttctccaatcttccagccaaacacaattcatcagtcagatacactttgaccgaggaattattcagaatcactccacgagaggatcagctttcgaagctagagaagcagagctctaccaaacaggccaggacgtctctcaaatccccagttcagtaactggctaactggtaggagaaggagagagagatggagaacggcgggcttaaaaggcgacgtccccgacgatgcgaacgagcattgccctggaaacagtcntgaggaggcaggcaaggcagatgccttgcgctgggtgcccaaccagcaatttgcgcccgnccccagggctgaatttcccccaatgggtgttttttttttgtagaaggttgctatggaaacaantttttttgagttttg

SEQ ID NO: 17485 - DNA, 601 bp, Zea mays
  misc_feature: Ceres CLONE 1382542-F
  misc_feature (230)..(230): n is a, c, t, g, unknown, or other
  misc_feature (237)..(237): n is a, c, t, g, unknown, or other
  misc_feature (240)..(240): n is a, c, t, g, unknown, or other
  misc_feature (241)..(241): n is a, c, t, g, unknown, or other
  misc_feature (252)..(252): n is a, c, t, g, unknown, or other
  misc_feature (284)..(284): n is a, c, t, g, unknown, or other
aaagctggagctccccgcggtggcggccgctttagaactagtggatcccccgggctgcaggaattcgcacgagaccattacctagaacatcctaatcgaaaaaattcgccttcacctcgccgcttcctccttgaccgccaccgttgacgtcgtcttccggcgaggtagctcgccggaagacctcacctggacttttccgacgcaccctccacacactctttaaccctccnggatggncgnnctgcttctagnctcgtcgacgcccccattctccgcttgcttcntcgacagccccatcccggctctttctcgttctcggtaaagggtccccctggccggttcgccatgggatccggatcacggtttcctactcgggttagggggggaggaactcgccggggtggtgggccaccggttttcctccgcttccgcttcggggagccgctccctccatgaagggggcggggggcccttttggatttttcccccccccccccagcccaaaaaaaccccgggaaagggaaaagaccccccttaaggggggggtatataaccccccgaaacccccgggcttttcgccgggggattctctttttgtggg

SEQ ID NO: 17486 - DNA, 448 bp, Zea mays
  misc_feature: Ceres CLONE 1382543-F
  misc_feature: Translation starting site: 173
  misc_feature: SWISSPROT Homolog: EC 4.1.2.13 Fructose-bisphosphate aldolase
aagtggagtccccgcggggggcgctctagaatagggatcccccgggctgcaggaatcgcacgagaccattacctagaacatcctaatcgaaaaaagattccccgtttgccttgttaccattcctccccaaaacacatcctgcgatcctcgaagcctccgccgagcatcgatcatgtcggcctactgcgacaagtacgcggatgagctcatcaagaatgctgcctacatcggcacccctgacaggatatccttgctgctgatgagtcaactggcaccattggcaagcgcctttcagcatcaatgccagaacgggaggaaaacggggggcctctccggtgaagctcctgtctgtgcctgaggccctcagtactcgcgcgtgatccccgttcgagagaccctctaccagaaacccaagatggaagccctttttggcgaggccctcaaggac

SEQ ID NO: 17487 - DNA, 868 bp, Zea mays
  misc_feature: Ceres CLONE 1382548-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (32)..(32): n is a, c, t, g, unknown, or other
  misc_feature (35)..(35): n is a, c, t, g, unknown, or other
  misc_feature (46)..(46): n is a, c, t, g, unknown, or other
nnnnnnnnnnnnnnnnaaaaggccaacaacancgnaacgcaacccntcaaagctggagctccccgcggtggcggccgctctagaactagtggatcccccgggctgcaggaattcgcacgagaccattacctagaacatcctaatcgaaaaatccattggtgtggacgtgtcacgtgtggtggttgcgttgcggggccccgatttcgagcgggtgttcaattttggtgccggatttttaaggaggatccaatttaggaagaattttggttttggggacaatggttttggactgcctgatattcgattcataggttggtcaaacgctttggagcaaagaatttttttcccggaaaagaagagccatttttctagttgtgctactcgtcaatcaatccagtggaagctgaacttctggaagaataaactttccctaattaaactccggttattttcgggtcttgggccggttgggtgccctaaaagctctaatcttactttggtgcccggctgtgacgcgttaagatccggggggcttacgttctaacccggggtctgcacccccgcccacgcagcattttgctcccgttgcgagaagtaaaattgaggtcgaccgcgggcctgcccccctccccctcccccctcctcccacgcccatcctccacccagccacacgccgacaatacaaccgccgcttacccgatactccatagcactctactacaacaccacacctgagcccgttcctaacacttacacacaactcatagacgagaagctgacagcgaacacgcacagaaaccctaccacagctcatcacaatccctatacacaaccataataacacctacactaaaccaatagcagtccc

SEQ ID NO: 17488 - DNA, 743 bp, Zea mays
  misc_feature: Ceres CLONE 1382550-F
  misc_feature: Encodes the peptide sequence at SEQ ID NO. 17489
  misc_feature (695)..(695): n is a, c, t, g, unknown, or other
  misc_feature (743)..(743): n is a, c, t, g, unknown, or other
aagctggagctccccgcggtggcggccgctctagaactagtggatcccccgggctgcaggaattcgcacgagaccattacctagaacatcctaatcgaaaactcggctcatctcatttttctatttcggcccctctactgttccaataataaaaaaaagattctcgattccatttactcgccaattttcagggagcggcggagatcggcttcggatcggcgcagcgcggcggagcggagatggttgccgtggcggaggatggcctgatccgcggtgcggacgccgtgccggcggcggatagggaagcggtgagggcggcagctgcggaggcggcggccaagggcggtgagggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcgggcgacgcgcccgtgttcgtgtcgccggcgatcgactactacgcgcgccaccaccagctcccgccgccgcagcttctgcagcagcagcagccgatgcacgtgctgcagattgtggatggcgtccgcgttgttgacatgagtgacggcgcacgtatgtactccagcagcgacggatccgccaatggtcatgcgaatcgacgntagaagtgacggtttcatccagtagaagagaaaggatgatgggtgccn

SEQ ID NO: 17489 - protein, 152 aa, Zea mays
  misc_feature: Ceres CLONE 1382550-F
  misc_feature (57)..(74): Pfam Name: PAM2 Pfam Description: Ataxin-2 C-terminal region
MVAVAEDGLIRGADAVPAADREAVRAAAAEAAAKGGEGESGKEEVREYESDMRKLEELLSKLNPSAEEFVPQSRRRVDGGAPRLSGDAPVFVSPAIDYYARHHQLPPPQLLQQQQPMHVLQIVDGVRVVDMSDGARMYSSSDGSANGHANRR

SEQ ID NO: 17490 - DNA, 598 bp, Zea mays
  misc_feature: Ceres CLONE 1382558-F
  misc_feature: Translation starting site: 181
  misc_feature (218)..(218): n is a, c, t, g, unknown, or other
  misc_feature (219)..(219): n is a, c, t, g, unknown, or other
  misc_feature (242)..(242): n is a, c, t, g, unknown, or other
  misc_feature (243)..(243): n is a, c, t, g, unknown, or other
  misc_feature (245)..(245): n is a, c, t, g, unknown, or other
  misc_feature (248)..(248): n is a, c, t, g, unknown, or other
  misc_feature (296)..(296): n is a, c, t, g, unknown, or other
  misc_feature (314)..(314): n is a, c, t, g, unknown, or other
  misc_feature (329)..(329): n is a, c, t, g, unknown, or other
  misc_feature (330)..(330): n is a, c, t, g, unknown, or other
  misc_feature (352)..(352): n is a, c, t, g, unknown, or other
  misc_feature (381)..(381): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (465)..(465): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (547)..(547): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
aagctggagctccccgcggtggcggccgctctagaactagtggatcccccgggctgcaggaattcgcacgagaccatacctagaacatcctaatcgaaaaactcgtagctcaagcatcagcggcaggagctctgggcagcgtgcgcacgtggggtacctagctcgctctgctagcctaccatggctgatcaccaccggggcgcgacgggaggtggcgnnggctacggcgacctccagcgcgnngncgncatgcacggcgaggcgcagcagcagcagaagcagggcgccatgatgancgcgctcagggccgcgancggcgcgaccctcgnngggtcgatgctgttgctgtccnggctgatcctggccgggacgggatcgcgntcacgtgggcacccccggggctgtgatctcagccggggggggggggcccggnnnnnnnnnnnngggnnnnnnngnngggggggngggnnnnnngggggggggggggnnnnnnnnnnnnnnngnnnnnnnngnnnnnnnnnnnnnnggggnnnnnnnnnnngnnngngnnnnnnnnnnngggnnnnnnnnnnnnnnngnnnnnngnnnnnnngnnnng

SEQ ID NO: 17491 - DNA, 677 bp, Zea mays
  misc_feature: Ceres CLONE 1382561-F
  misc_feature (351)..(351): n is a, c, t, g, unknown, or other
  misc_feature (411)..(411): n is a, c, t, g, unknown, or other
  misc_feature (417)..(417): n is a, c, t, g, unknown, or other
  misc_feature (431)..(431): n is a, c, t, g, unknown, or other
  misc_feature (443)..(443): n is a, c, t, g, unknown, or other
  misc_feature (564)..(564): n is a, c, t, g, unknown, or other
atagctggagctccccgcggtggcggccgctctagaactagtggatcccccgggctgcaggaattcgcacgagaccattacctagaacatcctaatcgaaaaatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaaagattgcagatttgagttatagtccaagaaacgggtggtggtccgccatgggaggtgaggtccgagcaagggctgnatggcggggagggatctattcggtatgccaaagagcccgccgggcgcccggtttccgggnccgccnggcgtccgccgccnatgcagagcgtngcgcatggcgtacacctcggaccggcaccgctgtgttccgctccgatgagatcctcggcccgcgacgccgtcttaccagccgcagggtgcagcccacggcgctagcatgtccgcggcgacnatcattggagggaatggcgcggcagctgcgccgagcatgggggaagcggtgcccaaaaagaagcgcgggcgaccaaggaagatgggtccgacgtgtcctggcgctggcattgg

SEQ ID NO: 17492 - DNA, 713 bp, Zea mays
  misc_feature: Ceres CLONE 1382562-F
  misc_feature: Encodes the peptide sequence at SEQ ID NO. 17493
  misc_feature (700)..(700): n is a, c, t, g, unknown, or other
gctctagaactagtggatcccccgggctgcaggaattcgcacgagaccattacctagaacatcctaatcgaaaaataaacaactcgaccaaacccaagtccagacccgcagctcccgtcagccgccggaggcggagggaaccgagccggcgaccggcagaccgcagagaagaggccagaagccgaccgcaggcagccgccaccgcaccaaaacccgaggtctcgaggcaatcgagcgcgcgcgggtcgggggctgcggccatgtcggtgagttgcgggctcgagtgggtggtgtgccttggctgcacgcggtgggcgtggaagcggctcacctacatcggcgcctacgacagcgagacgtggccgccggcgtccgccgacgagttcgagcccgtcccgcgcctctgccgcgccgtgctcgcgaactacgacgaggagctctccagccccaagttcgcgccgccggagcacggctacttcgacatcgaccccaagggcatcctcaagcgggctacctacaaggaggtcggcaacgcgtgcccgccgtacctcgtctacgtcgacgaggggcacaaggagatcatcctcgccgtgcgcggcctcaacctcgtgcgcacgccgactacaaggtgctcatggacacaagctcggggatgcagatggtcgacgggcggctacgtgcaccacggcctgctcatggncgcaattcatccc

SEQ ID NO: 17493 - protein, 151 aa, Zea mays
  misc_feature: Ceres CLONE 1382562-F
  misc_feature (6)..(74): Pfam Name: Lipase3_N Pfam Description: Lipase 3 N-terminal region
  misc_feature (147)..(147): Xaa is any aa, unknown, or other
MSVSCGLEWVVCLGCTRWAWKRLTYIGAYDSETWPPASADEFEPVPRLCRAVLANYDEELSSPKFAPPEHGYFDIDPKGILKRATYKEVGNACPPYLVYVDEGHKEIILAVRGLNLVRTPTTRCSWTQARGCRWSTGGYVHHGLLMXAIHP

SEQ ID NO: 17494 - DNA, 572 bp, Zea mays
  misc_feature: Ceres CLONE 1382566-F
  misc_feature (276)..(276): n is a, c, t, g, unknown, or other
  misc_feature (277)..(277): n is a, c, t, g, unknown, or other
  misc_feature (310)..(310): n is a, c, t, g, unknown, or other
  misc_feature (316)..(316): n is a, c, t, g, unknown, or other
  misc_feature (327)..(327): n is a, c, t, g, unknown, or other
tccccgcggtggcggccgctctagaactagtggatcccccgggctgcaggaattcgcacgagaccattacctagaacatcctaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgnncggtgcatctggcacctccggttcacctgccanctccgntggatctcccnaaccggcgggtccactggcgccgccgggtccccctggccccgccgggtcatggggccccccccgtttttttggccggcgcccagtggcattacccttttttagcggcccggggttttgattttttcccccgggaaaccccgtggggggggggggaaaaaaggcgctttaaaaaaccccgggtgtattttggggggaaaaaacccggggggggggtgaggaaccccccccctctgggggggggggg

SEQ ID NO: 17495 - DNA, 656 bp, Zea mays
  misc_feature: Ceres CLONE 1382569-F
  misc_feature: Encodes the peptide sequence at SEQ ID NO. 17496
tggagctccccgcggtggcggccgctctagaactagtggatcccccgggctgcaggaattcgcacgagaccattacctagaacatcctaatcgaaaaccccggcccggtccggcctaaacacgcattcttccttctcccaacgacggaagaaacttcctgcctggatatccatccatccaaccgctcctccctcgtccggcaggcgacgactcgattccttcctcccttcctcctcctcgtctctttcatcggcgactccgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatgttcccagcgcgggagtacaagctcgtcgttgtggggctcgacaacgcggggaagaccaccacgctctacaagctccacctcggcgaggacgtcaccgccgcgcccaccatggcagcaacggtggaggaggtcgtcttcaagaactggcgcttcgaaggtctgggaatctaaggagggcaagaaagcctgcgcactcccttgggcgacgtactaccggag

SEQ ID NO: 17496 - protein, 68 aa, Zea mays
  misc_feature: Ceres CLONE 1382569-F
MGAWMSRVWFLMFPAREYKLVVVGLDNAGKTTTLYKLHLGEDVTAAPTMAATVEEVVFKNWRFEGLGI

SEQ ID NO: 17497 - DNA, 794 bp, Zea mays
  misc_feature: Ceres CLONE 1382571-R
  misc_feature (16)..(16): n is a, c, t, g, unknown, or other
gggggggggggggggnggggggggaggggcaccagccaagaaatcggtgttggcccaatgaggaccgggacccccctcgaggtcgacggtatcgataagcttttttttttttttttttcaacaaataccacgttgttggctgaattattctgattttgaataactagtttgggagctccatgcaacacaggatttctttttttaactaggagtacaatttattatcttgtgaagccaatagcgcaatcgtacagtttagtctagcgatctgacaacctgacgtgcaccattaccaccatagtgataaaattcacaagaacgcggagatggaagacgtcttggctcctcttcacagctccagcttgctggccaggtaccaggagtgcatggccaagctaccaaacgacatgatgttggccagtgatgacagcccccgtggaatcatcccaaacttcttgttgattgcagcaagggtgggggttggattaagcccctctgctgatttcttggaccacgccacctggctccccgaatactcgggtgcccgctcaaaccttagagccgcggtctggaacaacctaaaaagtgtgaaaggggggggaaaaaaccaagccaggctgggcaaagaatgtgtaagcccaggccgcgggacagggaaggaaatgcccagccgagggtaaaacccctcccccaggagagcaaataccaaagttttcaacccgtattacggagggtccccttaacacggggcgggtaaacactcgaaaatggcgccccgcccgcgaggacaaaaa

SEQ ID NO: 17498 - DNA, 725 bp, Zea mays
  misc_feature: Ceres CLONE 1382579-F
  misc_feature: Encodes the peptide sequence at SEQ ID NO. 17499
tggagctccccgcggtggcggccgctctagaactagtggatcccccgggctgcaggaattcgcacgagaccattacctagaacatcctaatcgaaaaatgctcttcgcccctcgcgcttaccgctgccgcgcctcccgacttgccgcctccgcctagctccgggctctccaatggtctccatgctcggcatcctcaggccctccgcgccggccccgctcgcggggcgccgggtcagggctgccgcgccggcgaccgcgagggtgtcgctatcttccagatctaggtattcgtcgggcaggaagtcgctcggctccgaggttgcagtgggcgccgacgcgctcttcgccgactataagcccaccaccgctttcctcttcgccggccagggtgtccaaatcgttggaatagcggcagaagctcagagcgttccagcagctaccaaattgttcaaccaggcaaatgagatccttgaatatgacttgctggatctttgcaccaatgcaccaaaagaaaagcttgactcaacaatgatcagtcagacggctatatatgtcaccagccttgcagcagtagaggtactacgtgcacgcgatgtaggccaagatgtgattaactctgtagatgttacatgtgggctcagattgggagagtataccgctcttgcatttgccggtgcttttagctttgaggatggactgaagcttgtcaagctaagaggagaagt

SEQ ID NO: 17499 - protein, 184 aa, Zea mays
  misc_feature: Ceres CLONE 1382579-F
  misc_feature: SWISSPROT Homolog: EC 2.3.1.39 [Acyl-carrier-protein] S-malonyltransferase
MVSMLGILRPSAPAPLAGRRVRAAAPATARVSLSSRSRYSSGRKSLGSEVAVGADALFADYKPTTAFLFAGQGVQIVGIAAEAQSVPAATKLFNQANEILEYDLLDLCTNAPKEKLDSTMISQTAIYVTSLAAVEVLRARDVGQDVINSVDVTCGLRLGEYTALAFAGAFSFEDGLKLVKLRGE

SEQ ID NO: 17500 - DNA, 948 bp, Zea mays
  misc_feature: Ceres CLONE 1382584-F
  misc_feature: Encodes the peptide sequence at SEQ ID NO. 17501
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (46)..(46): n is a, c, t, g, unknown, or other
nnnccccnccccnnnnnnnnnnnnccnnccccnnccccgcggcttnttcaaagctggagctcaccgcggtggcggccgctctagaactagtggatcccccgggctgcaggaattcgcacgagaccattacctagaacatcctaatcgaaaaaacaaagttcagttgagttcaatgctcagccatgaagagaaatgagatcgcagcagcagccatggttttgctcttgttgacgttgggcgctgaggcccagatctgttactcgcggagcaagaccttcaaggggtggtgctaccacagcaccaactgcatctccgtttgcatcaccgagggggagattagcgggttctgccagcatggaatttgcatgtgcacctatgagtgtctcacgggtaaacgaagctagcctgcctggtggtggtggtgggggggaagacccacagttattacacgccgccacgccaaacgggtgatggggctagaccactgtcacttgagggatgaccagaaaagagacatcgaccagagaccggctatggaggggcgccaagaagccttagtcccgcgctaccaggaggaggtaagctgaccggaagagcggcctggtttttcggggggatgggggttacttcctcttcaacatgcgtaattggagctggagagaaaaaataaactggcgtgggggtctaacttaaatctaccaccgccccccccgccgggccgacagacgggtaatcggtcttgcgcgcggaccgccggtgggcacgtgggcgggtccacccagaacgagggggtatatcggacacaccgtgcccccgcttcgacaggaggcacccccccgaacccctcaacttccctctctttattgggggacgccctttattttatacacctcgcctaaatctagtgggtatagtcgcttttttacaaacgcgccccgggtgcagacg

SEQ ID NO: 17501 - protein, 73 aa, Zea mays
  misc_feature: Ceres CLONE 1382584-F
  misc_feature (23)..(67): Pfam Name: Gamma-thionin Pfam Description: Gamma-thionin family
MKRNEIAAAAMVLLLLTLGAEAQICYSRSKTFKGWCYHSTNCISVCITEGEISGFCQHGICMCTYECLTGKRS

SEQ ID NO: 17502 - DNA, 752 bp, Zea mays
  misc_feature: Ceres CLONE 1382585-F
  misc_feature: Encodes the peptide sequence at SEQ ID NO. 17503
  misc_feature (243)..(243): n is a, c, t, g, unknown, or other
ggagctccccgcggtggcggccgctctagaactagtggatcccccgggctgcaggaattcgcacaagaccattacctagaacatcctaacgaaaaaatcaattctccagaccctccccggcaaccgcgtccggccgtccgcttccgtctccttggataaccacgacgcccgccggcaagcgaaagcgaagcgagccaacccagccatggagaaggcgatcgatcggcagcgggtcctcctggngcacctcctcccctccctctccgccgcctcctcgcagcctcagcttgcggcgtcggcgtgcgcggccggggacagcgccgcctaccagaggtcctcctccttcggggacgatgtcgtcgtcgtcgctgcctacaggacgccgatatgcaaggccaagcgaaggaggtttcaggacacctacccagaggacctctcactgtggtctcaggctggtctggaaacactagaaccatccagctgaatcggggaatccccgtgggacggggttggccctggtcccagcgggaaaccagggcaggaggctggcctgtttgctggatccccgaaaccgccccggttaaaatggcaacccccacgggttttttggggctaaagggaaaaactggagggccccacttgttataaaggggtggggttctattagaaaaataagggtttggtggggggggttttggaaaacccgggggcccaaaaaaatcccccttgggggggggaaaagaagaaaaaat

SEQ ID NO: 17503 - protein, 92 aa, Zea mays
  misc_feature: Ceres CLONE 1382585-F
  misc_feature: SWISSPROT Homolog: EC 2.3.1.16 Acetyl-CoA C-acyltransferase
  misc_feature (13)..(13): Xaa is any aa, unknown, or other
MEKAIDRQRVLLXHLLPSLSAASSQPQLAASACAAGDSAAYQRSSSFGDDVVVVAAYRTPICKAKRRRFQDTYPEDLSLWSQAGLETLEPSS

SEQ ID NO: 17504 - DNA, 654 bp, Zea mays
  misc_feature: Ceres CLONE 1382588-F
  misc_feature (283)..(283): n is a, c, t, g, unknown, or other
  misc_feature (425)..(425): n is a, c, t, g, unknown, or other
  misc_feature (505)..(505): n is a, c, t, g, unknown, or other
  misc_feature (566)..(566): n is a, c, t, g, unknown, or other
tccccgcggtggcggccgctctagaactagtggatcccccgggctgcaggaattcgcacgagaccattacctagaacatcctaatcgaaaaacaagctcgatcaccaacccagctcggtcgtcccagctgatcaggtcgagcaccttgcgacctgctcgatcatcagtgtagagtgtctgtaggtgtctgtctctcttggtggctggttgcaacggtcatggcgacgtcgtctcgtcgggtggcctttgctgctgctgggcccctgggcgggcttgggggccngggctccctttttccggggggaaattgacccaaaattgaatttcctggggaaacggggggaaaagccttggaaaaagggggttggttggttttttttttaacccaaaccccctttcccgttttccaccccccgggaaaaaancacttttcccaaaaaaaaaaaaaaatttgggtggggggggaaaatattccggggggggccccccctttaaattttttttnaagagggggggccccaaaaaaaaaatttttttttttttttttggagaaaaatttggggggnttcttttttttttgtaaaaaaccctttttttttttgggggggggggggggggataaaaaaaaaaaaaaacccccttcccccccctctt

SEQ ID NO: 17505 - DNA, 704 bp, Zea mays
  misc_feature: Ceres CLONE 1382592-F
  misc_feature: Encodes the peptide sequence at SEQ ID NO. 17506
tggagctccccgcggtggcggccgctctagaactagtggatcccccgggctgcaggaattcgcacgagaccattacctagaacatcctaatcgaaaaaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaaggtatggatctcgctcgccttactcgagaagcacaaggtaccgaagtcgctctaggagtgtcgactctagtgatgctgaaaaccctgggaacaacctgtatgtgactggttttgtcagctcgtgtaacggatcgagatctggagaaggcccttctcactggaggtgagtgatgatgcagcgtgtatttgtcctggcaaggaaaccggggtttgttttgttccatgctggtgtaagagcgaacggtgatcaaaacggaccgtctggggtcaaggcgtcctaatggttgaaaaatttttgtcacaaaagggaaaagttggaacttccttgcaaaaagggttaacccttaaccccaacgtgggccccctcccaaaaggggggggggccccccctttggagaaagaaagaaggggtgaaaccccccccccctgggggaaatttttgtgaacaaaaattttcccggggggggggggggg

SEQ ID NO: 17506 - protein, 62 aa, Zea mays
  misc_feature: Ceres CLONE 1382592-F
MSYSRGSRYGSRSPYSRSTRYRSRSRSVDSSDAENPGNNLYVTGFVSSCNGSRSGEGPSHWR

SEQ ID NO: 17507 - DNA, 801 bp, Zea mays
  misc_feature: Ceres CLONE 1382593-F
  misc_feature: Encodes the peptide sequence at SEQ ID NO. 17508
  misc_feature (732)..(732): n is a, c, t, g, unknown, or other
ggagctccccgcggtggcggccgctctagaactagtggatcccccgggctgcaggaattcgcacgagaccattacctagaacatcctaatcgaaaactaatcgaaaagccgcatcccttctttcattcgccgccgccgcctcctctctgctgccgtcgccatggggagaaggcctgcgagatgctatcgccaaatcaagaacaagccataccccaagtccaggtactgccgtggtgtccctgaccccaagattaggatctacgatgttggcataaagagaaagggtgttgatgagttcccctactgtgtgcaccttgtctcttgggagaaggagaatgtctccagtgaggctcttgaggctgcccgtattgcctgcaacaagtacatgaccaagtctgcaggaaaggatgccttccaccttcgggtccgggttcaccccttccatgtccttcgtatcaacaagatgctttcgtgtgctggggctgataggctccagactggaatgaggggtgcctttggcaagcctcagggcacctgtgctagggtggacattggtcaggtactcctttctgttcgatgcaaggacaacaatgctgcacatgccagtgaagctctgcgacgcgccaagttcaagttccctgggcgccccaaagatattgagagcagaaagtggggcttcaccaagttcagccgtgccgactacctgaagtacaagagtgagggtagaattgntcctgatggtgtcacgcaaagctgctcggtaccatggaagaactgagaagcgtgctcctgggaaggctt

SEQ ID NO: 17508 - protein, 205 aa, Zea mays
  misc_feature: Ceres CLONE 1382593-F
  misc_feature (5)..(167): Pfam Name: Ribosomal_L16 Pfam Description: Ribosomal protein L16
  misc_feature (191)..(191): Xaa is any aa, unknown, or other
MGRRPARCYRQIKNKPYPKSRYCRGVPDPKIRIYDVGIKRKGVDEFPYCVHLVSWEKENVSSEALEAARIACNKYMTKSAGKDAFHLRVRVHPFHVLRINKMLSCAGADRLQTGMRGAFGKPQGTCARVDIGQVLLSVRCKDNNAAHASEALRRAKFKFPGRPKDIESRKWGFTKFSRADYLKYKSEGRIXPDGVTQSCSVPWKN

SEQ ID NO: 17509 - DNA, 786 bp, Zea mays
  misc_feature: Ceres CLONE 1382594-F
  misc_feature: Translation starting site: 163
  misc_feature (377)..(377): n is a, c, t, g, unknown, or other
  misc_feature (394)..(394): n is a, c, t, g, unknown, or other
  misc_feature (433)..(433): n is a, c, t, g, unknown, or other
  misc_feature (460)..(460): n is a, c, t, g, unknown, or other
ggagctccccgcggtggcggccgctctagaactagtggatcccccgggctgcaggaattcgcacgagaccattacctagaacatcctaatcgaaaaagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagatcaggatatacgatgtcgggatgaagaggaagggtgttgatgagttcccctactgtgtgcaccttgtctcttgggagaaggagaatgtctccagtgaggcgcttgaggctgcccgcattgcctnggcacagtacatgaccnagtctgcaggaaaggatgccttcccacttaggggtcggntcaccccgtccatggtctccgaatcancaggatgctttcgtgtgctggggctgatagcctcagactgaatgaaggttgcctttggcagcctcagggcactggggtaaggtgacatggtcaggtcttcctcccgggggatgcaaggaaaacaatgctgccatggccaggaagtctggggccggcttaaatcaagtccctggcccccaaaaaacttggaaagcaaaagggggctccccaagttccaccgggtttattccctgagaacaaaggggggggaaattgttccctgatggggaaaccaaaattggtcccgaacccccggaaaatttggaaaagggcctcccggaaaactt

SEQ ID NO: 17510 - DNA, 785 bp, Zea mays
  misc_feature: Ceres CLONE 1382597-F
  misc_feature: Encodes the peptide sequence at SEQ ID NO. 17511
  misc_feature (477)..(477): n is a, c, t, g, unknown, or other
  misc_feature (528)..(528): n is a, c, t, g, unknown, or other
  misc_feature (557)..(557): n is a, c, t, g, unknown, or other
  misc_feature (640)..(640): n is a, c, t, g, unknown, or other
  misc_feature (711)..(711): n is a, c, t, g, unknown, or other
tccccgcggtggcggccgctctagaactagtggatcccccgggctgcaggaattcgcacgagaccattacctagaacatcctaatcgaaaaaggggccatcagatccaagaagagggaagagcaccaaggaccttcggcgcccgttcaggatccacatcttcccgagcgagttcttggttgacctcttcctcttcggaccacctccaaggctcttggtgtagcttgccactctcaccaatcaagttttcatgtctgatctcgacattcagatcccaactgccttcgatcccttcgctgaggccaatgctggggactctggtgcggcagcagggtcaaaggactacgtacacgtgcgcatccagcagcgtaatggtcgcaagagcctgaccaccgtccagggattgaagaagggagtcagctacagcaagatcctcaaagatctcaagaaagagttctgctgcaatgggtacagtggntcaggacccagaactttggacaggtcattcagctcccaggtgatcagaggnaagaacgtctcgaatttcctccgtcaggncggatttgtggaagaagagcacatcaagaattcatggtttctgagcaaaccgccgggtccatagcaaaccaaccctgcatgcnaggccagctaaatatatataaaaaaatcgggaggggagcaatctaattctgggctgtgtaactgcaagcangcctagtagcccccggctgcgcgttcctctatttacactatagcccccccctggggggggatgctcttttttat

SEQ ID NO: 17511 - protein, 123 aa, Zea mays
  misc_feature: Ceres CLONE 1382597-F
  misc_feature (27)..(109): Pfam Name: SUI1 Pfam Description: Translation initiation factor SUI1
  misc_feature (103)..(103): Xaa is any aa, unknown, or other
MSDLDIQIPTAFDPFAEANAGDSGAAAGSKDYVHVRIQQRNGRKSLTTVQGLKKGVSYSKILKDLKKEFCCNGYSGSGPRTLDRSFSSQVIRGKNVSNFLRQXGFVEEEHIKNSWFLSKPPGP

SEQ ID NO: 17512 - DNA, 818 bp, Zea mays
  misc_feature: Ceres CLONE 1382602-F
  misc_feature: Encodes the peptide sequence at SEQ ID NO. 17513
  misc_feature (23)..(23): n is a, c, t, g, unknown, or other
  misc_feature (26)..(26): n is a, c, t, g, unknown, or other
  misc_feature (42)..(42): n is a, c, t, g, unknown, or other
  misc_feature (59)..(59): n is a, c, t, g, unknown, or other
  misc_feature (64)..(64): n is a, c, t, g, unknown, or other
  misc_feature (163)..(163): n is a, c, t, g, unknown, or other
  misc_feature (398)..(398): n is a, c, t, g, unknown, or other
tacagctggagctccccttaggnggngggggcgtggcttacngcttgctcccgcgggcngcagngataacccacgacaccaggagctagaacatcctaatcgaaaaaattagccagcccacctctgctctgcgggcgcttcagatggaagcactagccattgnatccgcgcctcgccgtccgggcgcaaggtactcccaactccgccgccccggaaccctcgccgtcaccaccacagccacagttgcatgccgccccctcacggcgccctccatggacgccgccgttggccgcccgagccgcgcgcctatccgctgcaccagcgcggagacggactcggtggatgaggtcgcgacgagctctcacgccgcgtaggccaacgcggggggcaccacggancaagagggcaacgggagccccgtggccgccgctgccgcgtactcccccgtggtcgccggcgtcgacgggataaggatccggcggcggcccgtgacggggcccgcggtgcactacgtgggcccgttccagttccgcctcgagaacgaggggaacacgccgcggaacatcctcgagaaaatcatctggaacaaggacgtccaggtttcccacatgaaggaaaggaggcccctgtacatgctgaagggtccgcttgaggctgctccccccgctagggacttctttggggcgctcaaggggtcctactatcgaactggcttgcctgctctgattgcggagggcaagaaggcttcaccaagccgggggcgttatcagggagaaaatttgatcccggttcagatcgctcagggatatgaggaaaag

SEQ ID NO: 17513 - protein, 70 aa, Zea mays
  misc_feature: Ceres CLONE 1382602-F
  misc_feature: SWISSPROT Homolog: EC 4.1.1.48 Indole-3-glycerol-phosphate synthase
MKERRPLYMLKGPLEAAPPARDFFGALKGSYYRTGLPALIAEGKKASPSRGRYQGENLIPVQIAQGYEEK

SEQ ID NO: 17514 - DNA, 798 bp, Zea mays
  misc_feature: Ceres CLONE 1382612-F
  misc_feature: Translation starting site: 156
  misc_feature (664)..(664): n is a, c, t, g, unknown, or other
  misc_feature (725)..(725): n is a, c, t, g, unknown, or other
tccccgcggtggcggccgctctagaactagtggatcccccgggctgcaggaattcgcacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaagagagtggtgtttctcaagcagctcaagtctggcctgctccttatctctgggcctttcagatcaatggagtaccgatccgccgtgtgaaccagacctatgtcattgctacatcaaccaaagtgacatctctgggtggtgatgtcgccaagtttgatgacaagtactttgccagggagaagaagcaaaaggtgaggaagaccgagggcgagctttttgagacagaaaaggagcatccnagtcactgccggactttcagaagatgaccagaaaggctgtggattctgctctgatcagggntaatcgagctgtcctggagctgaaactacccttggcgcggtcttccttctccggggatgtgacagccccatgg

SEQ ID NO: 17515 - DNA, 794 bp, Zea mays
  misc_feature: Ceres CLONE 1382613-F
  misc_feature: Encodes the peptide sequence at SEQ ID NO. 17516
  misc_feature (567)..(567): n is a, c, t, g, unknown, or other
  misc_feature (568)..(568): n is a, c, t, g, unknown, or other
  misc_feature (671)..(671): n is a, c, t, g, unknown, or other
  misc_feature (677)..(677): n is a, c, t, g, unknown, or other
  misc_feature (701)..(701): n is a, c, t, g, unknown, or other
  misc_feature (738)..(738): n is a, c, t, g, unknown, or other
  misc_feature (763)..(763): n is a, c, t, g, unknown, or other
  misc_feature (772)..(772): n is a, c, t, g, unknown, or other
tccccgcggtggcggccgctctagaactagtggatcccccgggctgcaggaattcgcacgagaccattacctagaacatcctaatcgaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaagatgcacccatgtttnngtgttgtgtcaatgaggacaagtacacctcggatgtttacattgtgtccaatgctagctgcacccacaactgccttgctcccctttgctaggtcattcatgancacttncggcattgttgagggtttgatgancactggtcatgccatcactgccacccagaaaactggntgacgaccctcagccagggactggnagaggtggncaggctgccagctttacatcat

SEQ ID NO: 17516 - protein, 190 aa, Zea mays
  misc_feature: Ceres CLONE 1382613-F
  misc_feature (4)..(149): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (133)..(133): Xaa is any aa, unknown, or other
  misc_feature (134)..(134): Xaa is any aa, unknown, or other
  misc_feature (168)..(168): Xaa is any aa, unknown, or other
  misc_feature (170)..(170): Xaa is any aa, unknown, or other
  misc_feature (178)..(178): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKMHPCXXVVSMRTSTPRMFTLCPMLAAPTTALLPFARSFMXTXGIVEGLMXTGHAITATQKTG

SEQ ID NO: 17517 - DNA, 915 bp, Zea mays
  misc_feature: Ceres CLONE 1382616-F
  misc_feature: Encodes the peptide sequence at SEQ ID NO. 17518
  misc_feature (1)..(1): n is a, c, t, g, unknown, or other
  misc_feature (2)..(2): n is a, c, t, g, unknown, or other
  misc_feature (7)..(7): n is a, c, t, g, unknown, or other
  misc_feature (13)..(13): n is a, c, t, g, unknown, or other
  misc_feature (17)..(17): n is a, c, t, g, unknown, or other
  misc_feature (19)..(19): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (42)..(42): n is a, c, t, g, unknown, or other
  misc_feature (341)..(341): n is a, c, t, g, unknown, or other
nnccccntccccncccncnccccnnnnnnccnncctcccccncctcctctctcttcggcgaaaggatggaagaatggggctccccgcggtggcggccgctctagaactagtggatcccccgggctgcaggaattcgcacgagaccattacctagaacatcctaatcgaaaactcctttttttctctcatccgaattcccaggcaggcaggtcggcgaggagggcaggaagaccgaagaccgagccgtgcgggggctcgggacgggaacgggacaggaccccaaaatctcagatccttcctgcccgcccgcccgtgcccgtcgacgcgtcgttcttgccggncgcgccccacctccgccctctcctcctccagggggatcggatacgccacaggctgcgcgatggtgctgtgggtcttcggctacggctccctcatctggaggggcgggtgcgacttcgacgacaaaatcctcggcttcatcaagggctacaagcgcacctttaatctcgcttgcattgaccacagaggcacaccggagcatccggcgaggacctgcacgcttgaaaccgacgacgaggccatatgctggggaattgcatattgtgtcaaggggggtccagaaaaagagctaaaaggaatacggtactgggagagaagagagggggagtaccaccagaaaatatccgttggattctacgagggaaggagatccctttgaacccgcttgggacgggccgccttaagggtccgtttccccctcccagatcccaatggggcaaccaagtactaatcttgggccccgggctcctcctgcgggaatatggccaaggggaaaattgggttacaaggccaagggggccctaacgggcattataaaaagggggatattaccggggtgtccccaagggggagaaa

SEQ ID NO: 17518 - protein, 105 aa, Zea mays
  misc_feature: Ceres CLONE 1382616-F
  misc_feature (3)..(99): Pfam Name: ChaC Pfam Description: ChaC-like protein
MVLWVFGYGSLIWRGGCDFDDKILGFIKGYKRTFNLACIDHRGTPEHPARTCTLETDDEAICWGIAYCVKGGPEKELKGIRYWERREGEYHQKISVGFYEGRRSL

SEQ ID NO: 17519 - DNA, 798 bp, Zea mays
  misc_feature: Ceres CLONE 1382621-F
  misc_feature: Encodes the peptide sequence at SEQ ID NO. 17520
aagctggagctccccgcggtggcggccgctctagaactagtggatcccccgggctgcaggaattcgcacgagaccattacctagaacatcctaatcgaaaatttttctcacgccctccccgcggaattatacctttttttttctctctctctcgcctcgcttccttcgaatccatccatctctcgcctccctttccaattcgatgcctttgtagcgctgctgcctcgcccccgccgcgtcgtcgcgggtccccggcttcgcttgctgctgcgcttccagcgtcatggacgggggatccggcaatgcctccagcggcggagcggcggagtgctgctactacgcgctcctcggcgtccgcaagagcgcctccgccaccgacatacgcaccgcgtaccggaggctcgcgatgaagtggcacccggaccggtgggacagcgataccggcgcggccggcgaggccaagcggcggttccagcggatccagaagggctactcagttttatcggacgaggggaagaagccatgtacgacgccgtgatcttcgatcccctcgacgacgacgaccaggatttctccgacttcatgaaggagatgctgccgatgatggataacgtggaaaacgagaacccgcgaccgcctagaggaccgcacaagatgctggcggaatcgtgaacgtgacgaggcggacgacgtaggcgtgagggtgccgcggaagcccccggagttgatcggggaagggcgtggcgccccaccgggaaccgagaagggggaatgggcggccgggccccctaattgtgg

SEQ ID NO: 17520 - protein, 84 aa, Zea mays
  misc_feature: Ceres CLONE 1382621-F
  misc_feature (17)..(78): Pfam Name: DnaJ Pfam Description: DnaJ domain
MDGGSGNASSGGAAECCYYALLGVRKSASATDIRTAYRRLAMKWHPDRWDSDTGAAGEAKRRFQRIQKGYSVLSDEGKKPCTTP

SEQ ID NO: 17521 - DNA, 780 bp, Zea mays
  misc_feature: Ceres CLONE 1382623-F
  misc_feature (607)..(607): n is a, c, t, g, unknown, or other
tccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggactttctgcaagtgctgctacggcgaccattttcccgcaatgctcgcaagctcctatagcttcccttcttcccccgtacctctcatcagcggtgtcttcggtatgtgaaaacccaatccttcaaccctacaggatccaacaggcaatcgcagctggcatcttacctttatcacccttgttcctccaacaatcatcagccctattacaacagttacctttggtgcatttattggcacaaaacatcagggcacaacaactacaacaacttgtgctagcaaaccttgctgcctactctcagcaacagcagtatcttccattcaaccaactaggttcattgaactctgcttcttatttgcaacaacaacaactaccattcagccagctacctgctgcctacccccagcaatttcttgcattcaancaactggcagcattgaactctcctgcttattttacacagcaacaactactaccattcagccagctagctggtgtgagccctgctaccttactgacacaacacagttgttggcgttctacagccacgtgcgctaagctggcaccctcttacactgcaacaatggctgcattcac

SEQ ID NO: 17522 - DNA, 781 bp, Zea mays
  misc_feature: Ceres CLONE 1382625-F
  misc_feature: Encodes the peptide sequence at SEQ ID NO. 17523
  misc_feature (669)..(669): n is a, c, t, g, unknown, or other
  misc_feature (781)..(781): n is a, c, t, g, unknown, or other
tggagctccccgcggtggcggccgctctagaactagtggatcccccgggctgcaggaattcgcacgagaccattacctagaacatcctaatcgaaaaaaaacacctccgatccgtccccgatcatcgcaccacctgtagcccacctcgctctcgagtctcgacccagcgacgagatggccgcggtggatctgaccccaaggacgcccaagaaggcctacggcggcgacggcggcgcctactacgagtggagccccgccgacctgcctatgctcgccgtcgcctccatcggcgccgccaagatctcgctcgccgccggtggactctccctccccagctactccgactccgccaaggtcgcctacgtcctacaaggtgtcggtacctgcggcctcgtcctccccgaggcgacgaaggagaaggtgctggcggtgaaggagggcgacgcgctggcgctgcccttcgatgcggcgacgaggtgtcacaacggtcccgccgtgcaggtcgacctcacggtgctcttcctcggagacacctccaaggtccacaagcggctgcagatcagcaacttccagttcacggtgtccgcgagcatcttcacggctctgctcaccgagttcgtgtcgcgcgcgtgagatctgccggagcccgacgccgcgatgctgatgtcnagccagacggactcgtacatgtacagatgaccgtctccgacgccgtgctcccgcgtcctacacaaggaccgctgcgttttgacatcaactgccgttaggcccgctgcatcgn

SEQ ID NO: 17523 - protein, 152 aa, Zea mays
  misc_feature: Ceres CLONE 1382625-F
  misc_feature (6)..(135): Pfam Name: Cupin_1 Pfam Description: Cupin
MAAVDLTPRTPKKAYGGDGGAYYEWSPADLPMLAVASIGAAKISLAAGGLSLPSYSDSAKVAYVLQGVGTCGLVLPEATKEKVLAVKEGDALALPFDAATRCHNGPAVQVDLTVLFLGDTSKVHKRLQISNFQFTVSASIFTALLTEFVSRA

SEQ ID NO: 17524 - DNA, 963 bp, Zea mays
  misc_feature: Ceres CLONE 1382627-F
  misc_feature (18)..(18): n is a, c, t, g, unknown, or other
  misc_feature (20)..(20): n is a, c, t, g, unknown, or other
  misc_feature (37)..(37): n is a, c, t, g, unknown, or other
ttttttcccccccccctncncccccccccctcccccntatttacgaaactggataaaccctaaactccccgcggtggcggccgctctagaactagtggatcccccgggctgcaggaattcgcacgagaccattacctagaacatcctaatcgaaaaacgcgcgcccaaaggcccccaaggccccaaccccaaccttgcaggaaaaaaaaagagacgaccccccaaatcggaatccgcacacccatcatccatggccgccgccctgctccgccgctcgccggcggcgcgcgcgctcctctcgccggcactctcgtcccgcctcgtcgcgtccaagccccactcctcgtcccccgcgccgcccgccacctggggaagggccgacccccagccaccgaaaaaccccttccccgggattctacccggggggggggaaaccggaaacccccgggggaagaaaacccccccctcccaggggatcccaggggggaccccgttccaacggaggggcccaatggggggcggggacgcccgcgttccccgaaatcccaaaagagggggggcgccccctgtttgtttttactcttccgtgcccaatattgctacgggaggggggaatctatcgggggggaaggcaccggcgccccgggagaaatcacacagagagggtgaaagacgacgcccgctcaccccgcgggcacccacaacaaaaatatttggcgagaggccgtcctcccccgcccggggcaaaaaaatgagtatctacctccttctctccaccaccaaaatattgtctctacctcacaaaaacacgcaacagggggtgggtgggcggagctagtaacaccaacaccccccccacgagccccgctccttacttaacgtaaccgctgcgcccctcacggtttcgtgctctctccactaaactaagttgaaatgtctacctccaccccccacacagccggc

SEQ ID NO: 17525 - DNA, 782 bp, Zea mays
  misc_feature: Ceres CLONE 1382633-F
  misc_feature: Encodes the peptide sequence at SEQ ID NO. 17526
  misc_feature (782)..(782): n is a, c, t, g, unknown, or other
tccccgcggtggcggccgctctagaactagtggatcccccgggctgcaggaattcgcacgagaccattacctagaacatcctaatcgaaaagatttcctcgtcatttctctcatccgctgcgctccctctcccactcggcgaagaagggggaaaaaagctcgaaagcgggagccggcgagcgagatgggcgcagggagcagccgcgcggacgcgccgtcgcggcgccgggcgcgcctcagcctcggcgggtgcttcggggccggatcctcctcgtccgcgcacgacggcgggagcttcgccgcggccgggccctcctcctcgcgcgccatcgaggtacaatcacgacagtcagggcgacaagtgagtgccctgaattttcaggcttctctagctgctaaggatctccaggtttccagtgagtcaaatccaaggctgcattcgtcttcaagcaccataagccatcatctcagattcaatcacctcaattaccatgaaaacaaggaagatggcctggggtctgaaaacgctgaaacaattggtcttcaaagctcatctaggaaacctgtcatggtaaggggaagtctcattaatgaagctgttgatggtgacatatcaggaggaagaataagttctgtaggatcagagctgggaaatgtcctagcacagtctccactaatggaatggtggctcacttctgaatctgggttgggccctcatcgagacatctgaaaagatcatgtctgactcagaagtagagatatctcgcaggggacctcatccn

SEQ ID NO: 17526 - protein, 181 aa, Zea mays
  misc_feature: Ceres CLONE 1382633-F
MGAGSSRADAPSRRRARLSLGGCFGAGSSSSAHDGGSFAAAGPSSSRAIEVQSRQSGRQVSALNFQASLAAKDLQVSSESNPRLHSSSSTISHHLRFNHLNYHENKEDGLGSENAETIGLQSSSRKPVMVRGSLINEAVDGDISGGRISSVGSELGNVLAQSPLMEWWLTSESGLGPHRDI

SEQ ID NO: 17527 - DNA, 886 bp, Zea mays
  misc_feature: Ceres CLONE 1382636-F
  misc_feature: Encodes the peptide sequence at SEQ ID NO. 17528
aaaaaaataactagcatttattaatctcctcccccttccttccaagctggagctccaccgcggtggcggccgctctagaactagtggatcccccgggctgcaggaattcgcacgagaccattacctagaacatcctaatcgaaaagtcacgagaccgcttcccacactcccttccccaccagccgataccgaggctgacgctgcgggagccaaccggcggcgatgcaggcggcagtcggccaccgcggcgccaaccttggctccccgagactctcgcgcttccggtatgccttcggcctccacggccgggcccgcctcttctctgagggagtggcggcggcgtcactcctcgccggatctctgccccagccacggacccatggcagcgccggtttcgcgcaccctcggtcccatgcgcggaggaggcggcgaagcctgccccacctccctccgggagaatgttcatccgacattcaacagaaacggctgggtccccaaactgtctggaaaagctggttggagcttttccgcccccgggacattcgggctatcccggagacctactaggaagggcggaacaccgggaggacttgttgcccagcccctccctaggctgcctctcccgcccagaccttggcccaaagtttatcactgggtgtgtcaccacctcaaacggcagcctgccggcgtcggggcgattaaagaagaaattgccccagacgaaacggcccccaacccatatgtgggctacaaaaaataaaactttcccctccggaaccaggggatggacttggaataatgggcggggccatagatgcgaggtctatgggggcgcgcgggggcctagccttataggggccgctgcggggggagaaacaattggaga

SEQ ID NO: 17528 - protein, 114 aa, Zea mays
  misc_feature: Ceres CLONE 1382636-F
MQAAVGHRGANLGSPRLSRFRYAFGLHGRARLFSEGVAAASLLAGSLPQPRTHGSAGFAHPRSHARRRRRSLPHLPPGECSSDIQQKRLGPQTVWKSWLELFRPRDIRAIPETY

SEQ ID NO: 17529 - DNA, 717 bp, Zea mays
  misc_feature: Ceres CLONE 1382640-F
  misc_feature: Translation starting site: 165
tggagctccccgcggtggcggccgctctagaactagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgtcgattcatctgcccgccgcaccatgccactaccctactcaaccgccccgggctcagcctcatccccagccacatccatgcccgttgcaacagtcgcatcccagcccgtgccagctgcagggaacttgcggcgttggccacaccccgatcctgggccatgcgccaagttcctgaaggatcagtgcagcccgaaggcgaagccctaatgttcgcctcaaggccaatctttggggaaacagtgttgcccccccctccagaaaggggagccccaaaaaccggacccagggattttccgttgggccctccagcccatccgggaaaaaaaagccga

SEQ ID NO: 17530 - DNA, 722 bp, Zea mays
  misc_feature: Ceres CLONE 1382645-F
  misc_feature: Translation starting site: 160
  misc_feature: SWISSPROT Homolog: EC 3.1.3.7 3'(2'),5'-bisphosphate nucleotidase
tggagctccccgcggtggcggccgctctagaactagtggatcccccgggctgcaggaattcgcacgagaccattacctagaacatcctaatcgaaaaacgcctcctcctccgcctcccgatcctgccgggcgtagtcgaggttcgccgcagtcggcgccatggcttcagggaaccactacgccgtggagcttgccgacgccaagaagaacggcaccctcgccgtcgaactctgccagaatgtccaacaggatattatgtattctggcgttcaggctagagcagacaacagccctgaaagcgtgcctgattatggatctcaaatattggaggccttctccttcctgatggatgtatacctcaggaccattttcattggaggttgactagcactcccatgacttgagaacagatggtgctgcaatactgttggtagatattactgaccttgccagtgcaagcatctctgccgatggatcatataacatttgcctgaccaaggagggcatactcctctgcaattgaggacggaaactgttaaggaggtccatctggaccacattgcgtgatggatccgactgacggcattataggtgtcttgagatccgaccaatatgccattgctatgggtctgcttgaagaggcaacgtggcttcgagtgaatcgttgcgtcaaaccttccatgtcatcaatacatgcctcaagttaactcaagctgcttcaa

SEQ ID NO: 17531 - DNA, 723 bp, Zea mays
  misc_feature: Ceres CLONE 1382646-F
  misc_feature: Encodes the peptide sequence at SEQ ID NO. 17532
  misc_feature (403)..(403): n is a, c, t, g, unknown, or other
  misc_feature (584)..(584): n is a, c, t, g, unknown, or other
  misc_feature (684)..(684): n is a, c, t, g, unknown, or other
  misc_feature (686)..(686): n is a, c, t, g, unknown, or other
tggagctccccgcggtggcggccgctctagaactagtggatcccccgggctgcaggaattcgcacgagaccattacctagaacatcctaatcgaaaagtctgtctgtctgcctccctccgctcacctcctctgcttcttctcgctttcttccatcttggtccagcctccactcttcctgctgagccatggcggctgccgaagaagggccagagccactcaggtatcatactctggccctgagggtgagcatccactgcgagggttgcaagaagaaggtgaagaaggtgctccacagcatagaaggcgtgtacaagacggacatagacacgcagcagcagaaggtggtggtcataggcaacgtctctgcagacgcgctcgtcaagatgctccctcaagtccggnaatcacccgtagccctggccggaccctgttccagcccccacgttcgccgacagcccgcccgggcccgaaggatctcccggcagggcatgccaaaaagaaaaaaaagataagggcaacaagagcccccaaggggtgaaacaacaagccccgccgatccggggccagggccccgcgcccgggncgggggaagagaaaagggggacccaacccccccggaaaaaaacaaaaaagggtgaagggggggcccccccgggaaaaagggaaccccggagggggggaananatttaaagaaacccccccggggattgcgtgggggggg

SEQ ID NO: 17532 - protein, 108 aa, Zea mays
  misc_feature: Ceres CLONE 1382646-F
  misc_feature (17)..(73): Pfam Name: HMA Pfam Description: Heavy-metal-associated domain
  misc_feature (73)..(73): Xaa is any aa, unknown, or other
MAAAEEGPEPLRYHTLALRVSIHCEGCKKKVKKVLHSIEGVYKTDIDTQQQKVVVIGNVSADALVKMLPQVRXSPVALAGPCSSPHVRRQPARARRISRQGMPKRKKR

SEQ ID NO: 17533 - DNA, 707 bp, Zea mays
  misc_feature: Ceres CLONE 1382647-F
  misc_feature: Encodes the peptide sequence at SEQ ID NO. 17534
tggagctccccgcggtggcggccgctctagaactagtggatcccccgggctgcaggaattcgcacgagaccattacctagaacatcctaatcgaaaactttcgtcaactccacttctcttctccgcgtcacctcctcttcgccgccgccgacgcttcaccgggcagccagccatggatgaggagtacgacgtgatcgtactaggcacggggctcaaggagtgcatcctcagcggtctcctctctgtggacggcctcaaggttttgcatatggacagaaatgactactatggaggagattccacctcgctcaaccttaatcagctctggaagaggtttagaggggaagacaagcccccagcacatctaggtgcaagcagagactacaatgtggacatggtgccaaagtttatgatggcaaatgggacattggttcgaaccctcatccacaccgacgtgacaaagtacttgtcattcaaagctgttgatgggagctatgttttcagtaaagggaagatttacaaggtccctgccactgatatggaggctctgaagtcccctttgatgggcctattcgagaagcgcagagcaaggaacttcttcatttatgtccaagattacaatgaagctgatccaaggaaacatcgagggattggaccttactagggtgaccactagaaaaacttatagcaaaatatgggtttaaggg

SEQ ID NO: 17534 - protein, 163 aa, Zea mays
  misc_feature: Ceres CLONE 1382647-F
  misc_feature (1)..(164): Pfam Name: GDI Pfam Description: GDP dissociation inhibitor
MDEEYDVIVLGTGLKECILSGLLSVDGLKVLHMDRNDYYGGDSTSLNLNQLWKRFRGEDKPPAHLGASRDYNVDMVPKFMMANGTLVRTLIHTDVTKYLSFKAVDGSYVFSKGKIYKVPATDMEALKSPLMGLFEKRRARNFFIYVQDYNEADPRKHRGIGPY

SEQ ID NO: 17535 - DNA, 697 bp, Zea mays
  misc_feature: Ceres CLONE 1382653-F
  misc_feature: Encodes the peptide sequence at SEQ ID NO. 17536
  misc_feature (639)..(639): n is a, c, t, g, unknown, or other
aagctggagctccccgcggtggcggccgctctagaactagtggatcccccgggctgcaggaattcgcacgagaccattacctagaacatcctaatcgaaaattttacgcctccgctccgccccgccccgcgtctgcctgcccagcccagacgactcccctccgacttgtacctaacctatcgagacagagttccacgaagcagcaccagcacggcgccgcctcagcctatatataaacacacagccgccccccgtcttctactctgactctcatctgaagcgcgcgagagaaacgcgtatacccaggcggcggttgaggaagaggaggagaagaagaagaagatggcttcctccgcatacgcctcatggtccaagcggtggatccgtcccgaggtacgtacgccgttgctgtttcccatctgatcgttcattcggtttctatcgatcggagaattgggtcatcggggatggatggatggatctgacgggatttgccgatcccggtgtcgcgcgcgtccatggatcaggtgtacccgctgttcgtgccgatggccgtggccttgggcatctgctcgtaccagcttgtgcgcacatcacgggcaaccccgaggtgcgggtgaccaaggagaagagggcggncggcgtcctgaacaaccacgacgagggcgagaggtacgctatgcacggcctcaggaag

SEQ ID NO: 17536 - protein, 74 aa, Zea mays
  misc_feature: Ceres CLONE 1382653-F
  misc_feature (20)..(74): Pfam Name: B12D Pfam Description: B12D protein
  misc_feature (55)..(55): Xaa is any aa, unknown, or other
MDLTGFADPGVARVHGSGVPAVRADGRGLGHLLVPACAHITGNPEVRVTKEKRAXGVLNNHDEGERYAMHGLRK

SEQ ID NO: 17537 - DNA, 729 bp, Zea mays
  misc_feature: Ceres CLONE 1382656-F
  misc_feature: Encodes the peptide sequence at SEQ ID NO. 17538
tggagctccccgcggtggcggccgctctagaactagtggatcccccgggctgcaggaattcgcacgagaccattacctagaacatcctaatcgaaaaatcccatcccctcaggcctcagtcggcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgcccgagcgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggacccctccgtgagcgtcgccatcgtggagcagtccgtgtccccggtcggcggcgcgtgtctgggcggacagctgttctcggccatgatgctgcgcatggcggcgcacctgtcctggacgagctgggcgtggctacgacgaggccgagactacgtggtgtccagcacgcggggctgttccgtccacgtgatgagccgg

SEQ ID NO: 17538 - protein, 101 aa, Zea mays
  misc_feature: Ceres CLONE 1382656-F
  misc_feature (1)..(98): Pfam Name: Thi4 Pfam Description: Thi4 family
  misc_feature: SWISSPROT Homolog: EC 1.1.99.1 Choline dehydrogenase
MTRRYMTDMITHADTDVVIVGAGSAGLSCAYELSKDPSVSVAIVEQSVSPVGGACLGGQLFSAMMLRMAAHLSWTSWAWLRRGRDYVVSSTRGCSVHVMSR

SEQ ID NO: 17539 - DNA, 697 bp, Zea mays
  misc_feature: Ceres CLONE 1382662-F
  misc_feature: Encodes the peptide sequence at SEQ ID NO. 17540
  misc_feature (499)..(499): n is a, c, t, g, unknown, or other
aaagctggagctccccgcggtggcggccgctctagaactagtggatcccccgggctgcaggaattcgcacgagaccattacctagaacatcctaatcgaaaattgctcccatccatcacagctagctagcatacagacgaataatctcttcttcacctcactaacaccagctagcaactctttctctcctgcaataatggccgctcgctcctcctcctcccagccgcagatggtcgcggcggcggcggtcctgacagcggcgctgctgctgctggcggcgggggccgggacggcgtcggcggcggtgagctgcggcgaggtgacgtcgtacggtggcgccgtgcctcgggtacgcgatgggcagcgcgggtcgccctccgcggtgtgctgcagcggggtgcgctcgctcaacagcgcgcgtcgcgacgggggacgtcaggcacctgcactgctcagagcatgacggccgttcggggcggggtcacatgccaaagccgcnaaatcccctcaagtgggggtctcggcgggtgcccataaccccacccgcgaatgaacaaaattaattgacgagggaacctaaaggaaggaactccccccttgaaaggaaagaaagggcccataaaaaatggaaacggccccaaaaaaaaaatgccccacaaacggggtggccgggcccaacatggccacaaaaaaaaaa

SEQ ID NO: 17540 - protein, 88 aa, Zea mays
  misc_feature: Ceres CLONE 1382662-F
MAARSSSSQPQMVAAAAVLTAALLLLAAGAGTASAAVSCGEVTSYGGAVPRVRDGQRGSPSAVCCSGVRSLNSARRDGGRQAPALLRA

SEQ ID NO: 17541 - DNA, 615 bp, Zea mays
  misc_feature: Ceres CLONE 1382664-F
  misc_feature: Encodes the peptide sequence at SEQ ID NO. 17542
  misc_feature (558)..(558): n is a, c, t, g, unknown, or other
  misc_feature (571)..(571): n is a, c, t, g, unknown, or other
  misc_feature (572)..(572): n is a, c, t, g, unknown, or other
  misc_feature (574)..(574): n is a, c, t, g, unknown, or other
  misc_feature (580)..(580): n is a, c, t, g, unknown, or other
tggagctccccgcggtggcggccgctctagaactagtggatcccccgggctgcaggaattcgcacgagaccattacctagaacatcctaatcgaaaacccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctgggcgcaaatgctccgggggcggggggtcatcattggacgggtgacccccgaacaggccgcctcccgaggaggccggccggcccctgatggcctggaagggtccccccaaaatccggggaaaggggggggggcccaaatttaaaacccggccctattccggaataataaggggcgggcgccccacccccgggatatgggcaaaaagccccccattttggggggcttttttggggggggggcgccccccacaccctcttgggtgggngggggggggtgtnncncccccnccccctcccctctcctccaaaaaaaaagggtgggg

SEQ ID NO: 17542 - protein, 65 aa, Zea mays
  misc_feature: Ceres CLONE 1382664-F
MASDGSGVVTVYGSNGAELLEPSKQPKSATFSVKVGLGANAPGAGGHHWTGDPRTGRLPRRPAGP

SEQ ID NO: 17543 - DNA, 705 bp, Zea mays
  misc_feature: Ceres CLONE 1382665-F
  misc_feature: Encodes the peptide sequence at SEQ ID NO. 17544
  misc_feature (630)..(630): n is a, c, t, g, unknown, or other
tggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcggttactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcgaacggagaggtgcaggtgcttgcctgccgccagcatctccaccgcttttgcgagcgtcaggatctccgtcgccagcgcccgcgccgtcgccatcctcagctcgtcggcctccacagcagccgcgacagcgcggccttgtaggctggtcagcgcgcgtccacctcggcgtccgcgactcctaaccgggncgccctgagacgccgccgcgccgaaccgtcgaagtttccgttggagcagctgcagctcccaaccgtgccgcgcag

SEQ ID NO: 17544 - protein, 94 aa, Zea mays
  misc_feature: Ceres CLONE 1382665-F
MLLTSCRQGRGMASLSCARADGVVRSGALPAKLLLCASCCFPTAAPVANGEVQVLACRQHLHRFCERQDLRRQRPRRRHPQLVGLHSSRDSAAL

SEQ ID NO: 17545 - DNA, 800 bp, Zea mays
  misc_feature: Ceres CLONE 1382666-F
aagctggagctcaccgcggtggcggccgctctagaatagtggatcccccgggctgcaggaattcgcacgagaccattacctagaacatcctaatcgaaaaaaacccaagcctctctcccggtgccgccgccgccgacgccatcgtcgccgacccgaggccgcatgccagtgaaaccgacttccgcctcgaattgaagcattgtcgtcgtacgacaaagccaggcaggagaaggagttcgacctctcctccaacgaggtcgtcaccaagtacaagattgccgccgaaatcctgaacaacactctgaaggtggttgtgtccgagagaaagccaaaaggatacattgttgacttttgtgagaagggttactctttcatatgagaggaaactggcaatggctactggaatgccaagaaggaatattgaacggggcatttgcttctccaaacctgtggttcatcagaaacacactgtcctgccacgttctccccccttaacacagaatgatgcgaattgtagtaagaaaatgcctggtctaaaaggtaacatgggccgggtcttactcggatgcttttaatggctggggctggcaacattacccttggtaattgggtaactgcccccgggcaacggggaagaacccgggtggacgtgtcttagctggttggccaacaaccggctttcaaaaaattgaccacaggcggttttggtccaaaacgtggggcaagaaaaaataaacgactttttacctggaaccaatttcaaaaaaagcgtgccgcgccgggcttaaagatatgacata

SEQ ID NO: 17546 - DNA, 743 bp, Zea mays
  misc_feature: Ceres CLONE 1382672-F
  misc_feature (743)..(743): n is a, c, t, g, unknown, or other
aagctggagctcaccgcggtggcggccgctctagaactagtggatcccccgggctgcaggaattcgcacgagaccattacctagaacatcctaatcgaaaaagcttcggagtttctttcgaataattaaaacgaaaacaatggtgacggttcagttcttcaaccaattcccctgcacaacccgagtccaaagcccacaaaaacctaaacccctctcctagccaactactctggtgtctatgagcacgctcactcgccgtccgttgttctcccccgacgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcggtggtggattcgttgtacgcaacagaccgagggttgagcgcatcgagcgagaacgagagccgagatcggagatctaatcacacagctcgagtccaagaaacctacaccagctcccagcgatgctctcttccttctcaacggtaaatggatcctcgcgtacaaatcgattcgttggattgttcccgttgctttcacaaaggatcgtgccgttagtttaatgccgacgacatctcgcagaattatggttttcgaaaaatttcacggtcagagaatctggttctggttgctgggaccgtttaaataagacctccaatcn

SEQ ID NO: 17547 - DNA, 762 bp, Zea mays
  misc_feature: Ceres CLONE 1382673-F
gctggagctccccgcggtggcggccgctctagaactagtggatcccccgggctgcaggaattcgcacgagaccattacctagaacatcctaatcgaaaacccgtccctccactcctcccgtcgagcacttggaactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtgcagctccgtagggtggaagagatccatcaggcgctgagcgataggaggcgcccgtacaactgaagggacggccaatggcggccgtgacaggcccactctgcacgtgactcgtcgccgcgtgcttgtctgcggcttgcgacgcaaaagagtacaagcagaaagcattgctgcccccggccgaaagcggcgcttggggcgcggagtcattgttcgggctggcgccgaccgccttcaggagcgcgggcgtcccggtctgggacgcccttcctggaaagggctatgggtgtgttgccttaacaagcctggaaagaaaagggccattggcaaaaaaaagaaaacccggataatcaaaaacaaagggagagggtgggttgtgcccaaccgtgggatg

SEQ ID NO: 17548 - DNA, 729 bp, Zea mays
  misc_feature: Ceres CLONE 1382675-F
  misc_feature: Encodes the peptide sequence at SEQ ID NO. 17549
ggagctccccgcggtggcggccgctctagaactagtggatcccccgggctgcaggaattcgcacgagaccattacctagaacatcctaatcgaaaaacgcccaatgcaattgcagatgcagttgcaattgaacggaacccatttccaaagccgtcctcaatgagctaggcaatcctcgctatcctgtccccaccatccagatcttcccttgcatggacgacgccgtctccatgctcaccgctctcgccatcttcgcgagcaccgtcgagcacgccgcctacagtagcgtgcaggggtatagagctgctcggaaggaaacgtgggcattcgctctgttaaccagaggggggtggagcgccaaatacgccctctccctctccttccccacggtagtgttcaaaggttgccctggcccccccggcgcggggccgggggataaagtgccaagggggggggccaaaccccccccgggtcccccgggggaaaaaaaccctcaacctttgggggtggccttggggggaatttaaaatgcggggcacaagggtttttttcgtttctcccccccccccaccggggtttttcccccctccgtgggaaccccaccctgtgggaaatttggtttaaacccaaaacaaagggcccggggggggggggggtcttctccctccacaaaaaaaaaaaaaaaaatgtttccccaccaaccctctcttttttgttggaaaacccccc

SEQ ID NO: 17549 - protein, 104 aa, Zea mays
  misc_feature: Ceres CLONE 1382675-F
MDDAVSMLTALAIFASTVEHAAYSSVQGYRAARKETWAFALLTRGGWSAKYALSLSFPTVVFKGCPGPPGAGPGDKVPRGGAKPPPGPPGEKNPQPLGVALGGI

SEQ ID NO: 17550 - DNA, 725 bp, Zea mays
  misc_feature: Ceres CLONE 1382677-F
  misc_feature: Encodes the peptide sequence at SEQ ID NO. 17551
  misc_feature (675)..(675): n is a, c, t, g, unknown, or other
gctggagctccccgcggtggcggccgctctagaactagtggatcccccgggctgcaggaattcgcacgagaccattacctagaacatcctaatcgaaaaccccattcacattcggccattctccaccgtccaaccaaccaccggtggcggcacaagggaagcgaagaggaatcaacgcgatgtctgcgaccacggcggcggtgcccttctggcgggcggccgggatgacctacatcggctactccaacatctgcgctgcgctggtacggaactgcctcaaggagcccttcaagtccgaggccgcgtcccgcgagaaggtccatttctccatctccaagtggacggatggcaaacaggagaagcccactggtcgcacagaatccgatgaataaagctctggtgccatagtggcatagtccttgctacagatgatttgaagtgttgttgcaagtttccggaacatgctatttagcttggttgattttataggccatgctgaatattaatactttttacgaaaatggtctttttcgttgctaatggcactccgccaccctgaatcagtcatgtgaacatcagggaaaggttcacattttgaaaaacctaaaattggtggggttgtccgaaaaattctatggccgggcccctcaaaaataacggaataatggaatggtntggttttttaaaggccccccttaaaaaaaaaaaaaaaaaaagcttattcg

SEQ ID NO: 17551 - protein, 70 aa, Zea mays
  misc_feature: Ceres CLONE 1382677-F
  misc_feature (9)..(57): Pfam Name: ATP-synt_Eps Pfam Description: Mitochondrial ATP synthase epsilon chain
MSATTAAVPFWRAAGMTYIGYSNICAALVRNCLKEPFKSEAASREKVHFSISKWTDGKQEKPTGRTESDE

SEQ ID NO: 17552 - DNA, 732 bp, Zea mays
  misc_feature: Ceres CLONE 1382678-F
  misc_feature: Encodes the peptide sequence at SEQ ID NO. 17553
aaagctggagctccccgcggtggcggccgctctagaacaagtggatcccccgggctgcaggaattcgcacgagaccattacctagaacatcctaatcgaaaaatcgcacatattacttgagaccaactaccaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagtggtgtcttcggtatgtgaaaacccaattcttcaaccctacaggatccaacaggcaatcacagctggcatcttacctttatcacccttgttcctccaacaatcatcagccctattacatcagttacctttggtgcatttattggcacaaaacatcacggcacaacaactacgacaacttgtgctagcaaaccttgctgcctactctcagcaacagcagtttcttccattcaaccaactagctgcattgaactctgcttcttatttgcaacaacaacaactaccattcagccaggtacctgctgcctaccgccagcaatttcttccattcaaccaactggcagcattgaactctcctgcttatgtacagcagcaacaactactaccattcaggcagctagctggtgagagccatgctaccttcgtgatacaacacagtgtgtgccg

SEQ ID NO: 17553 - protein, 190 aa, Zea mays
  misc_feature: Ceres CLONE 1382678-F
  misc_feature (1)..(190): Pfam Name: Zein Pfam Description: Zein seed storage protein
MAAKIFCLLMLLGLSASAATATIFPQCSQAPIASLLPPYLSPVVSSVCENPILQPYRIQQAITAGILPLSPLFLQQSSALLHQLPLVHLLAQNITAQQLRQLVLANLAAYSQQQQFLPFNQLAALNSASYLQQQQLPFSQVPAAYRQQFLPFNQLAALNSPAYVQQQQLLPFRQLAGESHATFVIQHSVC

SEQ ID NO: 17554 - DNA, 686 bp, Zea mays
  misc_feature: Ceres CLONE 1382679-R
  misc_feature: SWISSPROT Homolog: EC 4.1.2.13 Fructose-bisphosphate aldolase
  misc_feature (1)..(1): n is a, c, t, g, unknown, or other
ncgattgggtaccgggccccccctcgaggtcgacggtatcgataagcttagcatcactctttgtaagttccaagagtggcttcagagttatgccttgcacctacgatacaaggcctcttgagcagccttaagattctcctctttacctgcccatgtcttcaaagtgctctgttgcgacgcacgtccgaacaagaaggacaacgaccacggcttcttggtcttcaactggttcatcgcgttcaggttcttggtcgcctcctcctcgctctgtcctccagacaagaacacgatagctggaacagccgctgggaccgttctctgaagggcgcgcacggtgtgctcagcgatcacctccggtgcaaccttagcactgtcggatcctggagtaccatgttaggcttcaagagagttccctccaggaaaacatgggggacgctaatagccttgtagcatgccgcgaggacacgctcggtcacagcagcacacttgtggatgtcatgagaaccgtcgactagaatctcaggctcgacgatgggtacaagaccgttctcctggcagataacagcgtacctagccaacccgtaagcgttctcgcgcatggaaagctctgatggctacctctcaccgatcttgagaacgcacgccacttggcgaaacgtgcactagcttcgtagtactcactgctt

SEQ ID NO: 17555 - DNA, 731 bp, Zea mays
  misc_feature: Ceres CLONE 1382680-F
  misc_feature: Encodes the peptide sequence at SEQ ID NO. 17556
  misc_feature (658)..(658): n is a, c, t, g, unknown, or other
  misc_feature (731)..(731): n is a, c, t, g, unknown, or other
tggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcaacggaggaggctgttgtggctgaggtcccggtgaccgaggtgccagcggaggtcccggcggcccaggtggccgaggcgcccaaggtgaagaaggcgcccaaggagaagaaggcgcctaaggagaagaagctttccgcggcgaagaagccggcggcgcaccctccctacgctgagatgattgtagaggcgatcgctgccctcaaggagaggaaggggtcgagctcggtggccatcagcaagtacgtctaggggaagcatggcggcaagctccccaccaacttccgcaagcagctcactgtgcagctgaagaagctcgctgccgccggcaagctgacgagggtgaagaactcccttcagctgccggccaccgacgccaagcccatgtccgccaagcccatgttacccaggcccgcgccctagcccaagccctcgccgaatgcgaaaggccagaccgctgcgaagcccnaaggcgctgtcgcccaaacccatgcccaagccaaggtcaaagctgtcgctcctgccgccgcgtcgcacaagcn

SEQ ID NO: 17556 - protein, 84 aa, Zea mays
  misc_feature: Ceres CLONE 1382680-F
  misc_feature (54)..(85): Pfam Name: Linker_histone Pfam Description: linker histone H1 and H5 family
MSTEEAVVAEVPVTEVPAEVPAAQVAEAPKVKKAPKEKKAPKEKKLSAAKKPAAHPPYAEMIVEAIAALKERKGSSSVAISKYV

SEQ ID NO: 17557 - DNA, 607 bp, Zea mays
  misc_feature: Ceres CLONE 1382696-F
  misc_feature: Encodes the peptide sequence at SEQ ID NO. 17558
  misc_feature (372)..(372): n is a, c, t, g, unknown, or other
  misc_feature (584)..(584): n is a, c, t, g, unknown, or other
ggagctccccgcggtggcggccgctctagaactagtggatcccccgggctgcaggaattcgcacgagaccattacctagaacatcctaatcgaaaaacacaagagaaaagcagagggggccagatgaggagggacctcgcatcctccttcgctaccgccgcatcctcttcctcggcagccgacgcgctccggggctggtgggatgacgtcaacgagtcgccccagtgccaggacgcggccttcttctccctcgccgccgcctacgccctcgtctccgccgtcgcactgattcagctcgtcaggatccagcgccgggtgcccgagttcggatggaccacgcagaaggtcttccacctcatgaacttccttgtncacgggggtccgtgctctgggatcggcttcatggtcacgtcttctcctccgcgcaaagtatacaaagtggtgttgctagatctccctgggctggtgtttttctcaactacaacttgctcgtgctcttctgggcagaatataccatcaggctaggagtctcccacagacagctgggggctgcatacctggcgttaacacatcataatacgtgntcaggtttgcaattggaatacct

SEQ ID NO: 17558 - protein, 133 aa, Zea mays
  misc_feature: Ceres CLONE 1382696-F
  misc_feature (9)..(133): Pfam Name: DUF1084 Pfam Description: Protein of unknown function (DUF1084)
MRRDLASSFATAASSSSAADALRGWWDDVNESPQCQDAAFFSLAAAYALVSAVALIQLVRIQRRVPEFGWTTQKVFHLMNFLVHGGPCSGIGFMVTSSPPRKVYKVVLLDLPGLVFFSTTTCSCSSGQNIPSG

SEQ ID NO: 17559 - DNA, 646 bp, Zea mays
  misc_feature: Ceres CLONE 1382701-F
  misc_feature: Encodes the peptide sequence at SEQ ID NO. 17560
  misc_feature (528)..(528): n is a, c, t, g, unknown, or other
tggagctccccgcggtggcggccgctctagaactagtggatcccccgggctgcaggaattcgcacgagaccattacctagaacatcctaatcgaaaaaagcagccacagcagcctccttcctcctctcactctcgctcgtgctgcgctcgctacctcgcttcgcattccattcgaggagagcggtgagaggggaggaaaggcaagatgttcatcgagagcttccgcgtcgagagcccccacgtgcggtacggcccgacggagatcgagtcggagtaccggtacgacacgacggagctggtacacgagggcaaggacggcgcctcacgctgggtcgtccgccccaagtccgtcaagtacaacttccggaccagaaccgccgtccccaagctcggggtgatgcttgtggggtggggaggcaacaacgggtccacgctgacggctggggtcattgccaacagggaggggatctcatgggcgaccaaggacaaggtgcagcaagccaactactacggctccctcacccaggnctccaccatcagagtcggcagctaccacggggaggagatctatgcggcggtcaagagcctccttcccatgtgaaaccaaacgacattggggtcggaggctggaacatagccacatgag

SEQ ID NO: 17560 - protein, 131 aa, Zea mays
  misc_feature: Ceres CLONE 1382701-F
  misc_feature: SWISSPROT Homolog: EC 5.5.1.4 Inositol-3-phosphate synthase
  misc_feature (108)..(108): Xaa is any aa, unknown, or other
MFIESFRVESPHVRYGPTEIESEYRYDTTELVHEGKDGASRWVVRPKSVKYNFRTRTAVPKLGVMLVGWGGNNGSTLTAGVIANREGISWATKDKVQQANYYGSLTQXSTIRVGSYHGEEIYAAVKSLLPM

SEQ ID NO: 17561 - DNA, 642 bp, Zea mays
  misc_feature: Ceres CLONE 1382714-F
  misc_feature: Translation starting site: 153
  misc_feature (226)..(226): n is a, c, t, g, unknown, or other
  misc_feature (232)..(232): n is a, c, t, g, unknown, or other
  misc_feature (238)..(238): n is a, c, t, g, unknown, or other
  misc_feature (253)..(253): n is a, c, t, g, unknown, or other
  misc_feature (309)..(309): n is a, c, t, g, unknown, or other
  misc_feature (319)..(319): n is a, c, t, g, unknown, or other
  misc_feature (349)..(349): n is a, c, t, g, unknown, or other
  misc_feature (561)..(561): n is a, c, t, g, unknown, or other
  misc_feature (565)..(565): n is a, c, t, g, unknown, or other
tggagctccccgcggtggcggccgctctagaactagtggatcccccgggctgcaggaattcgcacgagaccattacctagaacatcctaatcgaaaaacatagcgaacaaacatcgagtacagtcggctaggtaatctggtggtacgacgacatggcggccaccagcagcaagtcgtcgtcgtcctcgagctcggcgcagcgggcagctgccgcactgctcgtggncgccgncgtggncgtgtccgtcctggntggtggcgccggccgcgtgtgccacatgaacaacgagcagttcatgtcgtggcagnccgcggcggncaagacgaggaacccgccggcgcgccgttncaagggtgctgtgacacgctggcgggggcggaactcaagtggctgtgcgggtatcagaatcgccgtgggatgggggtgtataaaatataccccaaagcgcgcatggaactttccggccagtgtgggctctccacgccggccgactggtgataaatggggctaatccaaggccagccccaacaggaagggccccggattgctaactgtacaangggntgtgggtggtgatcttcagcagggttggaagcagggggcccccaacacaaaaaggggttttttttttctctctcatt

SEQ ID NO: 17562 - DNA, 606 bp, Zea mays
  misc_feature: Ceres CLONE 1382723-F
  misc_feature: Encodes the peptide sequence at SEQ ID NO. 17563
gctctagaactagtggatcccccgggctgcaggaattcgcacgagaccattacctagaacatcctaatcgaagtatctgaccaagtcacacgacaccaccaccagccctccccttcatcaattggaggacggggtccgttcattcccctcttctccgctgcttgcctccggctccccaattccacgagatctccaattccaccgcgtcgtctctgcatccggaccccataccccgatcgatccctaaggcccatggttttctccgccgacgcgtcgcctctagtaggcaccggtgctgactctgcttcctcctgcgtcgcccacctccgctgctgctgtcgcgttagttgctggcgatgatgaagacgcgtagctctttagggttcgcgatttctcgctgatcggttcgagaattggtaagctatggatcactcgcggcccacatcgtcggacctctcgctcgggctccactctcacggtcacgcccacgcccacgctcgcaggcacgcggtagccgcgccgctgcgcctgttcgacgacgcggaggagccgaagccggagcgcgtcgtggccggagaggccgacgcggagagggatgacgaggag

SEQ ID NO: 17563 - protein, 61 aa, Zea mays
  misc_feature: Ceres CLONE 1382723-F
MDHSRPTSSDLSLGLHSHGHAHAHARRHAVAAPLRLFDDAEEPKPERVVAGEADAERDDEE

SEQ ID NO: 17564 - DNA, 744 bp, Zea mays
  misc_feature: Ceres CLONE 1382724-F
  misc_feature: Encodes the peptide sequence at SEQ ID NO. 17565
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (43)..(43): n is a, c, t, g, unknown, or other
nnnnnnnnnnnnnnnnnnnnttgtttgttcggtgcctacgcgnccccccccaagctggagctccccgcggtggcggccgctctagaactagtggatcccccgggctgcaggaattcgcacgagaccattacctagaacatcctaatcaaaaactctcgatccggaaacctctcaaaccctagccgcctcctgcaagtttcagagctcaggaatctgcgccatggcgagtgagacggagaccttcgcatttcaggctgagatcaaccagctgctctcactcatcatacaacaccttctactccaacaaggagatcttcctccgcgagcttatctccaactcttccgatgcgctggacaagatcaggttcgagagtctcactgacaagagcaagctcgatgcgcagcctgagcttttcatccaccttgtcccagacaaggccacgaacacgctctccatcatcgacagcggcatcggcatgaccaagtccgaccttgtcaacaacctcggtaccatcgccaggtccgggacgaaggagttcatggaagcccttgctgccggcgctgatgtgtcctggattggccagttccgggcgtcggtttctactctgcctacctcgcgcccgaatagaggtgtcgtgaccaccaagcacaacgatgacgagcagaacggtgtgggagtccccaggcggggcggggtcgtttcacttggtactcgtggacaccgtgcagggggagccaagcttg

SEQ ID NO: 17565 - protein, 89 aa, Zea mays
  misc_feature: Ceres CLONE 1382724-F
MTKSDLVNNLGTIARSGTKEFMEALAAGADVSWIGQFRASVSTLPTSRPNRGVVTTKHNDDEQNGVGVPRRGGVVSLGTRGHRAGGAKL

SEQ ID NO: 17566 - DNA, 637 bp, Zea mays
  misc_feature: Ceres CLONE 1382728-F
  misc_feature: Encodes the peptide sequence at SEQ ID NO. 17567
  misc_feature (324)..(324): n is a, c, t, g, unknown, or other
  misc_feature (539)..(539): n is a, c, t, g, unknown, or other
  misc_feature (579)..(579): n is a, c, t, g, unknown, or other
  misc_feature (580)..(580): n is a, c, t, g, unknown, or other
tggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctggtcaaccgctggaccttcgatgatgtccaggtgaacgacatctcgctgaacgactacctcgctgtgaacgcgacgaagcacgcgatgtacctgccngcacaccgcgggcgttactcccagaagcggttccgcaaggcgcagtggccgatcgtcgagcgcctcacaaactccctcatgatgcacgggcgcaacaacggcaagaagggcatggctgtccgcatcatcaagcataccctggagatcattcacctgctcaccgatgccaccccatcccaggtcgtcggtcgacgcgatcatcaacagtggacccncgtgaggtgcacccgatggtccccctcgcggggtgttttnnaaaaaaaaaacaaacccccccgggaaattctacccccccggggagggagggggaacc

SEQ ID NO: 17567 - protein, 149 aa, Zea mays
  misc_feature: Ceres CLONE 1382728-F
  misc_feature (46)..(135): Pfam Name: Ribosomal_S7 Pfam Description: Ribosomal protein S7p/S5e
  misc_feature (117)..(117): Xaa is any aa, unknown, or other
  misc_feature (130)..(130): Xaa is any aa, unknown, or other
  misc_feature (131)..(131): Xaa is any aa, unknown, or other
MAEVEQQQDTPKLVNRWTFDDVQVNDISLNDYLAVNATKHAMYLPAHRGRYSQKRFRKAQWPIVERLTNSLMMHGRNNGKKGMAVRIIKHTLEIIHLLTDATPSQVVGRRDHQQWTXVRCTRWSPSRGVXXKKNKPPREILPPRGGRGN

SEQ ID NO: 17568 - DNA, 625 bp, Zea mays
  misc_feature: Ceres CLONE 1382733-F
  misc_feature: Encodes the peptide sequence at SEQ ID NO. 17569
  misc_feature (358)..(358): n is a, c, t, g, unknown, or other
  misc_feature (540)..(540): n is a, c, t, g, unknown, or other
  misc_feature (545)..(545): n is a, c, t, g, unknown, or other
  misc_feature (546)..(546): n is a, c, t, g, unknown, or other
  misc_feature (610)..(610): n is a, c, t, g, unknown, or other
tccccgcggtggcggccgctctagaactagtggatcccccgggctgcaggaattcgcacgagaccattaccagaacatcctaatcgaaaaatcaccaccactgggtcttcagaccattagcttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgnccaccgccggtccatggtgccgccgccggttcatctgccgccgccaccatgccactaccctactcaaccgccccggcctcagcctcatccccagccacacccatgcccgtgccaacagccgcatccaagcccgtgccagctgcagggaaactgtgcggcgttggcagcaccccgatcctggngcagnngtgcgtcgaagttcctggaggcatcagggcagccccgacggcgacgccctatggctcgctcagntggcaagtcgtgggg

SEQ ID NO: 17569 - protein, 55 aa, Zea mays
  misc_feature: Ceres CLONE 1382733-F
  misc_feature (27)..(27): Xaa is any aa, unknown, or other
  misc_feature (29)..(29): Xaa is any aa, unknown, or other
  misc_feature (50)..(50): Xaa is any aa, unknown, or other
MPVPTAASKPVPAAGKLCGVGSTPILXQXCVEVPGGIRAAPTATPYGSLXWQVVG

SEQ ID NO: 17570 - DNA, 871 bp, Zea mays
  misc_feature: Ceres CLONE 1382734-F
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (17)..(17): n is a, c, t, g, unknown, or other
  misc_feature (45)..(45): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (871)..(871): n is a, c, t, g, unknown, or other
ttnnnnccttccccccncctcccctccccctcccttttaaatggncgnnnnccaaagctggggctccccgcggtggcggccgctctagaactagtggatcccccgggctgcaggaattcgcacgagaccattacctagaacatcctaatcgaaaagaaggtcactgtctctcttccatctttttctctctcaacaaaactccctgaattgcaaactccaccaaaacaaactccaagcccatccatcaccagtcctctgtcccctccccgaccgcaacgatctgctttgcatcttcccctccctccaattccagtcccatgcgtaatcgtctttcggaattgaatctctccatgtcatggcgctctgaacaagtacagctgcagtcacggagagaaatgtaggcaccacaaaataagtccagaaaatcccgggctgggtgctctaccaaaaaaaattcccagtcctttttcccagcccaaaatccggccttcttccggcttgttggcccattaaaggccccgcgatttttaccgaaggccttttcccccgcacggcggggcaaaaatttttctggtatatctcgaatcctctccccgcaaatcccccgaaataagccccgcgcccataaagggcgctggggcccacaaaaccctcctccccattttgctcttccccccccaaaagaacactctccccaaaaaaatttgggtacacccccacaaaagtgtgcctaccaacaactcacccgggggggagaaaacgaacacacccccccgcgcagagacgtattataaaaaaaagaaacacggggggggcgcgacaaagggtggggcggcgaacgcacgagagatcactccctgagcagggggtn

SEQ ID NO: 17571 - DNA, 657 bp, Zea mays
  misc_feature: Ceres CLONE 1382737-F
  misc_feature: Encodes the peptide sequence at SEQ ID NO. 17572
  misc_feature (462)..(462): n is a, c, t, g, unknown, or other
tccccgcggtggcggccgctctagaactagtggatcccccgggctgcaggaattcgcacgagaccattacctagaacatcctaatcgaaaaaccagctttccccttctctccggtccgggaatcggaagctcagggcagaagccatggggcagacgcatcttttgttgctcgcttgtttctgggtcctgtcaacatgctccttgctacttgatgcttcctccgatggactgttaagaatcaacctgaacaagaagagactggacaaggaagctttgactgctgcgaaattggcgaagaaggagagccaccttcgaaggtctgtgggtgctgaccagtatctcagtgcctcaactgatgacatagtccctttggacaactacctggacacccagtactttggacagatcagcatcggcacgccaccacagaacttcacagtgatattcgacactggaagtccnaccttgtgggttccctcatccaagtgctactttttcgatagcgtgctacttacaccacagatacaagtcaacccaagtcgaagacttacacaaagaagtggagaatcttgacgataacattaatggttctgggcaaatcgctggcttcttcgtgaggaccaaagggggttgggtggtaaaccttggttgtgcaaa

SEQ ID NO: 17572 - protein, 142 aa, Zea mays
  misc_feature: Ceres CLONE 1382737-F
  misc_feature: SWISSPROT Homolog: EC 3.4.23.40 Phytepsin
MGQTHLLLLACFWVLSTCSLLLDASSDGLLRINLNKKRLDKEALTAAKLAKKESHLRRSVGADQYLSASTDDIVPLDNYLDTQYFGQISIGTPPQNFTVIFDTGSPTLWVPSSKCYFFDSVLLTPQIQVNPSRRLTQRSGES

SEQ ID NO: 17573 - DNA, 758 bp, Zea mays
  misc_feature: Ceres CLONE 1382746-F
  misc_feature (1)..(1): n is a, c, t, g, unknown, or other
  misc_feature (29)..(29): n is a, c, t, g, unknown, or other
  misc_feature (33)..(33): n is a, c, t, g, unknown, or other
  misc_feature (47)..(47): n is a, c, t, g, unknown, or other
nttttttccccccccccccccctcccctntttntctttttttttttntcttgtgatcaaagctggcgctccccgcggtggcggccgctctataactagtggatcccccgggctgcaggaattcgcacgagaccattacctagaacatcctaatcgaaaaatccaggccccactgtccaggcacccaggatccagcccgtctctcctcttctccagcttccgtatccggattcttgcgcctccaagtacgatacaaaccagggccgcgccgagcgagcacgtcgcgcgacgctgcggcaggcgagatccgagaacatctcctccctcgcgccgccgcacccgcatggccgccgctggtcgcagatagggatgtgcaggcgggggcgtgcacactcccgatcccggtgggcggggaggacaaaatccccccctaccaccctgggcgggccggcgcatcgggagcctccctccgggtgggacaccacagggccgcggtcctccgctggggggggacctgaagcggcggaaggcctccccgcggaccctgccccgcgcgctcccctccgcgctgggcccgccccaggaggcgggggagccatcggggacatcccacccgctccggagacttccccaaacccagcgccgcagccgccccactacaccgggagcgtcagccggcatggagggcgttcatcccacctctctcccacctcccctccccgttgtcccccacacgatccaataccacaacaccctcct

SEQ ID NO: 17574 - DNA, 611 bp, Zea mays
  misc_feature: Ceres CLONE 1382748-F
  misc_feature: Encodes the peptide sequence at SEQ ID NO. 17575
gctctagaactagtggatcccccgggctgcaggaattcgcacgagaccattacctagaacatcctaatcgaaaactttcccctttcccctctcgcctctgctggcctcgccgagtccacccaatcccccgcgcggcgacgctagtcgcctccgatggcagcccggcgcgggccccacgtcatcaagcttcacgatcccaacccgcccctcctcggacgggcgccgggggccgcgccggccgccgtccccgcgtcctcgcgcgatgagggcctcctcgcgcagcacctgcgcgcctccgcggcgcacccggccttcgccctcatcgaggagcgcctcgccgcccgggaccaggatatccaggagctcctcgtcgacaaccagcggttcgctgccacccacgtcgcactccagcagcagctcatagcggcgcaacacgagctccgggcgggctccgtcgcccgccacagggcgcgcgccaagcgggaaggcgaggtgcgctccctgggcgacaggcggcgcatatggaggctgaggggcgggcatcgccgctgcgggcggggaggatcgaccaggtcacgccgacgtccagtgctcgccgcgggggcaacgac

SEQ ID NO: 17575 - protein, 30 aa, Zea mays
  misc_feature: Ceres CLONE 1382748-F
MEAEGRASPLRAGRIDQVTPTSSARRGGND

SEQ ID NO: 17576 - DNA, 639 bp, Zea mays
  misc_feature: Ceres CLONE 1382759-F
  misc_feature: Encodes the peptide sequence at SEQ ID NO. 17577
  misc_feature (444)..(444): n is a, c, t, g, unknown, or other
  misc_feature (445)..(445): n is a, c, t, g, unknown, or other
  misc_feature (518)..(518): n is a, c, t, g, unknown, or other
  misc_feature (534)..(534): n is a, c, t, g, unknown, or other
ggagctccccgcggtggcggccgctctagaactagtggatcccccgggctgcaggaattcgcacgagaccattacctagaacatcctaatcgaaaaatcacactcgcgaaccccgtcatcgatctcgtttcaaatccatccatcctcgtttcctccgtcccgcagcatctcaaccccatggccaagatcaagatcgggatcaatgggttcggcaggatcggaaggctggtggccagggtggccctgcagagtgacgatgtcgagctcgtcgccgtgaacgaccccttcatcagcaccgactacatgacctacatgttcaagtacgacactgtgcacggacagtggaagcaccatgaagtcaaggtgaaggactccaaaacccttctctttggtgagaaggaggttgctgtgtttggctgcaggaaccctgaggagatcccgtgnnggttcggttggtgctgaatatgttgttgagtctactggtgttttcactgaccaggagaaggctgcagctcacnttgaagggtggtgccnaagaaggttgtcatctctgctcctagcaaggaggccccatggttgggtcgttggtgtcaacgagaaggagtacaagtctgacattaacattgtctccaatgctag

SEQ ID NO: 17577 - protein, 94 aa, Zea mays
  misc_feature: Ceres CLONE 1382759-F
  misc_feature (4)..(94): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (89)..(89): Xaa is any aa, unknown, or other
  misc_feature (90)..(90): Xaa is any aa, unknown, or other
MAKIKIGINGFGRIGRLVARVALQSDDVELVAVNDPFISTDYMTYMFKYDTVHGQWKHHEVKVKDSKTLLFGEKEVAVFGCRNPEEIPXXFGWC

SEQ ID NO: 17578 - DNA, 665 bp, Zea mays
  misc_feature: Ceres CLONE 1382765-F
  misc_feature (404)..(404): n is a, c, t, g, unknown, or other
  misc_feature (443)..(443): n is a, c, t, g, unknown, or other
ggagctccccgcggtggcggccgctctagaactagtggatcccccgggctgcaggaattcgcacgagaccattacctagaacatcctaatcgaaaagtccctccactcctcccgtcgagcacttggcactgccaatggcggcagccgcccacaccccttcgatgcgcgcaagccgcctcctttcctcctgagatcgacgcacctcctcctctcgtactccattcccgctccaagttcgtttcttcggcaccgagccatcgcacggccgcccccgcatctcgtcctgctctcaggtccttggcctccgccgttcttcgacaggggcgcgccccggtgcccactccgcgaaatccgagtcccttgtggcagctccgtagggtggaagagatccatcaggcggtgangcggtaggaggcgcccgtacaactggaggggacgggcanatggcgggccggtggcagggcccactctgcacgtggctcgggcgccgcgtggcttgtctggcgcttggcgacgcaaaagagtacaagcagaagcattggttgccccggggaaagcggggctggggggcgggggcatggttgggcctggggcggcggcctcgggggggggggggcggggtttggggcgcccgggaagggaaatgggggggccctaaaaagggg

SEQ ID NO: 17579 - DNA, 623 bp, Zea mays
  misc_feature: Ceres CLONE 1382776-F
  misc_feature: Translation starting site: 417
  misc_feature (360)..(360): n is a, c, t, g, unknown, or other
  misc_feature (365)..(365): n is a, c, t, g, unknown, or other
  misc_feature (448)..(448): n is a, c, t, g, unknown, or other
  misc_feature (449)..(449): n is a, c, t, g, unknown, or other
  misc_feature (459)..(459): n is a, c, t, g, unknown, or other
aagctggagctccccgcggtggcggccgctctagaactagtggatcccccgggctgcaggaattcgcacgagaccattacctagaacatcctaatcaaaacgaaggaacctgctcggcctcgccgtccccggcgcgtggagcgcgtcgcgtccgccacacgcaccgaccatcccctgccctcatcagcaatccccggcccgcagcgtacaaatacacgctccccgccgctccgacctcactttccccgcctccatcaccaattcacgatctcctttcccgcaccgcgccccggatcgccggctcgcaattccggagttaaattcccctccaccgcaaccgtcatgggcggctcccacagncgcgnaggacgtcgatctcacctcctccgacgaagaggaggaattcgaggacgactatgacgcccgatcacccatcgcggaggccganncgagcgcggngcagcgcgacgacgacctcctccgcaccgccaaccttcctcgcttgaggccatcgacgccagttcaggtcgctggatctcaagtaccagagacccctacgcgccagctctactccacggtcggcgggggctcgccttcgcggcgctgggtgcccgccgaagccg

SEQ ID NO: 17580 - DNA, 674 bp, Zea mays
  misc_feature: Ceres CLONE 1382777-F
  misc_feature: Encodes the peptide sequence at SEQ ID NO. 17581
  misc_feature (415)..(415): n is a, c, t, g, unknown, or other
  misc_feature (431)..(431): n is a, c, t, g, unknown, or other
  misc_feature (439)..(439): n is a, c, t, g, unknown, or other
tggagctccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaggggccttagcacccgagagatcgacgaggccttccgaagggtncctgatctcaaccagnactacggntaccacttctcgcaggagcagggtcacagccaaaatcatcgggcggggtgcaagcttattgcccagcacaacctgggaacccggaaaagcctgggccttggcgcctttcaaagggacgcagggtttaactgggacccaaaaattccggggtgggggggttcttgtttgggttttgggggaaagcgctggttcttttaacaaaaaattgggcccttcccaaaggcaaagggttggg

SEQ ID NO: 17581 - protein, 156 aa, Zea mays
  misc_feature: Ceres CLONE 1382777-F
  misc_feature (37)..(139): Pfam Name: Pex14_N Pfam Description: Peroxisomal membrane anchor protein (Pex14p) conserved region
  misc_feature (89)..(89): Xaa is any aa, unknown, or other
MASGIGSGQQQPPAPAADADPGAVGDKLVFEAPPQPVREDYVQNAVKFLSHPKVRGSPVVYRRSFLEKRGLSTREIDEAFRRVPDLNQXYGYHFSQEQGHSQNHRAGCKLIAQHNLGTRKSLGLGAFQRDAGFNWDPKIPGWGGSCLGFGGKRWFF

SEQ ID NO: 17582 - DNA, 675 bp, Zea mays
  misc_feature: Ceres CLONE 1382779-F
  misc_feature: Encodes the peptide sequence at SEQ ID NO. 17583
  misc_feature (382)..(382): n is a, c, t, g, unknown, or other
  misc_feature (427)..(427): n is a, c, t, g, unknown, or other
  misc_feature (448)..(448): n is a, c, t, g, unknown, or other
  misc_feature (517)..(517): n is a, c, t, g, unknown, or other
  misc_feature (614)..(614): n is a, c, t, g, unknown, or other
  misc_feature (615)..(615): n is a, c, t, g, unknown, or other
tccccgcggtggcggccgctctagaactagtggatcccccgggctgcaggaattcgcacgagaccattacctagaacatcctaatcaaaaaacatcgatcagtcgcgtgtctaggtttcctctctcaccatagcgcccgctctgtcgcccttcgttcacctctccttcctctcgtccctgcctgccagggagaggggaagtcagaggcacggagtggcgcagagcagacgcccgtgaaccattgtagctgtccctgtcgtcgtcgtcgtcaacgaacccacacaaggaaaggatggagaagaagccgaccatcctcatgaacaggtacgagctcgggcgcacgctcgggcagggcaccttcgccaaggtgtaccacggcggnaacctcgcgtccgggcgagagcgtggccatcaaggtcatcgaccnagggagaaggtgatgcgcgtncggcatgatcgaccagatcaagcgcgagatctccgtcatgcgcctcgtcgccacccccaacgtcgtganctgcaccgaggtgatggccagcaagagcaagatatacttcgccatggagtacggttcggggggcggcgagctcttcgcccgcgtcgcccgcggcggnnttcaaggaggagcccgcgaagaaggtacttccaccgttcgggccgggggccgtcgacttc

SEQ ID NO: 17583 - protein, 74 aa, Zea mays
  misc_feature: Ceres CLONE 1382779-F
  misc_feature: SWISSPROT Homolog: EC 2.7.11.1 Non-specific serine/threonine protein kinase
  misc_feature (22)..(22): Xaa is any aa, unknown, or other
  misc_feature (55)..(55): Xaa is any aa, unknown, or other
MIDQIKREISVMRLVATPNVVXCTEVMASKSKIYFAMEYGSGGGELFARVARGGXQGGAREEGTSTVRAGGRRL

SEQ ID NO: 17584 - DNA, 629 bp, Zea mays
  misc_feature: Ceres CLONE 1382797-F
  misc_feature: Translation starting site: 187
  misc_feature (577)..(577): n is a, c, t, g, unknown, or other
  misc_feature (601)..(601): n is a, c, t, g, unknown, or other
  misc_feature (602)..(602): n is a, c, t, g, unknown, or other
cgcggtggcggccgctctagaactagtggatcccccgggctgcaggaattcgcacgagaccattacctagaacatcctaatcgaaaaaccaccgcatcccacaacccccgagctcagtttagctccactccagctccaatcgcagtcgtgaccagagcgcgagagctagctcgaggggcgtggaaaatgccgatcaataggatcgccctgatgagccaccaggaggtgtaccacccgggcgaccctcaggcggcgttcgctgagttcatctcccccctcatcttcgtcttcgccggccagggatcccgcatggtcttcagctagctgaccggcggcggtccgactacccccggggtgctgatcgcggcggacggtggcgcacgcgttcacgctggtcgtggcggtgcttgtggacgcgaacatctccggcggggacgtggaacctgccgtgatcttcggtggctttcgtgagcgactacatctccctgtgtcgggctctcttggactgggtgggagcattttgctgggacccctcgtgggggtgtttcttgctctgctgctcacgggctgggaaggncacggacatcttcgggctgagggnnggagtcccccggggggagagcccttct

SEQ ID NO: 17585 - DNA, 703 bp, Zea mays
  misc_feature: Ceres CLONE 1382809-F
  misc_feature (286)..(286): n is a, c, t, g, unknown, or other
  misc_feature (323)..(323): n is a, c, t, g, unknown, or other
  misc_feature (335)..(335): n is a, c, t, g, unknown, or other
  misc_feature (339)..(339): n is a, c, t, g, unknown, or other
  misc_feature (343)..(343): n is a, c, t, g, unknown, or other
  misc_feature (344)..(344): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (356)..(356): n is a, c, t, g, unknown, or other
  misc_feature (360)..(360): n is a, c, t, g, unknown, or other
tccccgcggtggcggccgctctagaactagtggatcccccgggctgcaggaattcgcacgagaccattacctagaacatcctaatcgaaaagagctgagctctagtgatagactggtaggtcctagctgcgcgcacgtgcactaggagggagccatactgcgcgcgcggcattccgtccatcgtcggtcgattggtatggcgggtcgtcggggcgactcggcgcctgcggcgccgttgctggagaacaggcggcgccggcgtcggaggcggaggccgggcggcggntaccaccaccacaactactaactactacgtggacggntgggcccggggntgcncccnngnnnaccgcgcnaggngggcgagccccgggcatccccctacgcccaccttcatctaccttctgggatcgccccccctctgcacgggccctacccattctcatccggtgggtccccttccttggatttccaggataaggggaacctggaccgtcggctgaaaagaaccgaaggacattcggccttccacggcgggcttccgtaggtggcctccgttcaaggttccggtagaatgctttggatttccaccgccctgggggaaataacggcggccccgcatccgggaggaaaccccggccgccgggggtcggcttctcccctcggtgggtcggggttccacaccgttgttttggccttgacg

SEQ ID NO: 17586 - DNA, 673 bp, Zea mays
  misc_feature: Ceres CLONE 1382811-F
  misc_feature: Encodes the peptide sequence at SEQ ID NO. 17587
cgcggtggcggccgctctagaactagtggatcccccgggctgcaggaattcgcacgagaccattacctagaacatcctaatcgaaaaaattccccattcaccaatccccagtattgtagtaggggggaaaaacgagagaaaagaaacagcagtagcggaggcaatacgaaatggtggccgccgtcgcgtcgccttcgtcggcggcaccctccgccgcccgtccccatccgacatacaaggagatgatcatgcaggcgctgacggagctgcgggacccgagcgggtcgagccgcagcgccatcgccagctacatcgccgaccacttctccggcctccactcgcgccacgatgccctcctctccgtccatctccgcagcctcaagtcccatggccaacttcgcctcgtctctggcaactacttcgtctccaccgccgctcagcgcgcaggggcgaggctccaacatcccgcccaaccccaaccctgctccggggcagaagcggtggttcgctggccggcctcctaagtacgcagattcagccccttccgctcgggaccccgggggtttcctgtctccaacgccgaggttcctgcacgcccggcggagaacggcagtatctcccgtgcactccgggtggctgcccccgccctccccctgctcccgttccaccggag

SEQ ID NO: 17587 - protein, 117 aa, Zea mays
  misc_feature: Ceres CLONE 1382811-F
  misc_feature (18)..(87): Pfam Name: Linker_histone Pfam Description: linker histone H1 and H5 family
MVAAVASPSSAAPSAARPHPTYKEMIMQALTELRDPSGSSRSAIASYIADHFSGLHSRHDALLSVHLRSLKSHGQLRLVSGNYFVSTAAQRAGARLQHPAQPQPCSGAEAVVRWPAS

SEQ ID NO: 17588 - DNA, 712 bp, Zea mays
  misc_feature: Ceres CLONE 1382818-F
  misc_feature: Encodes the peptide sequence at SEQ ID NO. 17589
aaagctggagctccccgcggtggcggccgctctagaactagtggatcccccgggctgcaggaattcgcacgagaccattacctagaacatcctaatcgaaaaattttctcgccttctcggcgcgctacgcctacgactgagctgaaagaagcggtagatcggcgttagcggcgagctagggttccggcgagtgcacccaatggcatcggaggcggcgcggcggcggcaggagatggcagaggaggggcaacggcacctggaggagactatcgcagcctcgttccagatcctcgtatcgatgaacgacgagctctgcaacgccggcctttggtcctcctcatccgtctcggccaccgctgcggctggctaccagcaccatcactctgctactcttccgaccccacactctgtagattccgacgccgccgacgcagggggcgcgcccagccccggcgggtcgctcgacgaggcgaggcaccgctacaagtcagccgtggcggcgctgcgggcatctatctctgccgtgtcgtcctgcgctcaggacattggatcaacagaatctgaagctgaccatgcagagattgagagattggaagagcatgcttctgctttgagaaaggaattgaaagcaaaacagcaagaaactcctcttgatcgctcgtgactaaagctgaatagcaatgggagagccttgctcctgtgaatgtcaatt

SEQ ID NO: 17589 - protein, 154 aa, Zea mays
  misc_feature: Ceres CLONE 1382818-F
MASEAARRRQEMAEEGQRHLEETIAASFQILVSMNDELCNAGLWSSSSVSATAAAGYQHHHSATLPTPHSVDSDAADAGGAPSPGGSLDEARHRYKSAVAALRASISAVSSCAQDIGSTESEADHAEIERLEEHASALRKELKAKQQETPLDRS

SEQ ID NO: 17590 - DNA, 727 bp, Zea mays
  misc_feature: Ceres CLONE 1382820-F
  misc_feature: Translation starting site: 181
  misc_feature (421)..(421): n is a, c, t, g, unknown, or other
  misc_feature (440)..(440): n is a, c, t, g, unknown, or other
  misc_feature (463)..(463): n is a, c, t, g, unknown, or other
  misc_feature (464)..(464): n is a, c, t, g, unknown, or other
  misc_feature (718)..(718): n is a, c, t, g, unknown, or other
ctccccgcggtggcggccgctctagaactagtggatcccccgggctgcaggaattcgcacgagaccattacctagaacatcctaatcgaaaagcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcgggntttgggggggggccgcccnccattcgcgctggcgctcatggnncggccgggttcgtcacctccggcgggcctcggcgtcgctgcgcctgtccgtggttctcctggatgtacaagtacctgacgggcaagcacccgccgggcgccgaccagctggaccacgccaaggcgaggctggcgtccaaggcccgcgacatcaaggatgcagcacagcaccgcatcgaccaggggcaggggtcttgagagaagaaccacctcgagcggaccgcgcgcgcgacctccttgaccactgccgggcgncggctatgg

SEQ ID NO: 17591 - DNA, 721 bp, Zea mays
  misc_feature: Ceres CLONE 1382830-F
  misc_feature: Encodes the peptide sequence at SEQ ID NO. 17592
  misc_feature (598)..(598): n is a, c, t, g, unknown, or other
tggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcggcggagagggaagcggtgagggcggcagctgcggaggcggcggccaagggcgggaagggggaatcggggaaggaggaggtgagggagtatgagagcgacatgaggaagctggaggagctgctttctaagctgaacccctcggcggaggagttcgtgccgcagtcccgccgccgcgtggacggcggcgctccccgcctttcggccgacgcgcccgtgttcgtgtcgccggcgatcgactactacgcgcgccaccaccagctcccgccgccgcagcttctgcagcagcacagccgatgacgtggctggagntttgtgggtggcgtcccccggggttgggcaggggtggcgccccggggggtatggactccagccaccgacggatccgccaatggtcacccgattcgacggaaaaaaggacgggtttcctcccgg

SEQ ID NO: 17592 - protein, 116 aa, Zea mays
  misc_feature: Ceres CLONE 1382830-F
  misc_feature (57)..(74): Pfam Name: PAM2 Pfam Description: Ataxin-2 C-terminal region
MVAVAVDGLIRGADAVPAAEREAVRAAAAEAAAKGGKGESGKEEVREYESDMRKLEELLSKLNPSAEEFVPQSRRRVDGGAPRLSADAPVFVSPAIDYYARHHQLPPPQLLQQHSR

SEQ ID NO: 17593 - DNA, 635 bp, Zea mays
  misc_feature: Ceres CLONE 1382831-F
  misc_feature: Encodes the peptide sequence at SEQ ID NO. 17594
  misc_feature (144)..(144): n is a, c, t, g, unknown, or other
  misc_feature (166)..(166): n is a, c, t, g, unknown, or other
  misc_feature (174)..(174): n is a, c, t, g, unknown, or other
  misc_feature (178)..(178): n is a, c, t, g, unknown, or other
  misc_feature (179)..(179): n is a, c, t, g, unknown, or other
  misc_feature (190)..(190): n is a, c, t, g, unknown, or other
  misc_feature (191)..(191): n is a, c, t, g, unknown, or other
  misc_feature (319)..(319): n is a, c, t, g, unknown, or other
  misc_feature (320)..(320): n is a, c, t, g, unknown, or other
  misc_feature (342)..(342): n is a, c, t, g, unknown, or other
  misc_feature (343)..(343): n is a, c, t, g, unknown, or other
  misc_feature (358)..(358): n is a, c, t, g, unknown, or other
  misc_feature (359)..(359): n is a, c, t, g, unknown, or other
  misc_feature (449)..(449): n is a, c, t, g, unknown, or other
  misc_feature (531)..(531): n is a, c, t, g, unknown, or other
tggagctccccgcggtggcggccgctctagaactagtggatcccccgggctgcaggaattcgcacgagaccattacctagaacatcctaatcgaaaactcgaaaccctagtcccctgctccattctcagccgccgccaatcccnttcccgtgctccgcaaccgctngagtgagnaagnnaagaagatggnnccggcaagggcgatggcccggctatcggcatcgatctcggcacgacgtactcttgcgtcggcgtgtggcagcacgaccgcgtcgagatcattgccaacgaccaggggtaaccggcaccacgccccctnncgtacgtcgccctttcaccggnnactccggaagccgcnnctccatcggagatggcggcaaagaaccccaggtcgccatggaacccccatcaacacccgtcttttgattgcccaagcggtctcattcggncagagagaggtcagtggatgcggtctggtcaagagtgataatcaaggtgtgggccctttcagggcactttctggggcctggnggaaaacgcaattggattgttggcccagcaacaaggggggaaggaaaaaacagtttggagcttgaagaaaaccccccccaaggggtcctaccaaaaaggggggg

SEQ ID NO: 17594 - protein, 38 aa, Zea mays
  misc_feature: Ceres CLONE 1382831-F
  misc_feature (27)..(27): Xaa is any aa, unknown, or other
MAAKNPRSPWNPHQHPSFDCPSGLIRXERGQWMRSGQE

SEQ ID NO: 17595 - DNA, 725 bp, Zea mays
  misc_feature: Ceres CLONE 1382833-F
  misc_feature: Encodes the peptide sequence at SEQ ID NO. 17596
gctctagaactagtggatcccccgggctgcaggaattcgcacgagaccattacctagaacatcctaatcgaaaaatacagtgtcacctccccggtccctcgcgaaccctagagccgcagcagcacactcccgcagtagcagcagccgccgccgccgccgcccagccgcaggaaacaggaggaagatgccggcggggcacgggcttcggtcacggacccgcgacctgttcgcgcggccgttccgcaagaagggttacatcccgctcaccacgtacctgcgcacctacaagatcggcgagctgcggctgctggctgggggaagtcggacggcgacacgctgcgggctcggcggggggggggcgccggactcattgagattaacctgccctctgcccggcttttggggcggactcttagggcccggatccatgaagcctggacggaacagaagcgcgcgggggggcgggccacaaccaacaatctctggctagaaaacaaggatacagctctgacacacaatatggaccctgacagcccgccttcgcctctgcttgcgccgtccctgacgctggtgttgtgcctcttttgctttataatgtgttacttttttcacatccagtacctcgctcctaccctccgcacacgaccgcgtaccgcccgctcattcccgcccgtccccgccccaccgcacaaccccgcgcccccacgcaacacactacaaaccac

SEQ ID NO: 17596 - protein, 101 aa, Zea mays
  misc_feature: Ceres CLONE 1382833-F
  misc_feature (2)..(70): Pfam Name: Ribosomal_L21e Pfam Description: Ribosomal protein L21e
MPAGHGLRSRTRDLFARPFRKKGYIPLTTYLRTYKIGELRLLAGGSRTATRCGLGGGGAPDSLRLTCPLPGFWGGLLGPGSMKPGRNRSARGGGPQPTISG

SEQ ID NO: 17597 - DNA, 674 bp, Zea mays
  misc_feature: Ceres CLONE 1382842-R
ccgattgggtaccgggccccccctcgaggtcgacggtatcgataagcttttttttttttttttttcagaggaaaggaagtttgtaaatgcttgatagaattcccatgttcatttcaggttcttaaaccaaccaacataaaataagcactactacacttgtccagaatctagagagagagagagagaggaactagaatccagagaggaaaggcaaataaacgaaaaatacagcctcaaaacccatgatccatcattgcaaaacccagttaatcatccttctattcctaaatacctgacacgccagaacacagaacatgactatcaccaaacacaagcaactagctaagcctctagctcctatgaactataggaaacaagctcaatgggacatcagaatttcctcaaacaacccaccacagccttaggttcaacccagacaccactgtcaacggcttgagctaacgaaaaatattaacagccatttagacccgccaacttctcagtttgtgttttcgggtcctgtggggcgacatcatttcctttctcgccatttttctctcctgctttgcctaataaacgctctttgttcaagacgtcagtctcaaccccagtaacttctgttgatccagtctctcctttaggacttctctccatgtcggtgacgctgggcagct

SEQ ID NO: 17598 - DNA, 657 bp, Zea mays
  misc_feature: Ceres CLONE 1382843-F
  misc_feature: Translation starting site: 227
  misc_feature: SWISSPROT Homolog: EC 2.4.1.207 Xyloglucan:xyloglucosyl transferase
  misc_feature (364)..(364): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcggncgcgggctggacctgacgctggaccgcacgtccggctccgggttccagtccaagagcgagtacctgttcggcaagatcgacatgcagatcaagctggtgccaggcaactccgtggcacggtcaccaccttctacctgtcgtcccagggcgacgcgcacgacgagatcgacttcgagttcctgggcaacgtgagcgggggagcctacacgctgcacaccaacgggttcacgcgcggacagggccaaggggaagcaagactccccccccctgggtcgaccctaccactgccctcn

SEQ ID NO: 17599 - DNA, 635 bp, Zea mays
  misc_feature: Ceres CLONE 1382845-F
  misc_feature: Encodes the peptide sequence at SEQ ID NO. 17600
  misc_feature (332)..(332): n is a, c, t, g, unknown, or other
  misc_feature (369)..(369): n is a, c, t, g, unknown, or other
  misc_feature (371)..(371): n is a, c, t, g, unknown, or other
  misc_feature (391)..(391): n is a, c, t, g, unknown, or other
  misc_feature (399)..(399): n is a, c, t, g, unknown, or other
tggagctccccgcggtggcggccgctctagaactagtggatcccccgggctgcaggaattcgcacgagaccattacctagaacatcctaatcgaaaaactgcgccgcggcttccagcgctcagcctccagctcccacgcgcactccacctcgtccatggccgccgatcgagtccctccccatctcctacaaccggccgccctgctcgttctccctagctgcgatgtggagctcgccctggacgatcgtccctgcccctcctctctgatctgcgtgcaggggtttccctccatggcgcctggtctcttccttgactcatgccgagcgcccagncgagctcgtcctggctccagcttcttccttggacggngnagccctcccattcctgcagnagggtggngtccctctctcatcaactttccgggttggtttccgggggaggtccccctgggtcttctggtcgcccgggcccgggggcattttttcatttccgggggaaagaacaagcccctccccagggaaaatccctttttaaagagggtggcccttttggggttttgggggggggggcaccctggggggccccagggggaaataaaaccccttgggggggtttaaaaaaggtgggaaaaaccg

SEQ ID NO: 17600 - protein, 153 aa, Zea mays
  misc_feature: Ceres CLONE 1382845-F
  misc_feature (59)..(59): Xaa is any aa, unknown, or other
  misc_feature (72)..(72): Xaa is any aa, unknown, or other
  misc_feature (79)..(79): Xaa is any aa, unknown, or other
  misc_feature (82)..(82): Xaa is any aa, unknown, or other
MAADRVPPHLLQPAALLVLPSCDVELALDDRPCPSSLICVQGFPSMAPGLFLDSCRAPXRARPGSSFFLGRXSPPIPAXGWXPSLINFPGWFPGEVPLGLLVARARGHFFISGGKNKPLPRENPFLKRVALLGFWGGGHPGGPQGEIKPLGGV

SEQ ID NO: 17601 - DNA, 717 bp, Zea mays
  misc_feature: Ceres CLONE 1382852-F
  misc_feature: Encodes the peptide sequence at SEQ ID NO. 17602
  misc_feature (313)..(313): n is a, c, t, g, unknown, or other
  misc_feature (479)..(479): n is a, c, t, g, unknown, or other
  misc_feature (491)..(491): n is a, c, t, g, unknown, or other
  misc_feature (515)..(515): n is a, c, t, g, unknown, or other
  misc_feature (627)..(627): n is a, c, t, g, unknown, or other
  misc_feature (652)..(652): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
aaagctggagctccccgcggtggcggccgctctagaactagtggatcccccgggctgcaggaattcgcacgagaccattacctagaacatcctaatcgaaaaacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggangccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcactttcgtggaggcccgnatcctggagggncgtgggcgtcgactacgtgaccgnagagccgaggtgctgacccccgccgacgacgcgcaccacatcaacaagcacaacttccgcgtcccctttcgtctgcggctgccgcgaccctcggggggcgctttcccagggntgcgcgagggcgccgcctgacgcancccaaaggggggaggccggacggggcacgttcgtcgaggccgtgcgccacggcgctccgnnnatg

SEQ ID NO: 17602 - protein, 125 aa, Zea mays
  misc_feature: Ceres CLONE 1382852-F
  misc_feature (29)..(123): Pfam Name: SOR_SNZ Pfam Description: SOR/SNZ family
  misc_feature (60)..(60): Xaa is any aa, unknown, or other
  misc_feature (116)..(116): Xaa is any aa, unknown, or other
  misc_feature (120)..(120): Xaa is any aa, unknown, or other
MASDGSGVVTVYGSNGAELLEPSKQPKSATFSVKVGLAQMLRGGVIMDVVTPEQARLAEXAGACAVMALERVPADIRAQGGVARMSDPGLIRDIKRAVTIPVMAKARIGHFRGGPXPGGXWASTT

SEQ ID NO: 17603 - DNA, 782 bp, Zea mays
  misc_feature: Ceres CLONE 1382854-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (14)..(14): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (30)..(30): n is a, c, t, g, unknown, or other
nnnnnttacctccnacccnnaacaaaananaccaccaaaaaacgaaaccaccccccaaagctggcgctccccgcggtggcggccgctctagaactagtggatcccccgggctgcaggaattcgcacgagaccattacctagaacatcctaatcgaaaaataaaaatttcgtttttctcctctcagtctccgacgccgccgcactcatccccccagacgaccaccctcctcctcctcccccacccacctcgccggaaccctagcgccgaccgcctgccgtgcccatcgacggcgatcgcattgctgcgccccgatggcgacccgcgcctccagaattgcctctgcgcgggagctcttcgttcatgaccccgacgtggtcgaggtgtctccggcaaccgcgcggttggaagggtgggctcgccggcccacaacaataggaacacgtcctactgtggtagacccgtccacgcgagggagccgccgagcgccggggtaatgtacgcgagtcccgtcagcgcccccccccctctgtcccccccccacgggcctcctccacaataattggcattgtatatgtagcgcccccgtctcaatactcccacacacgagcacgcggcccaccagccacgacctagagagagcgggtcacgtttgttcggcggcgtctggcgcttctcctcccattcccgcccccttcgtgggaggtcgcggtcgatgcggagtttcgcggcccgtaatattgagcgcgggcgatgctgagagcaattcgagtcacgtaagccc

SEQ ID NO: 17604 - DNA, 650 bp, Zea mays
  misc_feature: Ceres CLONE 1382855-F
  misc_feature: Encodes the peptide sequence at SEQ ID NO. 17605
tccccgcggtggcggccgctctagaactagtggatcccccgggctgcaggaattcgcacgagaccattacctagaacatcctaatcgaaaaacttccaccccggaccgaccaagcagagcacgcgctggcagccaagtgcacacagacacgtctctctgttcgttctcagcttgctatagcaacctctagtaggtagccatggagatggtcctggactggcgctcgctgggctccctgctggcgaccgtcgtggtgttccgcaccgcgctgcgtaacttcctgccgccggaggccgagatgctcctgcgccgcttcctcgcgtgggtcgccgccgcgttccgcccgcccagcgacaccatcctcatcgacgaggcggacgggcccacggggagcgcccccgacctctacgagtcggcgcaactctgcctcagcgcgcgctgcctcgccaccgcgcccgccgtgcgcctgcccaatccgcgccagtcgccgccccccgggggggtcctcccggactggcccaccaacccgacagcccttcctctgtggtccgcgtctttattggtagtcctcatgccgggctcgttcaaacgcaacaccgcgctcggctcgagtgtaggtaaaaacccacctcgtaactaatgtggttagc

SEQ ID NO: 17605 - protein, 146 aa, Zea mays
  misc_feature: Ceres CLONE 1382855-F
MEMVLDWRSLGSLLATVVVFRTALRNFLPPEAEMLLRRFLAWVAAAFRPPSDTILIDEADGPTGSAPDLYESAQLCLSARCLATAPAVRLPNPRQSPPPGGVLPDWPTNPTALPLWSASLLVVLMPGSFKRNTALGSSVGKNPPRN

SEQ ID NO: 17606 - DNA, 622 bp, Zea mays
  misc_feature: Ceres CLONE 1382861-F
  misc_feature: Encodes the peptide sequence at SEQ ID NO. 17607
  misc_feature (456)..(456): n is a, c, t, g, unknown, or other
  misc_feature (483)..(483): n is a, c, t, g, unknown, or other
tccccgcggtggcggccgctctagaactagtggatcccccgggctgcaggaattcgcacgagaccattacctagaacatcctaatcgaaaaacacaatacgcacacttcgcaaagcgtcttcctccgaccccatcgcctctgtggcttcctggctgtctgactgcgtctgcctggtcgtacgcgagcgcgtgcgtcccttcaccgtcacgagcggcgcacaccgtcaccgccacgctccgtcgccttccagaaaatctaaaccccagcggagccggccacggccagtcagccctcacacggactccgacgcgctgcccgctcgcctgccaaacccccaccccctcgccggcgatgctgccgcgtcgctttagcaaccacccgggctcctcctcacccctcccgttcctcgtcgtctgcggcctgctcctcgctgcggccgtagcattttccccggncgctgccgccgaggccgctggccgcgncggcggcggccgcgccgcgggccccgcgccccccccggggcgcccgggggcggcgccccgccgcgggccccccgcgccgggccgcgccggggcggggccccgccgggccccggccccccccccccccccgccccgcggc

SEQ ID NO: 17607 - protein, 90 aa, Zea mays
  misc_feature: Ceres CLONE 1382861-F
  misc_feature (35)..(35): Xaa is any aa, unknown, or other
  misc_feature (44)..(44): Xaa is any aa, unknown, or other
MLPRRFSNHPGSSSPLPFLVVCGLLLAAAVAFSPXAAAEAAGRXGGGRAAGPAPPPGRPGAAPRRGPPAPGRAGAGPRRAPAPPPPPPRG

SEQ ID NO: 17608 - DNA, 692 bp, Zea mays
  misc_feature: Ceres CLONE 1382861-R
caaattgggtaccgggccccccctcgaggtcgacggtatcgataagcttttttttttttttttttcgcttttttttttttttttttttttttttttttttttttcccgaaaaaacgcaggaggactgcgttttaaatatatattaagaagagagaaaggtctaaaagacccaaaaaacataacaacgcactccctatggaggcgagtaacactcgtacatgaaaggatccataaaaaacacccacacacactccctacaacaacctatgcaagggggcagccaaggagagccctttggctccagcaatttcccagcctcttctttcctcatctgcatgctccataatcaaaggaaggctgggagaccctccatcaaaaatgactctattacgatgcttccaaatcatccccgaccctaaaatgatgagggagtcaagaccttccctgaccaaaccatttactgtctctgaaaccatctcccaccaatccataaaaaaaactgcatctggctgtgggctaaactatgcagcccgaactttcttagccggttgtaaccaaaaaatccttggaaaaacacaatttaaaagcaaggggttcagggtttccccccttgcttggtcccaaaaaggacctcttgaaaggcgggattcaacccccctttttttcccaaaaaaataaaagttttcaaaaag

SEQ ID NO: 17609 - DNA, 750 bp, Zea mays
  misc_feature: Ceres CLONE 1382862-F
  misc_feature: Encodes the peptide sequence at SEQ ID NO. 17610
tccccgcggtggcggccgctctagaactagtggatcccccgggctgcaggaattcgcacgagaccattacctagaacatcctaatcgaaaacgaaaaaaccccaccgcagcacagcgccggcaaccgccgccatcgatcgatcgcccggaaactgacctctaccgatgtctggagccggcgaggaggataagaagcccgcggagggcggcgcccacatcaaccttaaggtcaagggacaggatggcaatgaggtgttctttcgcataaagaggtccacccagctgaagaagctgatgaacgcctattgcgaccgccagtctgtggacatgaatgccattgcattcctgtttgatggccgcaggcttcgcggcgagcagacccctgatgagctggagatggaggacggcgacaagatcgacgccatgcttcaccagaccggaggcagcgttcctaggaccacctaaaagcagcagctggggagcctccgttttgctctccggcctgcggagtactaaccaaaagggaaaaggtctttttagggaactggggaggctcgggctccctggtgccattggctggggaactcccttaacctttaattaagcggaagggttggggactttggccctggcctcccccggttaatttatcccaaaaaatggccccgcggttttggtctttccaaaaaaaaaaaaaaaaaagggttttcgaacccggcccccctccgagggggggccccgggcccccat

SEQ ID NO: 17610 - protein, 99 aa, Zea mays
  misc_feature: Ceres CLONE 1382862-F
  misc_feature (21)..(91): Pfam Name: ubiquitin Pfam Description: Ubiquitin family
MSGAGEEDKKPAEGGAHINLKVKGQDGNEVFFRIKRSTQLKKLMNAYCDRQSVDMNAIAFLFDGRRLRGEQTPDELEMEDGDKIDAMLHQTGGSVPRTT

SEQ ID NO: 17611 - DNA, 665 bp, Zea mays
  misc_feature: Ceres CLONE 1382867-F
  misc_feature: Translation starting site: 125
  misc_feature: Pfam Name: HhH-GPD Pfam Description: HhH-GPD superfamily base excision DNA repair protein
  misc_feature (446)..(446): n is a, c, t, g, unknown, or other
  misc_feature (447)..(447): n is a, c, t, g, unknown, or other
  misc_feature (467)..(467): n is a, c, t, g, unknown, or other
  misc_feature (483)..(483): n is a, c, t, g, unknown, or other
  misc_feature (507)..(507): n is a, c, t, g, unknown, or other
  misc_feature (605)..(605): n is a, c, t, g, unknown, or other
  misc_feature (634)..(634): n is a, c, t, g, unknown, or other
tggagctccccgcggtggcggccgctctagaactagtggatcccccgggctgcaggaattcgcacgagaccattacctagaacatcctaatcaaaaaggcagccgccgcaaccttctttctacgatgcctcgcaagcccaaacggaaggctccggcctcaccggcgaggcacgacccttcgccggagccctacccttcccatgcctccccctgctcggcacaatgcctggtagtccgcgatgccctcctcgcgttccacgggttccccgaagagttcgcggccttccgcgtcctccgcctcggtggcctctcgcctaaccgtgaccctcggccttcgtcccccacagtgcttgacggcctcgtcaccacgctcctctcccagaacactaccgacgccatctcccgccgcgccttcgcctcgctcaaggccgctttcccctcctggnnaccaggtggtgggagaggangggaaaagaaggttgnaggacgccatccgggggcggcggnctggcggcgacgaaggcggccaggatacggtccatgctgagggacgtgagggagcggaggggcaagatttgcctcgagtacctgcgggaactgtcggnggatgaggtgaagaaggagctctcgcggntcaaagggattggaccaaagaccgtgagttc

SEQ ID NO: 17612 - DNA, 720 bp, Zea mays
  misc_feature: Ceres CLONE 1382872-F
  misc_feature: Encodes the peptide sequence at SEQ ID NO. 17613
  misc_feature (634)..(634): n is a, c, t, g, unknown, or other
ggagctccccgcggtggcggccgctctatcctaaaggatcccccgggctgcaggaattcccacgagaccattacctagaacatcctaatcgaaaattttacgcctccgctccgccccgccccgcgtctgcctgcccagcccagacgactcccctccgacttgtacctaacctatcgagacagagttccacgaagcagcaccagcacggcgccgcctcagcctatatataaacacacagccgccccccgtcttctactctgactctcatctgaagcgcgcgagagaaacgcgtatacccaggcggcggttgaggaagaggaggagaagaagaagaagatggcttcctccgcatacgcctcatggtccaagcggtggatccgtcccgaggtacgtacgccgttgctgtttcccatctgatcgttcattcggtttctatcgatcggagaattgggtcatcggggatggatggatggatctgacgggatttgccgatcccggtgtcgcgcgcgtccatggatcaggtgtacccgctgttcgtgccgatggccgtggccttgggcatctgctcgtaccagcttgtgcgcaacatcacgggcaaccccgaggtgcgggtgaccaaggagaagagggcggncggcgtcctgtacaaccacgacgagggcgagaggtacgctatgcacgccctcaggaagttcgtccgcgggaagaacccgagatcat

SEQ ID NO: 17613 - protein, 69 aa, Zea mays
  misc_feature: Ceres CLONE 1382872-F
  misc_feature (4)..(68): Pfam Name: B12D Pfam Description: B12D protein
  misc_feature (41)..(41): Xaa is any aa, unknown, or other
MDQVYPLFVPMAVALGICSYQLVRNITGNPEVRVTKEKRAXGVLYNHDEGERYAMHALRKFVRGKNPRS

SEQ ID NO: 17614 - DNA, 661 bp, Zea mays
  misc_feature: Ceres CLONE 1382874-F
  misc_feature: Translation starting site: 221
  misc_feature: Pfam Name: Biotin_lipoyl Pfam Description: Biotin-requiring enzyme
  misc_feature: SWISSPROT Homolog: EC 2.3.1.61 Dihydrolipoyllysine-residue succinyltransferase
  misc_feature (443)..(443): n is a, c, t, g, unknown, or other
tggagctccccgcggtggcggccgctctagaactagtggatcccccgggctgcaggaattcgcacgagaccattacctagaacatcctaatcgaaaaattccagtcttttcagaacgagattgcatcgaggaaactacagaaaagggaccaaatcgaatccgtggtgcactgcccctccccctccctcacaagccgccgccgccgtgaggactccggcgaatggcgtcccgcgtcgcctcgggcctcctccgccgccgcgccgtcgccactctagggctactaaggagtcatacacatgtcagaaactacagcagtcaactttcagctttgattccagctacttctcaatgctcaaatctgacaagaagacgctattacttacctaatccatctctgtaccaagtttggagtaggtcatttgcctcagacagcggagacaagnttcgaggctgttgtgcccttcatgggtgaatctgtaactgatggaactcttgctaacttcttaaagaagcctggagacagagtcgaggccgatgaacccatagcgcagattgaaactgataaggccacctatcagacgccgcaagacctgacggtggggatattgaaaaactcattggtactgagagggcctactgacctccgggtactagagtggcc

SEQ ID NO: 17615 - DNA, 671 bp, Zea mays
  misc_feature: Ceres CLONE 1382875-F
  misc_feature: Encodes the peptide sequence at SEQ ID NO. 17616
tccccgcggtggcggccgctctagaactagtggatcccccgggctgcaggaattcgcacgagaccattacctagaacatcctaatcgaaaaccgttgcagtgcagctgcaggttctcgccgactccccttctccttcgacctccgccgctcgccgccgtttcccgtccgcggcggtgcctcctcccctcccactcttcctcgttgtcgatctcgtatcgggtaccatggcaagatcactctccaccgccctcgtgaggggacttatgagatcgtcccgtgcatcgacatcagctgctgtgtcacgaccagctatccagcagtttatgaactattcatcaggtcttagttgcactcctagtgcagatggggactcagcgacaacacgagtagctgctgatcacgacacccatcatgattttcacccaacaagtaaaagtccacatatgtctttcagtggcattgggggctcagcaggggtaggaatcccccgttgtgctccacttggaagggcgtctggccggccccaggtgcgggtgacgcgggacccacaccggaggctcccccatccctgacgtgtgctatgtccgcgctggactcgacgttcacacacgaagcgcccccaggggacgcagacaaaacccaagctgccagtgcgcgcgcgtgccggagg

SEQ ID NO: 17616 - protein, 115 aa, Zea mays
  misc_feature: Ceres CLONE 1382875-F
MARSLSTALVRGLMRSSRASTSAAVSRPAIQQFMNYSSGLSCTPSADGDSATTRVAADHDTHHDFHPTSKSPHMSFSGIGGSAGVGIPRCAPLGRASGRPQVRVTRDPHRRLPHP

SEQ ID NO: 17617 - DNA, 657 bp, Zea mays
  misc_feature: Ceres CLONE 1382881-F
  misc_feature (626)..(626): n is a, c, t, g, unknown, or other
aaagctggagctccaccgcggtggcggccgctctagaactagtggatcccccgggctgcaggaattcgcacgagaccattacctagaacatcctaatcgactcccctctctccccagccaaggacgacacgccctactcccgcctcctccgcgccgagctctttggccccgattcgcccaaacccaccaccgccacctccgcagcctccgcctcgcccaacaccaacctcttccgcttcaagaaagaccactccgctcccacctcacccttcgctaaagctgccgccgcgcaccatgactgcaccgcgggatctggagacgcgccgtcgccgcagaagccacccaggaaggtccccaaaacgccgcataagttctgttgatcaaccctgccgcgtccgtattatgcacgccaggtcctggacgcgccctccctgcaggacgacttctatctcaacctcgtcgactggtcctcgcagaacgtgctcgctgtcggcctcggcacctgcgtctacctctggtccgcgtccaatagcaaggtcaccaagctctgcgatttggggcctagggacagcgtatgcgcagtgcattggtcacgggaaggctcttatctttccattggcaccggncttggagatgtccagatttgggatagttctc

SEQ ID NO: 17618 - DNA, 624 bp, Zea mays
  misc_feature: Ceres CLONE 1382889-F
  misc_feature: Encodes the peptide sequence at SEQ ID NO. 17619
aaagctggagctccccgcggtggcggccgctctagaactagtggatcccccgggctgcaggaattcgcacgagaccattacctagaacatcctaatcgaaaaacacactgctcgttctcacgacaaattcgattcatcaaaatctacaaacgtagtagtatttacgagaatagatattacaggcccaaacagctgctgcttctgttgaagcacgccgcaccggcagacgttacccctccaatgggcgaatgcacaacggagtacaggggcctgcccgacgccaatggcgaggacgcggggacggtgccggccgcgctccgcaaggtgtccatagtcccgctcgttttcctcatcttctacgaggtctccggcgggccgttcggcatcgaggacagcgtgggcgcagcggggccgctcctcgccatcgtcggcttccttgtcctccccgtcatctggagcatcccggaggcgctgattaccgcggagctgggcaccatgttcccggagaacggcgcgtacgtcgtgtgggtcgcctcggagctcggtccctactggggattccagcaagggtgggtgaagtggctcagtggcgacatcgacaatgccctgtaccccgtcctcttc

SEQ ID NO: 17619 - protein, 128 aa, Zea mays
  misc_feature: Ceres CLONE 1382889-F
MGECTTEYRGLPDANGEDAGTVPAALRKVSIVPLVFLIFYEVSGGPFGIEDSVGAAGPLLAIVGFLVLPVIWSIPEALITAELGTMFPENGAYVVWVASELGPYWGFQQGWVKWLSGDIDNALYPVLF

SEQ ID NO: 17620 - DNA, 701 bp, Zea mays
  misc_feature: Ceres CLONE 1382890-F
  misc_feature: Encodes the peptide sequence at SEQ ID NO. 17621
  misc_feature (458)..(458): n is a, c, t, g, unknown, or other
tggagctccccgcggtggcggccgctctagaactagtggatcccccgggctgcaggaattcgcacgagaccattacctagaacatcctaatcgaaaaatacatttcgactctcaactcccaaggtcccttttttttctcgatctggaagcgccgcagtagcagccatggacgtgagcggagcaggcgggaaggcgaagaagggcgcggcggggcgcaaggccggcgggccgacgaagaagtcggtgtcgcggtccgccagggccgggctgcagttccccgtcagccgcgtcgggcggtacctcaaaaagggccggtacgcgcagcgtgtaggcacgggtgcccccgtctacctcgccgccgtcctggagtacctcgcgggccgagtgctccagctcgccggcaacgcggcaagggacaataagaagacgcgcatcatcccgcgccacgtgctcctcgncatccgcaacgacgaggagctcggtaagctgctggccggcgtcaccatcgcccacgggggcgtcctccccacatccacactgtgctcctccccaagaggtgcccgagagggggccaaggacccaagaggccggccagcccccagaaaggggaaaggggtctccctggcttaaccaattccccttacatccggcggtaaacaaaacaggttaagggaaaccccatgtttttgcccgacccatgg

SEQ ID NO: 17621 - protein, 154 aa, Zea mays
  misc_feature: Ceres CLONE 1382890-F
  misc_feature (29)..(102): Pfam Name: Histone Pfam Description: Core histone H2A/H2B/H3/H4
  misc_feature (98)..(98): Xaa is any aa, unknown, or other
MDVSGAGGKAKKGAAGRKAGGPTKKSVSRSARAGLQFPVSRVGRYLKKGRYAQRVGTGAPVYLAAVLEYLAGRVLQLAGNAARDNKKTRIIPRHVLLXIRNDEELGKLLAGVTIAHGGVLPTSTLCSSPRGAREGAKDPRGRPAPRKGKGVSLA

SEQ ID NO: 17622 - DNA, 733 bp, Zea mays
  misc_feature: Ceres CLONE 1382891-F
  misc_feature: Encodes the peptide sequence at SEQ ID NO. 17623
  misc_feature (618)..(618): n is a, c, t, g, unknown, or other
tggagctcaccgcggtggcggccgctctagaactagtggatcccccgggctgcaggaattcgcacgagaccattacctagaacatcctaatcgaaaaatctgatatcatattttgaggatgaataattagaccaggctaaacaaattaacaatgacctacaaagaatggataccaatatattatccctccttggggttcttgggctttttgagaacgaaagaaacgcgcggattattcaacaatgctcagttgatcgaggtggaattattacacgaggtcctcgcaccagttacttcaatggaattagaacaaccagctgaggaagactatagggtagaacaagcaattgccgaaagggtattagaagaagcaattttacagttgcaacaacaatcattagtacatctagagatacgaataatagtaacacaacagcaacaagaatttctaccaggagtgagacatctagtcatggagaatcctgcactctacttgcaacaagaagtgcttgcatcaaaactacttgctctaggagacgtagttggaaatgaggcacaacaacagctgcaacagtttctggcagagctcagacaactagccatggtgaaccctgtcgnctaagtactagagcaacaactgctttcatctaggccgctcgctgtggccgatgcgactacatacctggaacgacaattgttgcaacagattgtaccagctctgactcagctaggt

SEQ ID NO: 17623 - protein, 155 aa, Zea mays
  misc_feature: Ceres CLONE 1382891-F
MTYKEWIPIYYPSLGFLGFLRTKETRGLFNNAQLIEVELLHEVLAPVTSMELEQPAEEDYRVEQAIAERVLEEAILQLQQQSLVHLEIRIIVTQQQQEFLPGVRHLVMENPALYLQQEVLASKLLALGDVVGNEAQQQLQQFLAELRQLAMVNPV

SEQ ID NO: 17624 - DNA, 647 bp, Zea mays
  misc_feature: Ceres CLONE 1382891-R
tcgaggtcgacggtatcgataagcttttttttttttttttttattttttttttttttttttttttttaggctaaagtctgttctcaccgatccacttcatccaatacacacgcatccttaacacatgcgtactgccgatttgaacatcatgaactgaaaaacaaataaacgcgtgccattcacgagttcggacggacacccctgctggatcgtttggttttattacacatgcgccactgtaaaacaccggttggtcacggctcacggaaacggcgcgtgacgcttcatctcgtggggcacgacgtccaccgcgaatcccttgcggtggcggagccagtagtcggcctggcccgggtgctcctcggcgggcgcctcaacgtcggccctagcggcgcggagctcctccgtggagagggccgtacctgtcgtctcgcttccggaccaggtcggggcacacggctgccgcggggtcagcctgctgggacaccatgagcgcgggggcgcccagcggcaggcggtctccgcggtccacctgccaggtgcaccagaacttgccgaacgtggcgggcatgtggtccagctccgccttctccagcaggcccgccacgtgcgggctcgtccacagggctgacttgatctcgtgcgcg

SEQ ID NO: 17625 - DNA, 661 bp, Zea mays
  misc_feature: Ceres CLONE 1382896-F
  misc_feature: Encodes the peptide sequence at SEQ ID NO. 17626
  misc_feature (387)..(387): n is a, c, t, g, unknown, or other
  misc_feature (416)..(416): n is a, c, t, g, unknown, or other
  misc_feature (440)..(440): n is a, c, t, g, unknown, or other
  misc_feature (577)..(577): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (606)..(606): n is a, c, t, g, unknown, or other
  misc_feature (627)..(627): n is a, c, t, g, unknown, or other
  misc_feature (631)..(631): n is a, c, t, g, unknown, or other
  misc_feature (632)..(632): n is a, c, t, g, unknown, or other
tccccgcggtggcggccgctctagaactagtggatcccccgggctgcaggaattcgcacgagaccattacctagaacatcctaatcgaaaaatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaggnagtccatcgtgtcccgcgagatgacccgncgcttacatggacggaaccatggnatcaccccacgccgaccacccgacgtggtgatcgtgggcgccgggctccgcgggcctgtcctgggcgtacgagctgtcaaggacccccccgggagcgtggcattcggtggaacaatccggggccccggggggggggngcggggtttgggnnnnnaaactgtccccncccctggggggggggcaaaancccnnccacctttttccggggaaaagtggggggg

SEQ ID NO: 17626 - protein, 157 aa, Zea mays
  misc_feature: Ceres CLONE 1382896-F
  misc_feature (67)..(67): Xaa is any aa, unknown, or other
  misc_feature (130)..(130): Xaa is any aa, unknown, or other
  misc_feature (135)..(135): Xaa is any aa, unknown, or other
  misc_feature (136)..(136): Xaa is any aa, unknown, or other
  misc_feature (140)..(140): Xaa is any aa, unknown, or other
  misc_feature (147)..(147): Xaa is any aa, unknown, or other
  misc_feature (148)..(148): Xaa is any aa, unknown, or other
MATTAASSLLKSSFAGSRLPSATRTTTPSSVAVATPRAGGGPIRASISSSPTPPYDLTSFRFSPIRXSIVSREMTRRLHGRNHGITPRRPPDVVIVGAGLRGPVLGVRAVKDPPGSVAFGGTIRGPGGGXRGLGXXTVPXPGGGAKXXPPFSGEKWG

SEQ ID NO: 17627 - DNA, 672 bp, Zea mays
  misc_feature: Ceres CLONE 1382897-F
  misc_feature: Encodes the peptide sequence at SEQ ID NO. 17628
  misc_feature (563)..(563): n is a, c, t, g, unknown, or other
  misc_feature (586)..(586): n is a, c, t, g, unknown, or other
  misc_feature (603)..(603): n is a, c, t, g, unknown, or other
  misc_feature (634)..(634): n is a, c, t, g, unknown, or other
aaagctggagctccccgcggtggcggccgctctagaactagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggccgccgccgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactggctagcagtgtgctagccaagccaagccaagcaggaaggcccccggcattgctagctggtacgntggtctgtgtgtggcatctgcgncaggggtgcaggcaggngccccgttacgtaacgtggtctctttctctnctctcatcttggcccgaccctaatctgggagggggggg

SEQ ID NO: 17628 - protein, 119 aa, Zea mays
  misc_feature: Ceres CLONE 1382897-F
  misc_feature (41)..(119): Pfam Name: Tryp_alpha_amyl Pfam Description: Protease inhibitor/seed storage/LTP family
MAATSSKSSSSSSSAQRAAAALLVAAAVAVSVLVVGAAAVCDMSNEQFMSCQPAAAKTTDPPAAPSQACCDALAGADLKCLCGYKNSPWMGVYNIDPKRAMELPAKCGLATPPDWLAVC

SEQ ID NO: 17629 - DNA, 669 bp, Zea mays
  misc_feature: Ceres CLONE 1382898-F
  misc_feature: Encodes the peptide sequence at SEQ ID NO. 17630
  misc_feature (485)..(485): n is a, c, t, g, unknown, or other
  misc_feature (506)..(506): n is a, c, t, g, unknown, or other
  misc_feature (507)..(507): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
tccccgcggtggcggccgctctagaactagtggatcccccgggctgcaggaattcgcacgagaccattacctagaacatcctaatcgaaaaacaagcagcatccgcacactcccaattcccctcgagcgccgcagcgagcccaagaagccgaccgccgagccccctctccagtccagtccgcggtctcggtttcttgcttgcccggcgcccaatcttcagagagagctccttctcgtcgtctgtctccatggccgcctcgaccaagaaccgtcgccgtcctcctcgccgcggtgctcctcgcgctggtcgcgtccgcggcagccagcaggaagctggaggaggacgcacttctgggaagcctggccccagcccccgcgccggccgttgggggtgccgcggggctgcctggcggcaagccggggggcgtgggccgtcgccgctctggtctctctcgtcgccttcctcgtgatctgaggggcgtggngatcgtgctgcgcatcgcggnnagatggagggacgaatcctgcgatctggatcgcagagagagaggagaggnnnatattttatggtccgctctgtttgggccagggcggcctctcttttggctgaataaggagaggaccacgattttttttacatagaacgcccgtttaatgtgggggagagag

SEQ ID NO: 17630 - protein, 34 aa, Zea mays
  misc_feature: Ceres CLONE 1382898-F
  misc_feature (17)..(17): Xaa is any aa, unknown, or other
MEGRILRSGSQRERRGXYFMVRSVWARAASLLAE

SEQ ID NO: 17631 - DNA, 648 bp, Zea mays
  misc_feature: Ceres CLONE 1382912-R
caggtcgacggtatcgataagcttttttttttttttttttaactcttttctgaagtaaaactgaactgcaatatgatacagtaatatttctatattacgttgacgaatatgataaccatggatgaaataaaccataccccgaaaaagggaacacataatatactgatatccaattgggtgaaagcaacgcgtttaaatcaaaccgtaacttgaaaattttggacccatgggcggtgaatccacccatcatgtatccccatttcaagggcaattgtaaaacaagtatcttcataggttattagtctctgctcataaaacatcatggttgaaacgcccagagaatggagctgctctgctgagcctgcttgaggtgcattgtgagggcatagctgtttatctctagggtcctaacttgctcctggtactgcaaaactagttgcttcaagctctggacctcgtgagacctctcgtcaaactccttttggcgctcatgttgaatggctaccgcccgcttcagcacagcagtctctcgcagaacaacaatcagttgctctttgagcatcatgttttccttatgaaagttctgtgtagcttcagctcctgcacgctctacaattgatttctccatatgctccaaagctcttggac

SEQ ID NO: 17632 - DNA, 576 bp, Zea mays
  misc_feature: Ceres CLONE 1382912-F
  misc_feature: Encodes the peptide sequence at SEQ ID NO. 17633
gctctagaactagtggatcccccgggctgcaggaattcgcacgagaccattacctagaacatcctaatcgaaaaagcgtggatcgagtgcggagggagagaaacgtctatcccatgtcccgcgacgccgtggaatacgccgacggctgcggtgccgatcggctgcggcggctcgacgaggcggcgtcgccggcgcgaatgcatgccgtcaccatgtctgcggcagtctggtggcaagaggtcctcctccatcttcaccgacgagctcctcccgccatcccctacctcccctcactcctcccaccagccggagcccaagagagacccgccgttacccctcggaccgtggcagatccgacgtgacacagacgagaggcgctcgtccaccatctgcttttactcttccccgacgtgtatccacagttgcttgaataagctctgcgagagtctggagatgacttggattctgactgtagggagtttgagtttgctgcgcttacagcccgtggagggtatcttggactctactggagtcgaacctgaaaatggtcaatgtactgcaatcagcctcctgttt

SEQ ID NO: 17633 - protein, 125 aa, Zea mays
  misc_feature: Ceres CLONE 1382912-F
MPSPCLRQSGGKRSSSIFTDELLPPSPTSPHSSHQPEPKRDPPLPLGPWQIRRDTDERRSSTICFYSSPTCIHSCLNKLCESLEMTWILTVGSLSLLRLQPVEGILDSTGVEPENGQCTAISLLF

SEQ ID NO: 17634 - DNA, 731 bp, Zea mays
  misc_feature: Ceres CLONE 1382920-F
  misc_feature: Encodes the peptide sequence at SEQ ID NO. 17635
aaagctggagctccccgcggtggcggccgctctatcactagtggatcccccgggctgcaggaattcgcacgagaccattacctagaacatcctaatcgaaaaaatatatccccactcttcgcctcctttctggagcagctagggttccgtcctcgatccgatccgccgagtgcacaccacctttccccactccgatcgaatcgatgggcgccgagggtgagaagaagatgatacccctcaaaagctccgatggcgaggagttcgaggcggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgccggcgccgccgccgccgccgcctcgaaggtcggttccgacgacgtgggtggcgtctccgccaacagcaccgccgcctccggtgaggacctcaagaactgggatgcggacttcgtcaaggtcgaccagaccacgcttttcgacctcatcttgcctgcaaactatctgaacatcaaggatctgctcgacctgacctgtcagactgttgctgacatgatcaagggcaagacaccagaagagattcgcaagaccttccacatcaaaaatgacttcaccccctgagaggaagaggagatccgcagggacaaccagtggggcttcgag

SEQ ID NO: 17635 - protein, 161 aa, Zea mays
  misc_feature: Ceres CLONE 1382920-F
  misc_feature (8)..(68): Pfam Name: Skp1_POZ Pfam Description: Skp1 family, tetramerisation domain
  misc_feature (99)..(161): Pfam Name: Skp1 Pfam Description: Skp1 family, dimerisation domain
MGAEGEKKMIPLKSSDGEEFEAEEAVAMESQTIRHMIEDDCADNGIPLPNVNSKILSKVIEYCNKHVHAGAAAAAASKVGSDDVGGVSANSTAASGEDLKNWDADFVKVDQTTLFDLILPANYLNIKDLLDLTCQTVADMIKGKTPEEIRKTFHIKNDFTP

SEQ ID NO: 17636 - DNA, 668 bp, Zea mays
  misc_feature: Ceres CLONE 1382930-F
  misc_feature: Translation starting site: 169
tccccgcggtggcggccgctctagaactagtggatcccccgggctgcaggaattcgcacgagaccattacctagaacatcctaatcaaaactacggccgccgccagcatcaagctccttgctccccgaccaaaccctacctgtacccgccgccgccgccgcagcagccatgccgcccaaattggacccctctcaggtggtggaggtcttcgtccgcgtgacgggaggcgaggtcggcgcggcgtcgtcgctggcccccaagatcggcccgctcggtctctccccgaagaagatcggtgaggacatcgccaaggagaccgccaaggactggaagggcctccgcgtcaccgtcaagctcaccgtgcagaagcggcaggccaagggtctccgtcgtcccctccgccgcggcgctcgtcatcaaggcgctcaaggaacccgagagggaccaggaagaaggtcaagaacatcaagcacagcggcaaatcagccctcgacgacgtcatcgagatcgccaagacattgcggaacagtcatgggcccaggaagtgggccggaccggtcaaggaagatcctggggactgcgtccagcgtcggtggcaacggccaaatgggaaggacccaaggaactgcagaggggaatcgggtgggggggggggggggaagatcccc

SEQ ID NO: 17637 - DNA, 614 bp, Zea mays
  misc_feature: Ceres CLONE 1382933-F
  misc_feature: Encodes the peptide sequence at SEQ ID NO. 17638
  misc_feature (301)..(301): n is a, c, t, g, unknown, or other
  misc_feature (302)..(302): n is a, c, t, g, unknown, or other
  misc_feature (464)..(464): n is a, c, t, g, unknown, or other
tccccgcggtggcggccgctctagaactagtggatcccccgggctgcaggaattcgcacgagaccattacctagaacatcctaatcgaaaactggtcctccattcaagctccactactccacacctagacttcccaatcctccattgggcaacctgtcacacagtacgccgtcgcctgtggtttggtttgtggagtgagagagaaagagagagatagacatagactcggactcggagagaaggagatgatgtcgagggagcgcaagaaggcggctgctcttcaggagaagctgaagatccnntcgctcatcactcactcccacgctctgagcaacacgtcgataatcatggacggcgtcgccgtacattcagggagctgaagcaaaaggtgggtgaggctgaacagggaaattgggtgggcgcaggacgcgctgaaacaccaggcatcatcttatccccggggnacggaaataataaactaatctcgcggggtggttttttggggcccagaaaaggatggggaggttcgtttccatggcaataccaccaatttggggggggggttcgggggggtcccaggaaaaagggggcgggcttccggggaagcaaaaaaa

SEQ ID NO: 17638 - protein, 44 aa, Zea mays
  misc_feature: Ceres CLONE 1382933-F
  misc_feature (19)..(19): Xaa is any aa, unknown, or other
MMSRERKKAAALQEKLKIXSLITHSHALSNTSIIMDGVAVHSGS

SEQ ID NO: 17639 - DNA, 662 bp, Zea mays
  misc_feature: Ceres CLONE 1382934-F
  misc_feature: Encodes the peptide sequence at SEQ ID NO. 17640
  misc_feature (522)..(522): n is a, c, t, g, unknown, or other
ctcgaactagtggatcccccgggctgcaggaattcgcacgagaccattacctagaacatcctaatcgaaaaaagatgttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgaatgccggattcttcgtcttacggcttgaatcgagctgggaggctgtggatctgagcacgggaggtacaacaaatccgcgtgtatgacgagttggatcggcaccggttagtctctgaccgcaagatttttgttgttgtgttgggctgatctgccgcgttgttttgcttcagggtctagagctagcgaaatcgcagggctattagggttcctttcggagcgcggctgaagcgatgatggctgaagtcggcgggggggatcggggaacttctctggccgggttcgactcgnaatggatgaatctgcctggcggggaggattaattgcgctgaatttggggggttaggagaaatcaaagacgaggcgccgaacgtgcagcagccggaggccacacctccaaggattgtagtacaaaccgcggcagtggttcg

SEQ ID NO: 17640 - protein, 47 aa, Zea mays
  misc_feature: Ceres CLONE 1382934-F
RTSGSPGLQEFARDHYLEHPNRKKMLFEAFPSSTQPSPLQIQDCRAP

SEQ ID NO: 17641 - DNA, 748 bp, Zea mays
  misc_feature: Ceres CLONE 1382938-F
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (21)..(21): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (536)..(536): n is a, c, t, g, unknown, or other
  misc_feature (537)..(537): n is a, c, t, g, unknown, or other
  misc_feature (540)..(540): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (550)..(550): n is a, c, t, g, unknown, or other
  misc_feature (555)..(555): n is a, c, t, g, unknown, or other
  misc_feature (658)..(658): n is a, c, t, g, unknown, or other
  misc_feature (720)..(720): n is a, c, t, g, unknown, or other
gtgtggggtgantnnntcccncagtgctctcaccataagtcctcccaccccttagtgatttagtgttttccccnnnggtttnnnnaacaagctgggactccccgcggtggcggccgctctagaatagtggatcccccgggctgcaggaattcgcacgagaccattacctagaacatcctaatctaaaaaccacgcgcggacacgccgcgtccggacgtacccgctcttcattcgccactgcacacaaatactactgtgactccgtgagggagcaactggaggaagacgcaggcggcagaggccacctcacccaacacattcgtgctcattgttacattcctaccgtgcgattactggactgcgttgaatgtatatcatcgactgctgaggtctctcgggcctcgtccccctggcatgcccaccatggactgaagctaccgggcttacttgggacagcgtcgccccatgctaagaggggggcgaacccccggagtgcgggnnnnnnnnnnnnnnnnnnnnnnnnnnncnnnnccctnnttnatnnnttccnaacanccccccccacaacacctccctcacctccccccctaccctcctaataactatttctacccccagaacacccctaactttatccccccccctccttcccctcacntactttatctcaatctcccaacccccccccaatataccccccatcacgtttccctcacccanattaactcactcccccccccctttccct

SEQ ID NO: 17642 - DNA, 666 bp, Zea mays
  misc_feature: Ceres CLONE 1382943-F
  misc_feature: Translation starting site: 216
  misc_feature: SWISSPROT Homolog: EC 2.7.1.20 Adenosine kinase
  misc_feature (587)..(587): n is a, c, t, g, unknown, or other
  misc_feature (598)..(598): n is a, c, t, g, unknown, or other
aaagctggagctccccgcggtggcggccgctctagaactagtggatcccccgggctgcaggaattcgcacgagaccattacctagaacatcctaatcgaaaaacttcacacccagcgcactcgagctcgagccctcgccctctcctcaaacacaagcctcagatctcagtcacctgcgccgccgcttcgttcgtgtggaggggagaagagaggaaatggcggcgaccgagggcgtgctcctggggatgggcaaccccctcctcgacatctccgccgtcgtcgatgacgccttcctgacaaagtatgacatcaagctgaacaatgctattctcgctgaggagaagcacttgcctatgtatgacgagttggctagcaagagcaatgttgaatatattgccggaggagccacccagaactctatcagggttgcccaatggatgcttcaaactcctggtgcaacaagttacatgggatgcattggaaaggacaagtttggtgaggaaatgaaaaaaacgctcaagctgcaggagttactgctcattactacgaggatgagactgctcctactggcacatgtgctgtatgtngttgtggtggngaaaggtcattgattgcaaatctgtcagcggcaaactgggtacaatctgagcatctaaagagaccaga

SEQ ID NO: 17643 - DNA, 644 bp, Zea mays
  misc_feature: Ceres CLONE 1382944-F
  misc_feature: Encodes the peptide sequence at SEQ ID NO. 17644
  misc_feature (393)..(393): n is a, c, t, g, unknown, or other
  misc_feature (520)..(520): n is a, c, t, g, unknown, or other
  misc_feature (536)..(536): n is a, c, t, g, unknown, or other
  misc_feature (549)..(549): n is a, c, t, g, unknown, or other
  misc_feature (550)..(550): n is a, c, t, g, unknown, or other
  misc_feature (638)..(638): n is a, c, t, g, unknown, or other
tggagctccccgcggtggcggccgctctagaactagtggatcccccgggctgcaggaattcgcacgagaccattacctagaacatcctaatcgaaaaaagactcaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttgnccgtatgcgtcaagacgtacccgctaacttgctcgtgctttgatcgggttgagcgctgctccgacgcctgtaaggagtgcgtggaaacggaggactcgcgccacgtctgcgtcgacaggtaccgtgncgaccccgggcccagntgccacgacgagnnacgggaggagcgcggacccgctgacgacgacgctggtgggcagcgacgccgacggcagtgatggcagatgacagaaaagacagcgcgncgacaa

SEQ ID NO: 17644 - protein, 142 aa, Zea mays
  misc_feature: Ceres CLONE 1382944-F
  misc_feature (71)..(71): Xaa is any aa, unknown, or other
  misc_feature (113)..(113): Xaa is any aa, unknown, or other
  misc_feature (118)..(118): Xaa is any aa, unknown, or other
  misc_feature (123)..(123): Xaa is any aa, unknown, or other
MAMGAASILLMMVSLEALLLAAAAGGGTIRLPSDVGGVAADLVTAMARARARAKHQLRDEERPWGECCDLXVCVKTYPLTCSCFDRVERCSDACKECVETEDSRHVCVDRYRXDPGPXCHDEXREERGPADDDAGGQRRRRQ

SEQ ID NO: 17645 - DNA, 649 bp, Zea mays
  misc_feature: Ceres CLONE 1382945-F
  misc_feature (511)..(511): n is a, c, t, g, unknown, or other
  misc_feature (602)..(602): n is a, c, t, g, unknown, or other
  misc_feature (603)..(603): n is a, c, t, g, unknown, or other
  misc_feature (605)..(605): n is a, c, t, g, unknown, or other
  misc_feature (643)..(643): n is a, c, t, g, unknown, or other
tggagctccccgcggtggcggccgctctagaactagtggatcccccgggctgcaggaattcgcacgagaccattacctagaacatcctaatcgaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggtgagcgccgggaacgagccctccgtcctcctactagctgcgatccgtagccttgcgtcgctttcgcgcctagtctagatcgccacgttctagatctgtggtgttttactttttccgggtgcggtggtcgaatccttccatcccacaggagagctcgtggcttgtctttgattaagctcgtctcccctgtgtccgtgatctgatatacgtccggatctgtctgctgtaatcatcangaaggtaggaggcctgaggggctgaagttgacccatgagtgcgtcgcggtttcgtcgtcgctggaccccgacggcgcgctcttatccccgnngngctgctgcagggtgaagacttcttcggcgcagtggttngaactc

SEQ ID NO: 17646 - DNA, 764 bp, Zea mays
  misc_feature: Ceres CLONE 1382948-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (36)..(36): n is a, c, t, g, unknown, or other
  misc_feature (764)..(764): n is a, c, t, g, unknown, or other
nnnnnnnnnnccccnnnnnnnntttcctaannnccntggttcatatgagtggaaaaggtggagctccccgcggtggcggccgctctagaactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaaggtcttctttctgatttgaagtcaatcgcggttgggaacttatatgctcttactagatgcaaagttgctttgttgatgacatagaagaaaagaagggagggagcagaaggagagtattggtaatgggatcagagagactgtcaaaaatataactcgtgtccatggctctcttttgaaaacatgaaacatatcagatgtcaaggagtttaggacgacaggttagagcccaagggaaaggtggcttcctcggggtagaaagcaatgggatgcgggggtgggtgcttggggccttctggcgttaggcgaggagagccgatcccgggccgtccgtttaagggcttgacgaagagttccggtgcctggaaggaaaatggccgcggccttacttacgcgggtatgggccccggagggcan

SEQ ID NO: 17647 - DNA, 666 bp, Zea mays
  misc_feature: Ceres CLONE 1382950-F
  misc_feature: Translation starting site: 191
  misc_feature: SWISSPROT Homolog: EC 1.2.1.12 Glyceraldehyde-3-phosphate dehydrogenase (phosphorylating)
  misc_feature: SWISSPROT Homolog: EC 1.2.1.13 Glyceraldehyde-3-phosphate dehydrogenase (NADP(+)) (phosphorylating)
  misc_feature (466)..(466): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaaacagatcacacacactcgagaactccatttcgatcccatttgaaatcaacccatcctcgtttcctccgtctagcagcctctcaccctcatggccaagatcaagatcgggatcaatgggtttggcaggatcggaaggctggtggccagggtggccctgcagagcgacgacgtcgagctcgtcgccgtgaacgaccccttcatcagcaccgattacatgacctacatgttcaagtatgacactgtgcacggacagtggaagcaccatgaggtcaaggtgaaggactccaagacccttctctttggtgagaaggagggttgctgtgtttggctgcaggaaccctgagagttcccatggggggttcgnttggcgctgaatatgttgttgagtctactggtgttttcactgaccaggagaaggctgcagctcacttgaagggtggtgccnagaaggttgtcatttctgctcctagcaaggatgcccccatggtcgttgttggtggcaacgaaaaggagtacaggtctgacatcaacattgtctctaatgctagctggacaaccaactgc

SEQ ID NO: 17648 - DNA, 675 bp, Zea mays
  misc_feature: Ceres CLONE 1382954-F
  misc_feature: Encodes the peptide sequence at SEQ ID NO. 17649
  misc_feature (267)..(267): n is a, c, t, g, unknown, or other
  misc_feature (326)..(326): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (415)..(415): n is a, c, t, g, unknown, or other
  misc_feature (442)..(442): n is a, c, t, g, unknown, or other
aaagctggagctccccgcggtggcggccgctctagaactagtggatcccccgggctgcaggaattcgcacgagaccatacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagncttcccttcttcccccataccttccatcaatgatagcttcagtatgtgaaaaccagctnctcagccctataggctccaacaagcaatcgcagcaagcaacatacctttatcagcgttgtnnngttcacatcgccaggcctaatcttgntgcagtcattggacaaaccatcagggnacaggagctgcaggaactcgtgctacttgggaatcaacaaagaagttctggaaacctttttccctaattttcaggaaaaaaaattttttcatttcacccaagggtcaaccttggaaccctgggtgtttaatttggagaaaaaactaataaccatttcccccccggttaggttatgggcctaattcccaagaaaaaaaaaattttttctccatttaaaaaaagtgggccgcccg

SEQ ID NO: 17649 - protein, 48 aa, Zea mays
  misc_feature: Ceres CLONE 1382954-F
  misc_feature (33)..(33): Xaa is any aa, unknown, or other
MATKIFSLLMLLALSACVANATIFPQCSQAPIXFPSSPIPSINDSFSM

SEQ ID NO: 17650 - DNA, 631 bp, Zea mays
  misc_feature: Ceres CLONE 1382968-F
  misc_feature: Encodes the peptide sequence at SEQ ID NO. 17651
  misc_feature (387)..(387): n is a, c, t, g, unknown, or other
  misc_feature (631)..(631): n is a, c, t, g, unknown, or other
aaagctggagctcaccgcggtggcggccgctctagaactagtggatcccccgggctgcaggaattcgcacgagaccattacctagaacatcctaatcgaaaaattccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcgccgcctacaacttcgcggngggtcccgcgacgctccctctctccgtgctcaagcgggcgcaggcggagctggtggactaccacggctgcgggatgagcatcatgtagatgagccaccgcgggaaggagttcgacgccgccatcaagaaggccgagtccgacctgcgcgcgctcctcgcggtgcccgacacccacgccgtgctcttcctccaggcggcgcccacacggagatcggcgccgtcccgctcaacctctgaacggggn

SEQ ID NO: 17651 - protein, 97 aa, Zea mays
  misc_feature: Ceres CLONE 1382968-F
  misc_feature: SWISSPROT Homolog: EC 2.6.1.52 Phosphoserine transaminase
  misc_feature (69)..(69): Xaa is any aa, unknown, or other
MAAAATTPHSLLLQRAAIPAAPSRASAAASPVRLPVRAARISCAAVAAPSPAAAAAADEVERAAYNFAXGPATLPLSVLKRAQAELVDYHGCGMSIM

SEQ ID NO: 17652 - DNA, 553 bp, Zea mays
  misc_feature: Ceres CLONE 1382971-F
  misc_feature (197)..(197): n is a, c, t, g, unknown, or other
  misc_feature (244)..(244): n is a, c, t, g, unknown, or other
  misc_feature (325)..(325): n is a, c, t, g, unknown, or other
aaagctggagctccccgcggtggcggccgctctagaactagtggatcccccgggctgcaggaattcgcacgagaccattacctagaacatcctaatcgaaaagtttccgtttactccggctcacgctcaccccgcctgctctatcattctcgacgatggctgggcgaccgccgccgtcctacgccaggtatcccgcngcttcaaggcggcaggccccttcgccggcgaagagcacccatcagantccccgagttgtttatccagttatcttgacccgagggctccgtagcatcttattatgcttcaggactggtctacctgtggnatcagatgttctttaaaaacgatggaattttctccacccaaaaaaccccatgggtttatgggtgggggcccaccaaaaaaaagggacccacaccccccgggtttttggggggtgggccccccaaaagggagaacaaacccccgcggggggggggggggaaattttccggcgggggggggggggctccctttaagtggtttcttttttgaaaaaaaaaaaacaccccca

SEQ ID NO: 17653 - DNA, 586 bp, Zea mays
  misc_feature: Ceres CLONE 1382982-F
  misc_feature (236)..(236): n is a, c, t, g, unknown, or other
  misc_feature (250)..(250): n is a, c, t, g, unknown, or other
  misc_feature (253)..(253): n is a, c, t, g, unknown, or other
  misc_feature (257)..(257): n is a, c, t, g, unknown, or other
  misc_feature (270)..(270): n is a, c, t, g, unknown, or other
  misc_feature (271)..(271): n is a, c, t, g, unknown, or other
  misc_feature (281)..(281): n is a, c, t, g, unknown, or other
  misc_feature (288)..(288): n is a, c, t, g, unknown, or other
  misc_feature (289)..(289): n is a, c, t, g, unknown, or other
  misc_feature (297)..(297): n is a, c, t, g, unknown, or other
  misc_feature (300)..(300): n is a, c, t, g, unknown, or other
  misc_feature (309)..(309): n is a, c, t, g, unknown, or other
  misc_feature (310)..(310): n is a, c, t, g, unknown, or other
  misc_feature (312)..(312): n is a, c, t, g, unknown, or other
  misc_feature (313)..(313): n is a, c, t, g, unknown, or other
  misc_feature (320)..(320): n is a, c, t, g, unknown, or other
  misc_feature (361)..(361): n is a, c, t, g, unknown, or other
cggctctagaactagtggatcccccgggctgcaggaattcgcacgagaccattacctagaacatcctaatcgaaaagttatcccccacccggacaatcttccttcaggcttcagctgtccgcccgcggcccacccctccgccgtctccaccattccgccgttcccaccacgccactcgccagttcggcactccctcctgtctccccccttgccgagacggcgcggacgccccgtcngccaccccgatggntgncacntctctcacgccgnncacggctcgntcagagnntctccagncgnacggggggnngnncgcacgncttcaccccctcgcggcgaccatcataaagctcgggggtcntcgtttcggcaatgcgggctcgagggtcctccgggggggtcggccgggatggttccggggaaaggaagaccccggggcgccgggtttttcccgcccaaaaggggaaaaaatggggggtctaaggggggcggtgaacggataaaacccggggggaaaaagccccgggggggcccaaaatttgtaaggaagtggttgagaagaccagggggagggccccccgaaaag

SEQ ID NO: 17654 - DNA, 683 bp, Zea mays
  misc_feature: Ceres CLONE 1382986-F
  misc_feature (389)..(389): n is a, c, t, g, unknown, or other
  misc_feature (565)..(565): n is a, c, t, g, unknown, or other
  misc_feature (566)..(566): n is a, c, t, g, unknown, or other
  misc_feature (605)..(605): n is a, c, t, g, unknown, or other
aagctggagctccccgcggtggcggccgctctagaactagtggatcccccgggctgcaggaattcgcacgagaccattacctagaacatcctaatcgaaaaatatgatgatactacggctcagcccaacgatttccttttgcaaaccctgctccaactccgattcgtcactccaccctcgtcgcgccgccgccgccgccgccgcctgccgcgtccccggccagcctcgcggcccggtggtctgctagccacagcggagagaccaggagtcatggtgatccctccaccagcaagggcagctagagtcacccgtttcctcaagccctacctattgaggatgcatttctcaaacaagtaatgtatctgctcaggtcgtccacaccccaacangcaactgttgcatgttctgcaagctcgaaagaagaagctgttgagaccaaacatggagtcgacccgtgacgtcgcagcagctgcgaaggattggaaagttgctcggcgagcgcctgctcctcaagggaattacctgcagtgtccatccacatgaagagagaacaaaagaccatggnnaaagtgaagggccgttatagattcagtcagagaagtggnagtcaagcctgttgtggattggcgatgttgaaaacattggacttagcatttgtgcaatggctgagctgaaaatcttta

SEQ ID NO: 17655 - DNA, 664 bp, Zea mays
  misc_feature: Ceres CLONE 1382987-F
  misc_feature: Encodes the peptide sequence at SEQ ID NO. 17656
  misc_feature (360)..(360): n is a, c, t, g, unknown, or other
  misc_feature (428)..(428): n is a, c, t, g, unknown, or other
  misc_feature (434)..(434): n is a, c, t, g, unknown, or other
  misc_feature (448)..(448): n is a, c, t, g, unknown, or other
  misc_feature (479)..(479): n is a, c, t, g, unknown, or other
  misc_feature (612)..(612): n is a, c, t, g, unknown, or other
  misc_feature (664)..(664): n is a, c, t, g, unknown, or other
tggagctccccgcggtggcggccgctctagaactagtggatcccccgggctgcaggaattcgcacgagaccattacctagaacatcctaatcgaaaacctttcctcgcccctacccccgccaccgccgccgccgtcgccgcagccatggcgtcgcggcgctgtctcctccgcttcctctcgatccgcctcgttcctcagagatctcaacctcttgcgccgatctcgactgcgacccggaccctaacctctttgtccgaggccctcggctccccagctccccgggccctcgcctccccccgggtgtactacccctcgcgctgccacttcgcgacccgctcctccggcgacgaggacgacgnacaagacgaagaagagcactacgacgatgaggggagcgatggggaatgccgggacgatgaggaggtgntggcgncgaaaaaccgagcnggagaccgaagaggagaggtagcggaggcgncgaagatcggctacaaggtgttgggaccgctcgaggctgacgataaaacccttcagccctacgagcccgtcttcgccgtcgtacagatcggctcgcaccaattcaggtgagcaatggcgactcatctccacgnaagaggtgaaggtctgggatgtgaatgaccaagtgtctttaaacgagttctn

SEQ ID NO: 17656 - protein, 147 aa, Zea mays
  misc_feature: Ceres CLONE 1382987-F
  misc_feature (72)..(72): Xaa is any aa, unknown, or other
  misc_feature (95)..(95): Xaa is any aa, unknown, or other
  misc_feature (97)..(97): Xaa is any aa, unknown, or other
  misc_feature (112)..(112): Xaa is any aa, unknown, or other
MASRRCLLRFLSIRLVPQRSQPLAPISTATRTLTSLSEALGSPAPRALASPRVYYPSRCHFATRSSGDEDDXQDEEEHYDDEGSDGECRDDEEVXAXKNRAGDRRGEVAEAXKIGYKVLGPLEADDKTLQPYEPVFAVVQIGSHQFR

SEQ ID NO: 17657 - DNA, 828 bp, Zea mays
  misc_feature: Ceres CLONE 1382988-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
nnnnccccccnnnaacacccacacaccccccccccgacgcccccccaaccccccccgccgttccacgcggtggcggccgctctagaactagtggatcccccgggctgcaggaattcgcacgagaccattacctagaacatcctaatcgaaaaatttttttccaaatattaaaaaaaaacgccggctgcaactgcaatcggcgacggtgaaccatagagcagccggcagcgtcgccgtcgcgccgctcccgcactgctcccctgccccggccgccgccgccgtcgtcgtccgcccgctcaccgctgatcgatgaccgcccgctctggcgctcggccttcgccccgtttctgccctcgcccctcagccgcctcggcgcctgtccgagaccgacgtcctctctccatccagccagttgaccagctcgactgctctagctcgtgctctccggtcgggggaatttgatttctttcctttcggcccaagcccggcccaaaagcccggccagattccggggcaacttccgttccaaaccccttcgggggacacccgaatcccccttttcttcaacccccctcttacctaccctccgggtgggaacggggaggaagaatgcattgccccccggaagcccagaaagaaggttcccccttgcatggcgtcccttcaaacacgtgcgaagaaagcggggaaaaacggggcgaagactgatttccacacatttctcaccaaaccaacattccatcaaaaacaacaccccacgtaaataacggcctcgcgcgccccacccaggctcccgcgcaccaaaagtcagaccccactccacttccc

SEQ ID NO: 17658 - DNA, 653 bp, Zea mays
  misc_feature: Ceres CLONE 1382991-F
  misc_feature: Encodes the peptide sequence at SEQ ID NO. 17659
  misc_feature (206)..(206): n is a, c, t, g, unknown, or other
  misc_feature (209)..(209): n is a, c, t, g, unknown, or other
  misc_feature (270)..(270): n is a, c, t, g, unknown, or other
tggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggctctgtggggcggcggcgncgncagcagcaccgcgccgcccgggcagccgaccacggtagcggtccagggtgctggacatggncgcgggggcgatggaaccgttgcgccccgggaacagggggaagcacacatggggccgtttcgggtggaacggcacaacccgaaacgggaggggggggaaacaacacttaaatttccccgcttaaacaaggatttcccccagggggccgtttatggattccaaaaagaggggagggggtttttctggggggggggaaaatccggggggggagggagaaattttccatctcctggcggggggggggagaacgcctcttgtggcccctcccccgggcccaaaaaaaaaaccgggggcccggggggaaaaacccccacgggggggggtttttcttcgcaagagacaagattgggaccaccggcgggccccgcaataccggccaggtc

SEQ ID NO: 17659 - protein, 167 aa, Zea mays
  misc_feature: Ceres CLONE 1382991-F
  misc_feature (19)..(19): Xaa is any aa, unknown, or other
  misc_feature (20)..(20): Xaa is any aa, unknown, or other
MASSDGKPLPTPALWGGGXXSSTAPPGQPTTVAVQGAGHGRGGDGTVAPREQGEAHMGPFRVERHNPKREGGETTLKFPRLNKDFPQGAVYGFQKEGRGFFWGGGKSGGGGRNFPSPGGGGENASCGPSPGPKKKTGGPGGKTPTGGGFSSQETRLGPPAGPAIPAR

SEQ ID NO: 17660 - DNA, 849 bp, Zea mays
  misc_feature: Ceres CLONE 1382993-F
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (31)..(31): n is a, c, t, g, unknown, or other
nttttccccccccctnnncnagcccggcggncgccgctggccggcgcggcgccgggacgaatccccgcggtggcggccgctctagaactagtggatcccccgggctgcaggaattcgcacgcgagaccattacctagaacatcctaatcgaaaactctctcgatttctcgcggagcggccctccacctttatcgccgccgccgccgttgctgtgttccgtctcttcgccgatggcttcggccaagttcggtgctgcccagcaggtggagaaccgaggcgcgctgtccaaaaggcacgtaacgacgtgtctgtaagggagggggactgcaattgccctcagtgcgggaatggcgactccagttttaaaaaggggtgggagcgggggagccggggggggtcccccggccatcacccgactcccggggggggaggggggcgccgggcctggctgggtacgagaaaaggaagggagaccctccctgtgttaagggggggatggtgtgctggtgtccagacgccccgcgccacgccgcgggcggcacggctgccgcggcgtgtgtgggagacaggcgaagcgggggggggggcgtgaggggggggggagggggggggggagaggggcggggcgcgggccgacggtggtctgtgggcgagggcggggcgcgggtgttctagggccggcggggcggccccgacgcggagcccggctcatcgcggcggataggtgtgtccaccgccacgggcgcgcggtggtggcccgcccgcacgcgcggcggaaggagcccgcgagagggcgcgagagagggggagccgcgccggccggggggcggttccgcgcgtcgggcaggc

SEQ ID NO: 17661 - DNA, 580 bp, Zea mays
  misc_feature: Ceres CLONE 1382996-F
  misc_feature (46)..(46): n is a, c, t, g, unknown, or other
  misc_feature (325)..(325): n is a, c, t, g, unknown, or other
  misc_feature (336)..(336): n is a, c, t, g, unknown, or other
  misc_feature (341)..(341): n is a, c, t, g, unknown, or other
  misc_feature (359)..(359): n is a, c, t, g, unknown, or other
  misc_feature (484)..(484): n is a, c, t, g, unknown, or other
  misc_feature (485)..(485): n is a, c, t, g, unknown, or other
ggagctccccgcggtggcggccgctctagaactagtggatcccccngggctgcaggaattcgcacgagaccattacctagaacatcctaatcgaaaaccgtcaggctgtcactgtccccctcaccgccgccgtcctcgtcaccacacctcacccgttgctcccactccttccagaaccacctcctcgccaccgtggctgcctgccctgcccgctataagactcttcactcccgctgcgacgcagtcctcacaagcaccagaccaattaactagcttcttctagctctagctaggctcgtctggctgcaagaaggtaacagcgcangcatggagggnaaggnagaggacgtccgcctggncgcccacagttctcggagcgcagccatcgcacgggcgcgcagggcacggacgacaagactacaggagccccccgcgggcgctctcgagcccggggagttcaagtcctggtcttctaccggccggnnatcggccgaagttggcgccacctttctccttcctcaaatttcatcctcagggggattgggcggcctccaggccaacctccaaggggcccaccggt

SEQ ID NO: 17662 - DNA, 690 bp, Zea mays
  misc_feature: Ceres CLONE 1382997-F
  misc_feature: Translation starting site: 241
  misc_feature (505)..(505): n is a, c, t, g, unknown, or other
  misc_feature (569)..(569): n is a, c, t, g, unknown, or other
tggagctccccgcggtggcggccgctctagaactagtggatcccccgggctgcaggaattcgcacgagaccattacctagaacatcctaatcgaaaagagagaagtcttctctgtcacagcgccgacgcttcccaattccttccaatcggcacctcgccgtcctcgtgtgcaatccccagctctcctcgcccctccctcccaaactccagcggccccccctgaccaagctccggggacggatggacggaggagccggctttccgggcacgcagccggtctcccgctcgccggaggacgtcttccgggactaccgcgcgcgccaggccggcctgatcagggcgctcaccaccgaatggtggagaagttctacgtgatgtgcgacccagagaaggagaacttatgtttatatggacttcctaatgagacatgggaaataacttgcttgtgctgaagaggtccctcctgaactgccagagccagctcttggaaattaattttgctcgnggatggggatggattgaaaaaagattggctatcaacttgttgcagtgcattagtgattcttggnctaaaggtctggttgcatttattttggggaggcaggggttggaattccgataaagattccaggaaaacgtctccttcaccatgatcaataaccttccagcaattaaaatggaggtttgtca

SEQ ID NO: 17663 - DNA, 657 bp, Zea mays
  misc_feature: Ceres CLONE 1382999-F
  misc_feature: Translation starting site: 154
  misc_feature (372)..(372): n is a, c, t, g, unknown, or other
  misc_feature (395)..(395): n is a, c, t, g, unknown, or other
  misc_feature (470)..(470): n is a, c, t, g, unknown, or other
  misc_feature (486)..(486): n is a, c, t, g, unknown, or other
tccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaagagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaanggagtttgtggtccacaacgttntctgagctggagttgctcatgatgcacaacaggacctactgcgctgaaattgctcacaacgtgtccaccaagagncgcaaggagatccgtnggagcgtgctgcacagtccgacattgtggtcaccaacaagcttgctaggctcgcagccaggaggacgaggtagtccggttttcttgtcttaacgaccgaacttgatgttgccattcctttctgtagggacctactttggcttggtttcttgggtagaactgaaaaccagag

SEQ ID NO: 17664 - DNA, 697 bp, Zea mays
  misc_feature: Ceres CLONE 1383002-F
  misc_feature: Encodes the peptide sequence at SEQ ID NO. 17665
  misc_feature (321)..(321): n is a, c, t, g, unknown, or other
  misc_feature (697)..(697): n is a, c, t, g, unknown, or other
cgcggtggcggccgctctagaactagtggatcccccgggctgcaggaattcgcacgagaccattacctagaacatcctaatcgaaaaaccaatgtcgcgtgcggccactagatttttcctgacgcggtgtctgctcccacttcccctcctctcccccaggtggcggcagcggcggcggggtagcatttgtgctacgagggcttttgcaatggcggcttcggagttcggcggcgacgaggcgttccggctctcggccgcaccaggggccggcttactgaagctgcacaagggcgacatcaccctctggtccgtcgactgcgncaccgacgccatcgttaatgctgctaatggacggagggtaggggggggcacctgttcatacacctatacatcgggcttgtgggcccagagcttgggcaagcttgacggaaagtgtccgaggggaaaaccgggagttcgggggaaaaagggtggaaaccgggataaccccgggttttgggcgcccccgaccccggggggaggtttcccgcggaggggcactttgggagggttactatttcaagggagcattggcgggcgaggacacgcggagggcgcggcgccccacaggggtggggggagggaagggttcttggggcgggctctcccttcgccttgggggaccggggggggcgggcataagagggggggcgcccgn

SEQ ID NO: 17665 - protein, 163 aa, Zea mays
  misc_feature: Ceres CLONE 1383002-F
  misc_feature (38)..(38): Xaa is any aa, unknown, or other
MAASEFGGDEAFRLSAAPGAGLLKLHKGDITLWSVDCXTDAIVNAANGRRVGGGTCSYTYTSGLWAQSLGKLDGKCPRGKPGVRGKKGGNRDNPGFWAPPTPGGGFPRRGTLGGLLFQGSIGGRGHAEGAAPHRGGGREGFLGRALPSPWGTGGGGHKRGGAR

SEQ ID NO: 17666 - DNA, 553 bp, Zea mays
  misc_feature: Ceres CLONE 1383006-F
  misc_feature (197)..(197): n is a, c, t, g, unknown, or other
tggagctccccgcggtggcggccgctctagaactagtggatcccccgggctgcaggaattcgcacgagaccattacctagaacatcctaatcgaaaatcgtttgaccttcgtctgtcgtctcgtctcgtccacctccccagcggcgcgtgaagcttgaggcaatccccgccctctctagccctgcgcaaccagttcnggttccatgggccaacagcaatctccccgcgccgaaatccatcagggaaaacgcaggggggtttcttaacgaaccaaaaccgggaaataacgcgcgccccctcggagggaaaaaatgggggaactttcaaggggaaggacctttgggcccccggcaaccccctttaaagggggggttttacaagtgaaaatattttgccggggaaaaaaaacaaggggggccccaaaaataaaaatttctccaaaatattctcccccaaaatggggaaggggggggggaaagcgccccccctttttatgaaaaaaagaggggggcccttttttaaaaaaaaaaaacttttaagagagaattccccc

SEQ ID NO: 17667 - DNA, 697 bp, Zea mays
  misc_feature: Ceres CLONE 1383007-F
  misc_feature: Translation starting site: 161
ctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcagccctataggctccaacaagcaatcgcagcaagcaacatacctttatcagccttgttggttcaacagtcgccagccctatctttggtgcagtcattggtacaaaccatcagggcacagcagctgcagcaactcgtgctacctgtgatcaaccaagtagctctggcaaacctttctccctactctcagcaacaacaatttcttccattcgaccaactggctacactgaaccctggctgcttatttgcaggaacaactattaccattcgggcagctaggtactgcctactctcagcagcaacaacttcttccatttaaccaattgggcgaactggaacccgctgcttattttgcggaggaaatactactagcatttaa

SEQ ID NO: 17668 - DNA, 717 bp, Zea mays
  misc_feature: Ceres CLONE 1383009-F
  misc_feature: Encodes the peptide sequence at SEQ ID NO. 17669
  misc_feature (368)..(368): n is a, c, t, g, unknown, or other
  misc_feature (399)..(399): n is a, c, t, g, unknown, or other
ggagctccccgcggtggcggccgctctagaactagtggatcccccgggctgcaggaattcgcacgagaccattacctagaacatcctaatcgaaaagtctttgggtgagcacaccgcgcagcaacgagaggggcaaacaagcttgctactgtgatttctcgtccgagcagcggcggaggagagagagagagcatggccgaccacaaggaggagcctgtgccggagtctgtgatggacaagatcaccgagaagttccacggcggggactcgtcgtcgtcgtcgtctgactcggacgacgagaagaaggggtcctcgtttggcgtcggcggcggaagccatgaaggccaagatctaccgcccttttcggncgggagaggcccgtccactccgtccctcggnggggggaagcctgccgatcttatccctatggaggaccaggaagatcctctgggggggatacttggctggggccacgggcatctggctccctattccaggggcatggaggtacatctccccccccctggggggggcaactggctccttcctctcggtggccatcccccctttcctggggggcccaaaggcccccccttttccatcaacaagccccaccggaaaatatttcctgaggcaaaaaacccccggggggaggggtgggggggttttggaaaaatgggtgccccgggccccctgtaggaaaattgggaccccccc

SEQ ID NO: 17669 - protein, 168 aa, Zea mays
  misc_feature: Ceres CLONE 1383009-F
  misc_feature (59)..(59): Xaa is any aa, unknown, or other
MADHKEEPVPESVMDKITEKFHGGDSSSSSSDSDDEKKGSSFGVGGGSHEGQDLPPFSXGRGPSTPSLGGGKPADLIPMEDQEDPLGGILGWGHGHLAPYSRGMEVHLPPPGGGNWLLPLGGHPPFPGGPKGPPFSINKPHRKIFPEAKNPRGEGWGGFGKMGAPGPL

SEQ ID NO: 17670 - DNA, 713 bp, Zea mays
  misc_feature: Ceres CLONE 1383012-F
  misc_feature (560)..(560): n is a, c, t, g, unknown, or other
  misc_feature (626)..(626): n is a, c, t, g, unknown, or other
  misc_feature (672)..(672): n is a, c, t, g, unknown, or other
  misc_feature (679)..(679): n is a, c, t, g, unknown, or other
  misc_feature (713)..(713): n is a, c, t, g, unknown, or other
tggagctccccgcggtggcggccgctctagaactagtggatcccccgggctgcaggaattcgcacgagaccattacctagaacatcctaatcgaaaaacctttttttgggttgcctagatttgttagcttcttgttgcagcggtatctactagggagtactaggatggcatagaatagaagaagtggaggtgcctgcctgctgaaaccgttctttcctctgaacaactcatctcatctttttgatcgtgaagtgtttcagctactaataagctagctaggctagggaaggagaagctagcgatggctgcagaggtcggagagcatcttcctgccctcgacgatctcgtcgaagaagtcatcgagctcagcgatgacggcctcggcgcctgatcgcagcatcccaacccagccattgatgatctctgctctctggacaaggctgtcgctgatgtcgtcgcggtagccgcccatggcgacggccctgtcgaagtcctgcttgaggccgtcgatggcggccctggcctggcggaactcgtgcatcatgatcccggccgagtgncgagcggtggtccccagcgatgatgcattcctccatctcctcgacgacgcgctggcgcaggcgggncgatgggaggcgacgtaaccgccgcccccgaggcgcggagctttgntgggggnttggcagacgcagagcagcagcccgcctgtggan

SEQ ID NO: 17671 - DNA, 711 bp, Zea mays
  misc_feature: Ceres CLONE 1383013-F
  misc_feature: Encodes the peptide sequence at SEQ ID NO. 17672
  misc_feature (475)..(475): n is a, c, t, g, unknown, or other
tccccgcggtggcggccgctctagaactagtggatcccccgggctgcaggaattcgcacgagaccattacctagaacattctaatcgaaaactttttcttccccgcaaagaaagaaggcaagagttctcggcttctcgcgagtcgcgagtcgcgacagagagagaggcggagttgcggagaagatgcagagcagcagcatgaagagggagatcagcgaggcccacgacaccattcgcttcggcatcaacgccggcgtcaaagccgacctcgccccgccgcacccgctccagtctaccatccaatcggagaccaagttctgggcggacaagaagaagttcgggacagatgccatatacggatccgccctcaacatccgcaaggatctcgatgcccaaatcctctccaggttccaaaggccccctggtgctttgccgtcatctctgcttggatacgaggcactgacaggttccttgnatgattttggatttgaagattatcttaacatggctcatgattctgacagtttcccgtcacctgacatgcacatgggaatggaggttcgcctttggtttgtccaggggacctatctgtcctagcttcaatggaggcagaattggatttctggctgcagtttcccttctccggcccggacttccggcatagaccccttttaaggaggggggaattggaaaactgggaccttggactgg

SEQ ID NO: 17672 - protein, 137 aa, Zea mays
  misc_feature: Ceres CLONE 1383013-F
  misc_feature (2)..(131): Pfam Name: UMP1 Pfam Description: Proteasome maturation factor UMP1
  misc_feature (98)..(98): Xaa is any aa, unknown, or other
MQSSSMKREISEAHDTIRFGINAGVKADLAPPHPLQSTIQSETKFWADKKKFGTDAIYGSALNIRKDLDAQILSRFQRPPGALPSSLLGYEALTGSLXDFGFEDYLNMAHDSDSFPSPDMHMGMEVRLWFVQGTYLS

SEQ ID NO: 17673 - DNA, 752 bp, Zea mays
  misc_feature: Ceres CLONE 1383019-F
  misc_feature: Translation starting site: 162
  misc_feature (388)..(388): n is a, c, t, g, unknown, or other
  misc_feature (389)..(389): n is a, c, t, g, unknown, or other
  misc_feature (432)..(432): n is a, c, t, g, unknown, or other
  misc_feature (439)..(439): n is a, c, t, g, unknown, or other
  misc_feature (452)..(452): n is a, c, t, g, unknown, or other
  misc_feature (603)..(603): n is a, c, t, g, unknown, or other
aagctggagctccccgcggtggcggccgctctagaactagtggatcccccgggctgcaggaattcgcacgagaccattacctagaacatcctaatcgaaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatccnngcctgggacggtgctgatcctcctcgcagggcgtttcatgggnaaggagnagtggtgtttctncaagcagctcaagtccggcctggctccttatctctgggcctttcaggatcaatgggagtacccgatccgccgtgtgaaccagacctatgtcattgctacatcaaccaaagttgacatctctggggtgttgatgtcgccaagtttgatgacnagtactttgccagggagaagaagcagaaagtgaagaagaccgagggcgaactttttgagacagaaaaggaggcatccaagtcactgcctgacttcaagaaagatgaccagaaaggctgtggattctgctctgatcaaggttattgaggg

SEQ ID NO: 17674 - DNA, 740 bp, Zea mays
  misc_feature: Ceres CLONE 1383020-F
  misc_feature: Encodes the peptide sequence at SEQ ID NO. 17675
  misc_feature (141)..(141): n is a, c, t, g, unknown, or other
  misc_feature (318)..(318): n is a, c, t, g, unknown, or other
  misc_feature (348)..(348): n is a, c, t, g, unknown, or other
  misc_feature (522)..(522): n is a, c, t, g, unknown, or other
  misc_feature (529)..(529): n is a, c, t, g, unknown, or other
  misc_feature (580)..(580): n is a, c, t, g, unknown, or other
  misc_feature (585)..(585): n is a, c, t, g, unknown, or other
  misc_feature (602)..(602): n is a, c, t, g, unknown, or other
  misc_feature (624)..(624): n is a, c, t, g, unknown, or other
  misc_feature (625)..(625): n is a, c, t, g, unknown, or other
  misc_feature (655)..(655): n is a, c, t, g, unknown, or other
  misc_feature (658)..(658): n is a, c, t, g, unknown, or other
  misc_feature (684)..(684): n is a, c, t, g, unknown, or other
  misc_feature (685)..(685): n is a, c, t, g, unknown, or other
  misc_feature (701)..(701): n is a, c, t, g, unknown, or other
  misc_feature (716)..(716): n is a, c, t, g, unknown, or other
  misc_feature (718)..(718): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
aaactggagctccccgcggtggcggccgctctagaactagtggatcccccgggctgcaggaattcgcacgagaccattacctagaacatcctaatcgaaaaatccatcggctggatttcccaagcacgctgctgccagggntctccagctgcaagcacgcatcagcattccacaagcgaaatggcggcgacggcagccgtgccttcttggcgccgggcattcgcggcgctcttgctggtcctgcagctgcgcggcgcgcggtcggcgacgttcaccatcgcgaaacactgcggctacacggtgtggccggggctgcgntcccagcgcgggctccgcgccgctgcccanccacggggttcgcgctggcgcccttcggagtcccgtgcccgggcggcgcccccggggggggggccccggccccccctggggggccccccggttttggggccgccgaacccgcccccggggcggggtccccggcgcccccggggggccttgggggcccccgggccgtgtgggggnccggggngggggcccccccccccccccggtcgtggggggtttttcccccggggggggncgccngggttttggttttttcncctcgccccccccggggggggnntccccctgggcccgggttttcccccccctnttnggccctcccctctgggggggcggggnntgtgggggccccccgngggcccccccccccntnttgnnnncccccggcccccccg

SEQ ID NO: 17675 - protein, 186 aa, Zea mays
  misc_feature: Ceres CLONE 1383020-F
  misc_feature (56)..(56): Xaa is any aa, unknown, or other
  misc_feature (117)..(117): Xaa is any aa, unknown, or other
  misc_feature (134)..(134): Xaa is any aa, unknown, or other
  misc_feature (141)..(141): Xaa is any aa, unknown, or other
  misc_feature (149)..(149): Xaa is any aa, unknown, or other
  misc_feature (159)..(159): Xaa is any aa, unknown, or other
  misc_feature (160)..(160): Xaa is any aa, unknown, or other
  misc_feature (169)..(169): Xaa is any aa, unknown, or other
  misc_feature (174)..(174): Xaa is any aa, unknown, or other
  misc_feature (179)..(179): Xaa is any aa, unknown, or other
  misc_feature (180)..(180): Xaa is any aa, unknown, or other
  misc_feature (181)..(181): Xaa is any aa, unknown, or other
  misc_feature (182)..(182): Xaa is any aa, unknown, or other
MAATAAVPSWRRAFAALLLVLQLRGARSATFTIAKHCGYTVWPGLRSQRGLRAAAXPRGSRWRPSESRARAAPPGGGPRPPLGGPPVLGPPNPPPGRGPRRPRGALGAPGPCGGPGXGPPPPPGRGGFFPRGGXPGFWFFXLAPPGGGXPLGPGFPPPXXPSPLGGRGXWGPPXGPPPXXXXPRPP

SEQ ID NO: 17676 - DNA, 754 bp, Zea mays
  misc_feature: Ceres CLONE 1383021-F
  misc_feature: Encodes the peptide sequence at SEQ ID NO. 17677
  misc_feature (426)..(426): n is a, c, t, g, unknown, or other
  misc_feature (620)..(620): n is a, c, t, g, unknown, or other
  misc_feature (623)..(623): n is a, c, t, g, unknown, or other
  misc_feature (630)..(630): n is a, c, t, g, unknown, or other
tggagctccccgcggtggcggccgctctagaactagtggatcccccgggctgcaggaattcgcacgagaccattacctagaacatcctaatcaaaaaatctcactcatcagctagcaccaccaggaagtaggaacacacctcccaccagtccactgtttcatcgctcatcactaggctgcaatggctgcaaagtcacctgtgcttgcagcactggtactgctcctgagctccgcccagctgtccacgggggcaaggaggcgcatggagctgtaccagcccgatccggcggacatgctctcctaccacaacggatccgtgctccactccgacatcttcgtgtccgtgctctggtacggcagcttcacgcaggtgcagaaggcgatcatctacgacttcctgctctcgctcaccaccacgccccaggncgcctcgcccgtccgtcgcggagtggtgggacatgatcgagcagcagtacctgtccaaggcggcgcagaccaccaagcataccacccacccggggtgatgctggaaccaccccaggtgtcggtccgacgacggctgtccccatgggcacgtcccccccccttggcgcaggtctccgcctttcggcgcgcggcanggncccaggnaaaagggcgccggtcccgctggtgttcacgggcgcagggaacgtcccccgggggaggccttctgcacgaagccatgcgggccttgaaccgggggggaattcccggcgcccgggggcgccctccg

SEQ ID NO: 17677 - protein, 191 aa, Zea mays
  misc_feature: Ceres CLONE 1383021-F
  misc_feature (82)..(82): Xaa is any aa, unknown, or other
  misc_feature (147)..(147): Xaa is any aa, unknown, or other
  misc_feature (148)..(148): Xaa is any aa, unknown, or other
  misc_feature (150)..(150): Xaa is any aa, unknown, or other
MAAKSPVLAALVLLLSSAQLSTGARRRMELYQPDPADMLSYHNGSVLHSDIFVSVLWYGSFTQVQKAIIYDFLLSLTTTPQXASPVRRGVVGHDRAAVPVQGGADHQAYHPPGVMLEPPQVSVRRRLSPWARPPPLAQVSAFRRAAXXQXKGRRSRWCSRAQGTSPGGGLLHEAMRALNRGGIPGARGRPP

SEQ ID NO: 17678 - DNA, 757 bp, Zea mays
  misc_feature: Ceres CLONE 1383022-F
  misc_feature: Encodes the peptide sequence at SEQ ID NO. 17679
  misc_feature (526)..(526): n is a, c, t, g, unknown, or other
  misc_feature (539)..(539): n is a, c, t, g, unknown, or other
  misc_feature (540)..(540): n is a, c, t, g, unknown, or other
  misc_feature (557)..(557): n is a, c, t, g, unknown, or other
  misc_feature (627)..(627): n is a, c, t, g, unknown, or other
tggagctccccgcggtggcggccgctctagaactagtggatcccccgggctgcaggaattcgcacgagaccattacctagaacatcctaatcgaaaaaatcctccctttctctcctctcctgcctttccccattactactccccagtcccactcccacccgcaggccgcgccgccccagcaaatctcacgcacagaaacaccaaagccccaaaggcccaaactcaccacctcccaatggagaacggcgacgaaaccctcgcctcccccacggccgccgccgagacggacgcgctcaacggcggcgtcgcggaggaggagcaggtccccatcacccaccccgcaaagtcctacgtcacgctcgccgacgacaaccccgctcctaacggcggcgtcgtgaaagaggaaggagggcggtgcccacaccaccgcgaagtcctacgcagctgtcgccgcccaagcccgagatcgaggacctccgcgccgccaagctcgacctgggaggagaagctcgctgaggcccgccgntgagaacaagtcnnctcgccgaggagaccancgccagcgaggggatcttcacgaggcccccgggaggaggtcacccatcgccgagttcgccgccactctgnccggagaaggaggtcgcctcgctccccgcgcgggaggtcgaacgccctcgatgctgttctcagggatcggaggaagggcgagcacgagctgggacaagcagaggacacgagaaggtccgcccaaggaagg

SEQ ID NO: 17679 - protein, 97 aa, Zea mays
  misc_feature: Ceres CLONE 1383022-F
MENGDETLASPTAAAETDALNGGVAEEEQVPITHPAKSYVTLADDNPAPNGGVVKEEGGRCPHHREVLRSCRRPSPRSRTSAPPSSTWEEKLAEARR

SEQ ID NO: 17680 - DNA, 715 bp, Zea mays
  misc_feature: Ceres CLONE 1383023-F
  misc_feature: Translation starting site: 154
  misc_feature (539)..(539): n is a, c, t, g, unknown, or other
  misc_feature (566)..(566): n is a, c, t, g, unknown, or other
aagctggagctccccgcggtggcggccgctctagaactagtggatcccccgggctgcaggaattcgcacgagaccattacctagaacatcctaatcgaaaatctgatgccgtaacacaaggctgaatttttgttcggtctagccgacccgacgatggcgtccagcgacgggaaaccactgccaaccccgcctctgtggggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcggtctcatcggcgtggagtacatcgtggtcgaggaagatcttcgactcgctgccggcggaggagcagcggctgtggcactcgcacgcgcacganatcaagtcaggcctgtggacgagccgncacgtggcggggctgctggagaaggcggagctggaccactggccgcacgttcggcaagttctggggcacctggcagggggaccggcgcgaccgcctgccgctgggcgcccccgcgcttatggtgtccccgcaggccgaacccgccgcag

SEQ ID NO: 17681 - DNA, 719 bp, Zea mays
  misc_feature: Ceres CLONE 1383024-F
  misc_feature: Encodes the peptide sequence at SEQ ID NO. 17682
  misc_feature (464)..(464): n is a, c, t, g, unknown, or other
  misc_feature (572)..(572): n is a, c, t, g, unknown, or other
  misc_feature (573)..(573): n is a, c, t, g, unknown, or other
  misc_feature (664)..(664): n is a, c, t, g, unknown, or other
  misc_feature (691)..(691): n is a, c, t, g, unknown, or other
aaagctggagctccccgcggtggcggccgctctagaactagtggatcccccgggctgcaggaattcgcacgagaccattacctagaacatcctaatcgaaaaacacgaactcgagacctcgcccgcccaaatacaaaagcctcagatctcagtgaccagcgccgccgcttcgttcgtgtcgaatagagaagagaggaaatggcggcgagcgagggcgtgctcctggggatgggcaaccccctcctcgacatctccgccgttgtcgatgacgccttcctggcaaagtatgacatcaagctgaacaatgccattctcgctgaggagaagcactcgcctatgtatgatgagttggctagcaacagcaatgttgaatatattgctggaggagccacccagaactctatcagggttgcccaatggatgcttcaaactcctggtgcaacaagttacatgggatgcattgngaaggacaagtttggtgaggagatgaagaaaaatgctcaagctgcaggagttactgctcattactatgaggatgagactgctcctactggccatgtgctgtatggtgnntgtggtggcgaagggtcattgattgcaaatctgtcggcggcaactggtacaaatctgagcatcctcagagaccagagactggggccttagntgggaaagcaaaaactcaacattggcntgatttttccccccgggggactggattt

SEQ ID NO: 17682 - protein, 154 aa, Zea mays
  misc_feature: Ceres CLONE 1383024-F
  misc_feature: SWISSPROT Homolog: EC 2.7.1.20 Adenosine kinase
  misc_feature (89)..(89): Xaa is any aa, unknown, or other
  misc_feature (125)..(125): Xaa is any aa, unknown, or other
MAASEGVLLGMGNPLLDISAVVDDAFLAKYDIKLNNAILAEEKHSPMYDELASNSNVEYIAGGATQNSIRVAQWMLQTPGATSYMGCIXKDKFGEEMKKNAQAAGVTAHYYEDETAPTGHVLYGXCGGEGSLIANLSAATGTNLSILRDQRLGP

SEQ ID NO: 17683 - DNA, 708 bp, Zea mays
  misc_feature: Ceres CLONE 1383028-F
  misc_feature: Encodes the peptide sequence at SEQ ID NO. 17684
  misc_feature (389)..(389): n is a, c, t, g, unknown, or other
  misc_feature (422)..(422): n is a, c, t, g, unknown, or other
  misc_feature (442)..(442): n is a, c, t, g, unknown, or other
  misc_feature (465)..(465): n is a, c, t, g, unknown, or other
  misc_feature (466)..(466): n is a, c, t, g, unknown, or other
  misc_feature (549)..(549): n is a, c, t, g, unknown, or other
  misc_feature (612)..(612): n is a, c, t, g, unknown, or other
tggagctccccgcggtggcggccgctctagaactagtggatcccccgggctgcaggaattcgcacgagaccattacctagaacatcctaatcgaaaaaagcgaaggtggcgatcgagcaccgccatggggcaaccaagaacagagctcctcgccctcgcattccttctcgtcgccctcgccgccgccgtggccgccgcggcgacagaggtggtagacgcggcgccggcaccagcgaggacgaggacgacgacggcggggtgccggcgcggcgacctggtggtgcggcagcgcgcgacggggcgcgtggtggaggggaagcccgagtacgcggtggaggtgcggaacgcgtgccggtgcgcgcagtcccgcgtgctgctgcgctgctacnggctcagcagcgtggagggcgtggacccgcgcngcatcccgcgcgtcgacggngagcgctgcctgctcccgcgcgnncgggcgctggcgccgcgcggggggcgccgtgcgcttcactaacgctggatgacgccgcaggacttcccgctcctcaggtcgcngccggactgctaaccgttccagtaccttacttagctcggggctgggctggtctgtattacaantggttgttgtacgcactggatcttcaccaggaaaaatgagattgggctgggctcttccgatcaggtctgagtaaaaaaaaaaaaaaaaaaaaacaa

SEQ ID NO: 17684 - protein, 127 aa, Zea mays
  misc_feature: Ceres CLONE 1383028-F
  misc_feature (89)..(89): Xaa is any aa, unknown, or other
  misc_feature (100)..(100): Xaa is any aa, unknown, or other
  misc_feature (114)..(114): Xaa is any aa, unknown, or other
MGQPRTELLALAFLLVALAAAVAAAATEVVDAAPAPARTRTTTAGCRRGDLVVRQRATGRVVEGKPEYAVEVRNACRCAQSRVLLRCYXLSSVEGVDPRXIPRVDGERCLLPRXRALAPRGGRRALH

SEQ ID NO: 17685 - DNA, 741 bp, Zea mays
  misc_feature: Ceres CLONE 1383029-F
  misc_feature: Encodes the peptide sequence at SEQ ID NO. 17686
  misc_feature (375)..(375): n is a, c, t, g, unknown, or other
  misc_feature (560)..(560): n is a, c, t, g, unknown, or other
aaagctggagctccccgcggtggcggccgctctagaactagtggatcccccgggctgcaggaattcgcacgagaccattacctagaacatcctaatcgaaaatccatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctggccgccgccggtccacctgnccaccgccggtccatgggccgccgccggttcatctgccgccgccaccatgccactaccctactcaaccgccccggcctcagcctcatccccagccacacccatgcccgtgccaacagccgcatccaagcccgtgccagctgcagggaaacttgcggcgttggcagcaccccgatcctgggccagnggcgtcgagttcctgaggcatcagtgcaggccgacggcgacgccctactgctcgcctcagtgggcagtcgttgcgggcagcagtgttgccagcagctccaggcaggtggagccgcagcacgggtaccaggcgatctttcggtttgggcctccagtccatcctgcagcagcagccgcaaggg

SEQ ID NO: 17686 - protein, 88 aa, Zea mays
  misc_feature: Ceres CLONE 1383029-F
  misc_feature (28)..(28): Xaa is any aa, unknown, or other
MPVPTAASKPVPAAGKLAALAAPRSWAXGVEFLRHQCRPTATPYCSPQWAVVAGSSVASSSRQVEPQHGYQAIFRFGPPVHPAAAAAR

SEQ ID NO: 17687 - DNA, 737 bp, Zea mays
  misc_feature: Ceres CLONE 1383032-F
  misc_feature: Encodes the peptide sequence at SEQ ID NO. 17688
  misc_feature (345)..(345): n is a, c, t, g, unknown, or other
  misc_feature (357)..(357): n is a, c, t, g, unknown, or other
  misc_feature (390)..(390): n is a, c, t, g, unknown, or other
  misc_feature (414)..(414): n is a, c, t, g, unknown, or other
  misc_feature (429)..(429): n is a, c, t, g, unknown, or other
tggagctccccgcggtggcggccgctctagaactagtggatcccccgggctgcaggaattcgcacgagaccattacctagaacatcctaatcgaaaaaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggcggtggcgccaaggtccgacccggaccacgggtcggagcggcagccgacggcgatgctgggcggcgtgatgggctcgctccgcgtcatcgagctgcagctggtggncttcatcatggntgtctcggcgtcgggcctcgtcccgctcatcgnactcgtgttcccccgtcggcacancgtctaaactctcgncatttcccggcctcgctttccggcggtggacgccaacaagtcgtccaagcctgatgacgccgccggttcgcccggcgcctcctcaaggcggcccccgggaaatttccggggaaggaagaaaacaaaaatccttccccccttggtttcccctggggcctccctcccattattccgcaaaataaattaaaatttgggaaccggtttccccaagttttccaagggtaaaaggggggggggaaccacgggggggcttttttcggccgggggaaatttgtggggggtttcccggggggcaacaagcggggggg

SEQ ID NO: 17688 - protein, 66 aa, Zea mays
  misc_feature: Ceres CLONE 1383032-F
  misc_feature (42)..(42): Xaa is any aa, unknown, or other
  misc_feature (46)..(46): Xaa is any aa, unknown, or other
  misc_feature (57)..(57): Xaa is any aa, unknown, or other
  misc_feature (65)..(65): Xaa is any aa, unknown, or other
MSGISLAVAPRSDPDHGSERQPTAMLGGVMGSLRVIELQLVXFIMXVSASGLVPLIXLVFPRRHXV

SEQ ID NO: 17689 - DNA, 730 bp, Zea mays
  misc_feature: Ceres CLONE 1383033-F
  misc_feature: Encodes the peptide sequence at SEQ ID NO. 17690
  misc_feature (585)..(585): n is a, c, t, g, unknown, or other
  misc_feature (586)..(586): n is a, c, t, g, unknown, or other
  misc_feature (621)..(621): n is a, c, t, g, unknown, or other
  misc_feature (622)..(622): n is a, c, t, g, unknown, or other
  misc_feature (627)..(627): n is a, c, t, g, unknown, or other
  misc_feature (636)..(636): n is a, c, t, g, unknown, or other
  misc_feature (688)..(688): n is a, c, t, g, unknown, or other
tggagctccccgcggtggcggccgctctagaactagtggatcccccgggctgcaggaattcgcacgagaccattacctagaacatcctaatcgaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggtttgccaagaagtaccatgctttcttggcatcagaggccatcatcaagcagattcccggtctcccttggtcctggtctcaacaagggcaggcaagttccccgaccctggttactcaccagnnaatccctcgaagtccaaggtgaacgagactaaggnnaaccngtcagtcangcttcaagaagtcttttttttttgggggggtggttgcccttggaaactgggncgatggagggagaaagcagatcccgcagaacatcccagatga

SEQ ID NO: 17690 - protein, 148 aa, Zea mays
  misc_feature: Ceres CLONE 1383033-F
  misc_feature (9)..(149): Pfam Name: Ribosomal_L1 Pfam Description: Ribosomal protein L1p/L10e family
  misc_feature (142)..(142): Xaa is any aa, unknown, or other
MSKLQSESVKDAISQIVGDAKEKNRKFTETVELQIGLKNYDPQKDKRFSGSVKLPHIPRPKMKVCMLGDAQHVEEAEKMGLDYMDVEALKKMNKNKKLVKRFAKKYHAFLASEAIIKQIPGLPWSWSQQGQASSPTLVTHQXIPRSPR

SEQ ID NO: 17691 - DNA, 751 bp, Zea mays
  misc_feature: Ceres CLONE 1383036-F
  misc_feature: Encodes the peptide sequence at SEQ ID NO. 17692
  misc_feature (551)..(551): n is a, c, t, g, unknown, or other
  misc_feature (618)..(618): n is a, c, t, g, unknown, or other
  misc_feature (622)..(622): n is a, c, t, g, unknown, or other
  misc_feature (730)..(730): n is a, c, t, g, unknown, or other
aagctggagctccccgcggtggcggccgctctagaactagtggatcccccgggctgcaggaattcgcacgagaccattacctagaacatcctaatcgaaaactttcctctccgatccggatctccccacccgctccggcgagccatcgccgcgtcgcctccacgcgaccgactacttctcatatcaatctatctatccggcttacccgccgccgcacgcaccaaggttgcgttcaccatattacctgtttgcttatcttctcccgagcccagcaaaccctagccgccgccacccatggacatagaggccgacggacgattcggcaacaaacgagtgcacaatcgcctaggcccgggctccggcggcgctccaccatctaccaacggaaaggtctgcaactactggcgtgccggtcggtgcaaccgctttccgtgccccttcctccacagcgagctccccgaggctgcgccgcccaagcgccccactggaccccggggggaacgtatggcgcaaccccaacaccggagggacgaggaggtggcatcacatanaatggggggaagggcccaggaggggggcagcggggattgcgagccaccagcccgcctgagagggccntgcnagtacttttctcgcccggtaccgaatgtagctaatggccgagaggtggccgctattccgcacagctactgcataggcgaatagtatcgcggatgcttacccttgctcnagggacaccaagcaggggtgt

SEQ ID NO: 17692 - protein, 136 aa, Zea mays
  misc_feature: Ceres CLONE 1383036-F
  misc_feature (86)..(86): Xaa is any aa, unknown, or other
  misc_feature (110)..(110): Xaa is any aa, unknown, or other
MDIEADGRFGNKRVHNRLGPGSGGAPPSTNGKVCNYWRAGRCNRFPCPFLHSELPEAAPPKRPTGPRGERMAQPQHRRDEEVASHXMGGRAQEGGSGDCEPPARLRGPCXYFSRPVPNVANGREVAAIPHSYCIGE

SEQ ID NO: 17693 - DNA, 732 bp, Zea mays
  misc_feature: Ceres CLONE 1383037-F
  misc_feature: Encodes the peptide sequence at SEQ ID NO. 17694
  misc_feature (397)..(397): n is a, c, t, g, unknown, or other
tggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagccgtccgcggcgaagaagccggcggcgcaccctccctacgctgagatgattgtagaggcgatgcctgccctaaggnaaaaaggaaaggggtcgagctcggtggcctccaccagttacgtccgaggggaaagcacggcggcaaagctccccaccaacttccgcaagcagctcaccgtgcaagctgaagaagctcgctgccgccggcaagctggaccaagggttgaagaactccttcaagctgccggccaccgacgcccagcccaaggccgccaagccaagggcacccaaggccgcgccaagccagcccttcgccggaaggggaaggccagaccgctgcgaaccccaagggggggtcgcccaggccagggccaggccaggccaggcaagggccagcctgtcgtccgccgcggc

SEQ ID NO: 17694 - protein, 182 aa, Zea mays
  misc_feature: Ceres CLONE 1383037-F
  misc_feature (54)..(107): Pfam Name: Linker_histone Pfam Description: linker histone H1 and H5 family
  misc_feature (71)..(71): Xaa is any aa, unknown, or other
MSTEEAVVAEVPVTEVPAEVPAAQVAEAPKAKKAPKEKKAPKEKKPSAAKKPAAHPPYAEMIVEAMPALRXKGKGSSSVASTSYVRGESTAAKLPTNFRKQLTVQAEEARCRRQAGPRVEELLQAAGHRRPAQGRQAKGTQGRAKPALRRKGKARPLRTPRGGRPGQGQARPGKGQPVVRRG

SEQ ID NO: 17695 - DNA, 729 bp, Zea mays
  misc_feature: Ceres CLONE 1383038-F
  misc_feature: Encodes the peptide sequence at SEQ ID NO. 17696
  misc_feature (377)..(377): n is a, c, t, g, unknown, or other
  misc_feature (378)..(378): n is a, c, t, g, unknown, or other
  misc_feature (407)..(407): n is a, c, t, g, unknown, or other
  misc_feature (408)..(408): n is a, c, t, g, unknown, or other
  misc_feature (419)..(419): n is a, c, t, g, unknown, or other
  misc_feature (420)..(420): n is a, c, t, g, unknown, or other
  misc_feature (427)..(427): n is a, c, t, g, unknown, or other
  misc_feature (473)..(473): n is a, c, t, g, unknown, or other
  misc_feature (485)..(485): n is a, c, t, g, unknown, or other
aagctggagctccccgcggtggcggccgctctagaactagtggatcccccgggctgcaggaattcgcacgagaccattacctagaacatcctaatcgaaaaccttcgcattaatggccgctctctccctatcccctttcgtctcgctctcggagtaggacactcgcccgcttccggcttaaccttcaagattctccctcctcctcctacttcttcccgcttgggcgggcgcggcaccttccggttctgggcctcctatatatatacgcgcgcgaccgtcccccttccatactccctagcatgctcggctcgcaccccggattgatcgagctcgcccgtcgccgcgatggattcggtgcttcccccctccctctctannccggggcacgctgctcccggtccctgctnngcgcttgacgnnctgccgnagggcgtgcgccaggcacgccgccgccgccgcgcggcccgcccggntgggcgctcggngcgctgctcacctgcgtcttcggcggcgggggttccctccgcggatccttcctgggggctcccggggggatgccaacgaaaggggttggtcccggggggttggggttcaaaaattcccggaagaagcttttccttgggggggggggagccgggtccaaaattggggggggccccctttggggaaaaaaggccttctttgggggggggaaattctccggcccttcgggggaaaaattggggggaa

SEQ ID NO: 17696 - protein, 58 aa, Zea mays
  misc_feature: Ceres CLONE 1383038-F
MPTKGVGPGGLGFKNSRKKLFLGGGGAGSKIGGGPLWGKKAFFGGGKFSGPSGEKLGG

SEQ ID NO: 17697 - DNA, 759 bp, Zea mays
  misc_feature: Ceres CLONE 1383041-F
  misc_feature: Encodes the peptide sequence at SEQ ID NO. 17698
  misc_feature (389)..(389): n is a, c, t, g, unknown, or other
  misc_feature (390)..(390): n is a, c, t, g, unknown, or other
  misc_feature (730)..(730): n is a, c, t, g, unknown, or other
tccccgcggtggcggccgctctagaactagtggatcccccgggctgcaggaattcgcacgagaccattacctagaacatcctaatcgaaaactgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcagtgcagtgtggttccttttnncactcaaatatgagctgctactttcagcaaagggcccgcgacaaaggttaccttttcttttagtttggaccattaccttgctggaagccccctctggaccggggaggctggagctaacccagaaaactaaccttggggggggaaaatgccccccaaaggagctacgggaggggttgggcacccccggaaaaaaggccccagttggccaatcccccccctgggggcgaagggtttaaagggccccttggcgggaaaagggggggagaaaagacttagaacacccggggtccacccccggggagggggggggggccccccacccccaaggagccccttggcngggaaacgggcccccccgcgtttccctgg

SEQ ID NO: 17698 - protein, 84 aa, Zea mays
  misc_feature: Ceres CLONE 1383041-F
  misc_feature: SWISSPROT Homolog: EC 5.3.3.2 Isopentenyl-diphosphate Delta-isomerase
  misc_feature (64)..(64): Xaa is any aa, unknown, or other
MAAAVVDDAGMDAVQKRLMFEDECILVDEQDNVVGHESKYNCHLMEKIDSENLLHRAVQCGSFXHSNMSCYFQQRARDKGYLFF

SEQ ID NO: 17699 - DNA, 724 bp, Zea mays
  misc_feature: Ceres CLONE 1383048-F
  misc_feature: Encodes the peptide sequence at SEQ ID NO. 17700
  misc_feature (506)..(506): n is a, c, t, g, unknown, or other
  misc_feature (517)..(517): n is a, c, t, g, unknown, or other
  misc_feature (580)..(580): n is a, c, t, g, unknown, or other
  misc_feature (590)..(590): n is a, c, t, g, unknown, or other
  misc_feature (597)..(597): n is a, c, t, g, unknown, or other
  misc_feature (598)..(598): n is a, c, t, g, unknown, or other
  misc_feature (619)..(619): n is a, c, t, g, unknown, or other
  misc_feature (677)..(677): n is a, c, t, g, unknown, or other
aaagctggagctccccgcggtggcggccgctctagaactagtggatcccccgggctgcaggaattcgcacgagaccattacctagaacatcctaatcgaaaaattccccgccgcctcgcgcccccgctcgcttcacttctctaggtgcgcaccgatcagaaggtgcctgcctcctcctcgtcggcgaaaagatggcggtgccgctgctgacgaagaagatcgtgaagaagcgggtcaagcagttcaagaggccccacctcgaccgctacaagtgccttaagccaagctggcgcaggccaaagggtattgattcccgtgtcaggaggaagttcaagggatgcaccttgatgcccaacattggttatggttctgacaagtcgaccaggcactacctccccagcaagttcaagaagtttgtggtccacaacgtttctgagctggagttgctcatgatgcacaacaggacctactgcgctgaaattgctcacaacgtgtccaccaagagncgcaaggagantcgtggagcgtgctgcacagctcggacattgtggtcaccaacaagcttgctaggctccgcagncaggaggacngagtagnnctggtttcttgtcttacgacngaactggatgttgccattcctttctgtagggaactactttggttgggggcttggtagnactggaaaccagaggcactcctacttttttgcatcagagccactaaa

SEQ ID NO: 17700 - protein, 134 aa, Zea mays
  misc_feature: Ceres CLONE 1383048-F
  misc_feature (14)..(121): Pfam Name: Ribosomal_L32e Pfam Description: Ribosomal protein L32
  misc_feature (105)..(105): Xaa is any aa, unknown, or other
  misc_feature (109)..(109): Xaa is any aa, unknown, or other
  misc_feature (130)..(130): Xaa is any aa, unknown, or other
MAVPLLTKKIVKKRVKQFKRPHLDRYKCLKPSWRRPKGIDSRVRRKFKGCTLMPNIGYGSDKSTRHYLPSKFKKFVVHNVSELELLMMHNRTYCAEIAHNVSTKXRKEXRGACCTARTLWSPTSLLGSAXRRTE

SEQ ID NO: 17701 - DNA, 696 bp, Zea mays
  misc_feature: Ceres CLONE 1383055-F
  misc_feature: Encodes the peptide sequence at SEQ ID NO. 17702
  misc_feature (386)..(386): n is a, c, t, g, unknown, or other
  misc_feature (387)..(387): n is a, c, t, g, unknown, or other
  misc_feature (425)..(425): n is a, c, t, g, unknown, or other
  misc_feature (476)..(476): n is a, c, t, g, unknown, or other
  misc_feature (491)..(491): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaatagagcaacaatggcgaccaagatattttccctccttatgctccttgctctttctacatgtgttgctaacgcgacaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgtnntcacaatcgccagccctatctttggtgcagtcattggntacaaccatcagggcacaacagctgcagcaactcgtgctacctctgatcancaaagaagctctggnaaacttttctccctactctcaggaacaacaatttctttccattcaaccaaatgggctaacctgaaccctgggtggtatatttggacaaacaacttattaacctttaacccgggtaggtacgggccaacctccaagaaaaaaaaaattttttccattttaaaccaattgggccgaacgggaaacccccggtgtttttttttggagg

SEQ ID NO: 17702 - protein, 129 aa, Zea mays
  misc_feature: Ceres CLONE 1383055-F
  misc_feature (74)..(74): Xaa is any aa, unknown, or other
  misc_feature (87)..(87): Xaa is any aa, unknown, or other
  misc_feature (104)..(104): Xaa is any aa, unknown, or other
  misc_feature (109)..(109): Xaa is any aa, unknown, or other
MATKIFSLLMLLALSTCVANATIFPQCSQAPIASLLPPYLPSIIASICENPALQPYRLQQAIAASNIPLSPLLXSQSPALSLVQSLXTTIRAQQLQQLVLPLIXKEALXNFSPYSQEQQFLSIQPNGLT

SEQ ID NO: 17703 - DNA, 664 bp, Zea mays
  misc_feature: Ceres CLONE 1383059-F
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
ggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgcccgcgccgcagtcgacgcgaggcgctctcggttttgacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17704 - DNA, 735 bp, Zea mays
  misc_feature: Ceres CLONE 1383065-F
  misc_feature: Encodes the peptide sequence at SEQ ID NO. 17705
  misc_feature (571)..(571): n is a, c, t, g, unknown, or other
  misc_feature (575)..(575): n is a, c, t, g, unknown, or other
  misc_feature (614)..(614): n is a, c, t, g, unknown, or other
  misc_feature (618)..(618): n is a, c, t, g, unknown, or other
tccccgcggtggcggccgctctagaactagtggatcccccgggctgcaggaattcgcacgagaccattacctagaacatcctaatcgaaaaaagcagcgaaatccaatctagaagcgcccctctccctctctctctctctcttcgccgtccgaagctccgcaccccaatctaatcgacacctcgccgagatgggccgcaagttcttcgtcggtggcaactggaaatgcaatggaaccacagatcaggtcgagaagattgtcaaaaccctgaatgaaggacaggttcccccttcagatgttgtggaggtcgttgtcagccctccttatgtcttccttcctgtggtcaagagccagctgcgccaagagttccatgttgcggctcagaactgctgggttaagaagggaggtgctttcaccggtgaagtcagtgctgagatgctcgtcaaccttggtgttccctgggtcattcttggacactctgaaaggagagctctgctgggagaatcaaatgaatttgttggagacaaggttgcgtatgccctgtctcagggactaaaggtcattgcatgtngtgntgagacacttgagcagaggggagctgggtctaccatggnaggntgtgctgcacaaacaaaagcaattgctgagaaagatcaggactggagcaacgtagttggtgcctatgaaccagttggggctattggaactggtaaagtgccaccccagctcaggctc

SEQ ID NO: 17705 - protein, 182 aa, Zea mays
  misc_feature: Ceres CLONE 1383065-F
  misc_feature (5)..(182): Pfam Name: TIM Pfam Description: Triosephosphate isomerase
  misc_feature: SWISSPROT Homolog: EC 5.3.1.1 Triose-phosphate isomerase
  misc_feature (128)..(128): Xaa is any aa, unknown, or other
  misc_feature (129)..(129): Xaa is any aa, unknown, or other
  misc_feature (142)..(142): Xaa is any aa, unknown, or other
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACXXETLEQRGAGSTMXGCAAQTKAIAEKDQDWSNVVGAYEPVGAIGTGKVPPQLRL

SEQ ID NO: 17706 - DNA, 695 bp, Zea mays
  misc_feature: Ceres CLONE 1383066-F
  misc_feature: Encodes the peptide sequence at SEQ ID NO. 17707
  misc_feature (379)..(379): n is a, c, t, g, unknown, or other
  misc_feature (380)..(380): n is a, c, t, g, unknown, or other
  misc_feature (453)..(453): n is a, c, t, g, unknown, or other
  misc_feature (499)..(499): n is a, c, t, g, unknown, or other
  misc_feature (606)..(606): n is a, c, t, g, unknown, or other
tccccgcggtggcggccgctctagaactagtggatcccccgggctgcaggaattcgcacgagaccattacctagaacatcctaatcgaaaaaaagccgcgccttacaacgagattcctcccctcctctctccaataaccctagcctactccgccgccggcgacgaatccggcgttttgagtttctgttgccagcgtagccatgtccatgttcaataggatcttcgggaagcccaaggagcaggccaactccaatgccttggccactctggacaagttaaatgagactcttgatatgctggagaagaaagaaaaggtgctggagaaaaaagcagccgctgagctggagagagccaaggagttctcaaaagctaagaatannagagcggctatccaatccttgaagaggggaaaactttatgagcaacaaattgagcagcttggaaattttcagntgagaatccatgatcagatgatcatggtagaagcagctaaagctancacagagactggtgatgcattgagaactggagctgcagctatgaaaagcatggcaaaagcaacaaacattgatgatgtaaaccagaccttggatgaaattatggacngactggaaattggaacaaattcgggatgttgtgccgctctctccgaacttcgggtgatttcatgggatgacctgaaacccaccttaaaa

SEQ ID NO: 17707 - protein, 165 aa, Zea mays
  misc_feature: Ceres CLONE 1383066-F
  misc_feature (21)..(164): Pfam Name: Snf7 Pfam Description: Snf7
  misc_feature (60)..(60): Xaa is any aa, unknown, or other
  misc_feature (85)..(85): Xaa is any aa, unknown, or other
  misc_feature (100)..(100): Xaa is any aa, unknown, or other
  misc_feature (136)..(136): Xaa is any aa, unknown, or other
MSMFNRIFGKPKEQANSNALATLDKLNETLDMLEKKEKVLEKKAAAELERAKEFSKAKNXRAAIQSLKRGKLYEQQIEQLGNFQXRIHDQMIMVEAAKAXTETGDALRTGAAAMKSMAKATNIDDVNQTLDEIMDXLEIGTNSGCCAALSELRVISWDDLKPTLK

SEQ ID NO: 17708 - DNA, 452 bp, Zea mays
  misc_feature: Ceres CLONE 1383067-F
  misc_feature (225)..(225): n is a, c, t, g, unknown, or other
  misc_feature (235)..(235): n is a, c, t, g, unknown, or other
  misc_feature (248)..(248): n is a, c, t, g, unknown, or other
gcggtggggcgctctagaactagtggatcccccgggctgaggattcgcacgagaccattacctagaacatcctaatcgaaaaatcaccaccactgggtcttcagaccattagctttatctactccagagcgagaagaacccgatcgacaccatgaggggttgctcgtgccctcgctctctggctctcgtgcagcgcactcacgatacagcgcggctgcgctgcangcacgcgcgntcattacgcgcgntgattgcactcggtactgcactcgggattcccacgcggccctgcccgcgggccttgcccccggcctggccccccctttttttttgcggggcaatgtatacttttacgccgggtttttttttcccaaaacccttggggggaaaaggcttaaaccggcctttggaacacggggttaccccccctctgggggggggattttaaaaaa

SEQ ID NO: 17709 - DNA, 708 bp, Zea mays
  misc_feature: Ceres CLONE 1383071-F
  misc_feature: Translation starting site: 157
  misc_feature (517)..(517): n is a, c, t, g, unknown, or other
  misc_feature (531)..(531): n is a, c, t, g, unknown, or other
  misc_feature (625)..(625): n is a, c, t, g, unknown, or other
  misc_feature (655)..(655): n is a, c, t, g, unknown, or other
  misc_feature (682)..(682): n is a, c, t, g, unknown, or other
tcaccgcggtggcggccgctctagaactagtggatcccccgggctgcaggaattcgcacgagaccattacctagaacatcataatcgaaaaaccaccaccactggacgtcagcctagcaattagctcatcgactccagattggagaactcgacaccatgaaggtgctgatcgttgcccttgctctcctggcgctcgctgcgagcgccgcctccagtacaagcggcggctgtggctgccagacaccaccgtttcatctaccgcctccgttctatatgccgcctccgttctatctgccgccgcagcagcagccgcagccatggcaataccccactcaaccaccgcagctaagcccgtgccagcagttcggatcctgcggcgtcggcagcgtcggcagcccgttcctgggccagtgcgtcgagttcctgaggcaccagtgcagcccggcggcgacgccctacggctcgccacagtgccaggcgctgcagcagcagtgctgcccacagatcaggcaggtgnagccgctgcaccgntaccagcgacatacggtgtggtcctgcagtctttcctgcagcagcagccgcaaggcgagctcgcggcgctgatggcgccccagtaacgcaacanctgacggcaatgtgcggtctgcagctgaancaacaggtccctgcccttgaaagcaantggcggggggggctataaggaagaaa

SEQ ID NO: 17710 - DNA, 722 bp, Zea mays
  misc_feature: Ceres CLONE 1383072-F
tggagctccccgcggtggcggccgctctagaactagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccatagcccagcgcggggcgtcgaggccgtccggggcgcgcccggcgctcagatctgacgctgagtagcaggcgaacaacatgcagatgcttgtcgcaggatgcgcgtccgacagacaggtggctgcgacatcggcgtgctcgaaagcggcccgccggactcgctaaaacacccataagcgtaggctctggaacagatgcaatgcagtaccatgcgaatgcacgggcctgctttgtgaccctgagtgagtgcatggagcacgttcgggggcattgttactgcggcgcctccaatcatttccaataaaaatgggtccaagccgcccccagcaggccttttttttgacattccccagggctcctgaaagtgctcctcgcccacatggaaccccagggagcagagaccacaaatgattaataacccgcgggaagggccatcccgaaaggcatcccgcgaaaacgacccaacgggggccccattgggaatcccagcccaagcccc

SEQ ID NO: 17711 - DNA, 712 bp, Zea mays
  misc_feature: Ceres CLONE 1383074-F
  misc_feature: Encodes the peptide sequence at SEQ ID NO. 17712
  misc_feature (528)..(528): n is a, c, t, g, unknown, or other
  misc_feature (644)..(644): n is a, c, t, g, unknown, or other
ggagctccccgcggtggcggccgctctagaactagtggatcccccgggctgcaggaattcgcacgagaccattacctagaacatcctaatcgaaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcacccggggctgggtggcccgcccgccatcgcgctggcgctcatggggcggcgggttcgtcacctccggcggcctcggcgtcgctgcgctgtccgtgttctcctggnatgtacagtacctgacgggcaagcacccgccgggcgccgaccagctggacacgccaagggcgagctggcgtccaagcccgcgacatcaaggatgcagcacagcacgcatcgacaangcgcagggggtctgagagaagaacacactcgagcggacgcgcgcgcgacctcttgaacactgccgggc

SEQ ID NO: 17712 - protein, 156 aa, Zea mays
  misc_feature: Ceres CLONE 1383074-F
  misc_feature (36)..(154): Pfam Name: Oleosin Pfam Description: Oleosin
  misc_feature (114)..(114): Xaa is any aa, unknown, or other
  misc_feature (152)..(152): Xaa is any aa, unknown, or other
MADHHRGATGGGGGYGDLQRGGGMHGEAQQQQKQGAMMTALKAATAATFGGSMLVLSGLILAGTVIALTVATPVLVIFTRGWVARPPSRWRSWGGGFVTSGGLGVAALSVFSWXVQYLTGKHPPGADQLDTPRASWRPSPRHQGCSTARIDXAQGV

SEQ ID NO: 17713 - DNA, 693 bp, Zea mays
  misc_feature: Ceres CLONE 1383079-F
  misc_feature: Encodes the peptide sequence at SEQ ID NO. 17714
tccccgcggtggcggccgctctagaactagtggatcccccgggctgcaggaattcgcacgagaccattacctagaacatcctaatcgaaaagtcgcatcgcacgccatcagcagctagcgcgctcctcgagcccagcagagaaaggccggcagcgctaatcgtaatagccatgggctccaccgccggcgacgtggccgcggtggtggacgaggaggcgtgcatgtacgcgatgcagctggcgtcgtcgtccatcctgcccatgacgctgaagaacgccatcgagctgggcctgctggaggtgctgcagaaggaggccggcggcggcaaggcggcgctggcgcccgaggaggtggtggcgcggatgcccgcggcgcccagcgaccccgccgccgccgcggccatggtggaccgcatgctccgcctgctcgcctcctacgacgtcgtccggtgccagatggaggaccgggacggccggtacgagcgccgctactccgccgcgcccgtctgcaagtggctcacccccaacgaggacggcgtgtccatggccgccctcgcgctcatgaaccaggacaaggtcctcatggagagctggtactatctcaaggacgcggtgctggacggcggcatcccgttcaacaaggcgtacgggatgacggcgttcgagtaccacgggacggaccctcgcttcaccg

SEQ ID NO: 17714 - protein, 174 aa, Zea mays
  misc_feature: Ceres CLONE 1383079-F
  misc_feature (31)..(87): Pfam Name: Dimerisation Pfam Description: Dimerisation domain
  misc_feature: SWISSPROT Homolog: EC 2.1.1.68 Caffeate O-methyltransferase
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFT

SEQ ID NO: 17715 - DNA, 721 bp, Zea mays
  misc_feature: Ceres CLONE 1383083-F
  misc_feature: Encodes the peptide sequence at SEQ ID NO. 17716
  misc_feature (172)..(172): n is a, c, t, g, unknown, or other
  misc_feature (380)..(380): n is a, c, t, g, unknown, or other
  misc_feature (414)..(414): n is a, c, t, g, unknown, or other
tccccgcggtggcggccgctctagaactagtggatcccccgggctgcaggaattcgcacgagaccattacctagaacatcctaatcgaaaaccgaggaaggaaccctagcctagccttgctccgaccggtcgccgcggcgactgcgacgatgatggactgcgctggaggccngagaccccgtggaggacttcctcctcggcggcgccggcgacgacggagatctcgtcgccgtcttctgcgacgacggaggacttgggattgagggtatccatggagatgcttgtggatttgagcaatctaatttggggaaaaggggtagagatgaaccatgttcatctggcccaacatccaaagcttgtcgtgaaaaatgaggagggancagctgaatgacaggttcctggaatttagtcagntatgagtcctggtagggagcaaagtagataaagtaatatatgagtgatgcagcccggatgggggcaccacttaaaggtgagcagaaaagcttagggatccatggaaagctgcgggaaaattcagggatctggaggggggaaaaaccagctccggaaaaaaaaggggaactaaggtaaaaaagggttggtggggccccaagcccaacctttgggggaccccccaaaggaatggacccctttcccccttcccgttttaaaacacccggggggggacaccccttgggggcccccccccccacaaaaggcc

SEQ ID NO: 17716 - protein, 39 aa, Zea mays
  misc_feature: Ceres CLONE 1383083-F
  misc_feature (37)..(37): Xaa is any aa, unknown, or other
MEMLVDLSNLIWGKGVEMNHVHLAQHPKLVVKNEEGXAE

SEQ ID NO: 17717 - DNA, 705 bp, Zea mays
  misc_feature: Ceres CLONE 1383084-F
  misc_feature: Encodes the peptide sequence at SEQ ID NO. 17718
  misc_feature (381)..(381): n is a, c, t, g, unknown, or other
  misc_feature (382)..(382): n is a, c, t, g, unknown, or other
  misc_feature (390)..(390): n is a, c, t, g, unknown, or other
  misc_feature (391)..(391): n is a, c, t, g, unknown, or other
  misc_feature (408)..(408): n is a, c, t, g, unknown, or other
  misc_feature (426)..(426): n is a, c, t, g, unknown, or other
  misc_feature (428)..(428): n is a, c, t, g, unknown, or other
tggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccacccgggcggcgacctcccgcttctcaccctggcggnngcagacgnncaccgacgctttcgcgnctaccacccgccctcggngngcccgctcctccgccgctttctcgttggccggctctccgaataaggcgtctccccggggtcggcgaataccgcggctccctggggagttatcctcgggggccctcttgagggggtgggcccccccccaagggcaagtccgcctgaggggggcttttttaaggggggtttaacttgtcctcccttggccaaggcggggaggaccctcctcgggggggttcatctgttttccctggaaccacccgggtggagggggcccaaaatgggcaccaccccaac

SEQ ID NO: 17718 - protein, 96 aa, Zea mays
  misc_feature: Ceres CLONE 1383084-F
  misc_feature (22)..(95): Pfam Name: Cyt-b5 Pfam Description: Cytochrome b5-like Heme/Steroid binding domain
  misc_feature (67)..(67): Xaa is any aa, unknown, or other
  misc_feature (70)..(70): Xaa is any aa, unknown, or other
  misc_feature (76)..(76): Xaa is any aa, unknown, or other
  misc_feature (82)..(82): Xaa is any aa, unknown, or other
  misc_feature (83)..(83): Xaa is any aa, unknown, or other
MPPSVDAMPAPGDAAGGGDVRMISSKELRSHASADDLWISISGDVYDVTPWLPHHPGGDLPLLTLAXADXHRRFRXYHPPSXXPLLRRFLVGRLSE

SEQ ID NO: 17719 - DNA, 702 bp, Zea mays
  misc_feature: Ceres CLONE 1383089-F
  misc_feature: Encodes the peptide sequence at SEQ ID NO. 17720
  misc_feature (667)..(667): n is a, c, t, g, unknown, or other
  misc_feature (695)..(695): n is a, c, t, g, unknown, or other
ggagctccccgcggtggcggccgctctagaactagtggatcccccgggctgcaggaattcgcacgagaccattacctagaacatcctaatcgaaaaatcacaccacacgccagccagccatcgtcacactggtgagctctgcactctgcttagctccgagcttcagtgccttcgttgtttggtccacgcagtccacacacacacaccagtacgtccagctgcactgcaccaatggccgccgtcgaggtccaggtcccgactgccgctcccgtcgaggaggttgcccagctggccgccgcctccgccgtcgagatcccgaacgaggagaccgctgctccggcggtggagaccgaggtcgtcgtcgctaaggagccggtgccggccgaggccgagactgagtccaaggaggtcgaggtcgaggctgaggccgaggccgaggccgtagctgaggctgagccgaccgaggcagagcccgaggccgccttgccggcagcagagacggaggccaaggaagcagagccggaggccgccttgccggcagcagagacggaggctgctgctgccccggtcgaggctgctgagccggagatagccgccgagaccaaagaggtgcggtgggggggtctcccaacccaaagagaggaggaggcagcgcctgctgttgctngccactcctgaggtccagcgaccgaagnaaggaaa

SEQ ID NO: 17720 - protein, 148 aa, Zea mays
  misc_feature: Ceres CLONE 1383089-F
  misc_feature (146)..(146): Xaa is any aa, unknown, or other
MAAVEVQVPTAAPVEEVAQLAAASAVEIPNEETAAPAVETEVVVAKEPVPAEAETESKEVEVEAEAEAEAVAEAEPTEAEPEAALPAAETEAKEAEPEAALPAAETEAAAAPVEAAEPEIAAETKEVRWGGLPTQREEEAAPAVAXHS

SEQ ID NO: 17721 - DNA, 716 bp, Zea mays
  misc_feature: Ceres CLONE 1383093-F
  misc_feature: Encodes the peptide sequence at SEQ ID NO. 17722
tacccgcggtggcggccgctctagaactagtggatcccccgggctgcaggaattcgcacgagaccattacctagaacatcctaatcgaaaacgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggtggcgttgggtaccgtggaggtcgtggaggcggctgctacggcggtggcggtcgccgtgatggcgatggcggctattggggttggcgtcggctacgggggcgggggcaggctaccgaggagggtggtgccgagctaccggggtgctaatcggtgtgggcggcttaccggcacttcctaaggggaattgtaggtaacttgaacgggggggggtcctctcttggccaaggttatccctgtttcgtttac

SEQ ID NO: 17722 - protein, 141 aa, Zea mays
  misc_feature: Ceres CLONE 1383093-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGVGYRGGRGGGCYGGGGRRDGDGGYWGWRRLRGRGQATEEGGAELPGC

SEQ ID NO: 17723 - DNA, 712 bp, Zea mays
  misc_feature: Ceres CLONE 1383095-F
  misc_feature: Encodes the peptide sequence at SEQ ID NO. 17724
cgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcacgggctagccaacgagacggcagcaatggcggaccgtgaccgcagcggcatctacggcggcgcccacgccacctacgggcagcagcatcagcagggaggaggcgggcgcccgatgggtgagcaggtgaagggcatgctccacgacaaggggccgacggcgtctcaggcgctgacggtggtgacgctgttcccgcggggcgggctgctgctggtgctgtctgggctggcgctgacggcctccgtggaggggctggccgtggccacgccggtgctcctgatcttcagccccgtgctcgtccccgccgcgctgctcatcgggacggccggcatggtgttcctcacgtcgggcgcgctggggctcggaggcctgtcctcgctcacgtgcctcgccaacacggcgcgacaggcgttccagcgcaccccggactacgtggaggaagcgcaccgcagcatggcggaggccgcgccgcacgcgggccacaagaccgcgcaggctagccaggccatccaagccagggcgcaggaggccggagacgttggaggtgca

SEQ ID NO: 17724 - protein, 174 aa, Zea mays
  misc_feature: Ceres CLONE 1383095-F
  misc_feature (44)..(161): Pfam Name: Oleosin Pfam Description: Oleosin
MADRDRSGIYGGAHATYGQQHQQGGGGRPMGEQVKGMLHDKGPTASQALTVVTLFPRGGLLLVLSGLALTASVEGLAVATPVLLIFSPVLVPAALLIGTAGMVFLTSGALGLGGLSSLTCLANTARQAFQRTPDYVEEAHRSMAEAAPHAGHKTAQASQAIQARAQEAGDVGGA

SEQ ID NO: 17725 - DNA, 677 bp, Zea mays
  misc_feature: Ceres CLONE 1383099-F
  misc_feature: Encodes the peptide sequence at SEQ ID NO. 17726
ggagctccccgcggtggcggccgctctagaactagtggatcccccgggctgcaggaattcgcacgagaccattacctagaacatcctaatcgaaaaacctataatattttgagcattcagaaacacaccaagcgaagcacattagcaacaacctaacaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgcggcgagcgtcttacaacaccaatttcccaggtgcaacaacatccttggcacatctaacatacaacccatcgcaaacgcacagcaacaacaattcctaccagcactgagccacctagccatgggggaccctgccgctacttggaacagcagttgcttgcatcaaacccacttggtcctggaaaccggattggaaaccagcaaaacaaaagttgaaaaagtttctgccaagggctaacaattaaacagggggaaacctggcccctaactaaaaaaaaaaaaaatggtttttttaacccccctcctttggggccaatggcctaaattcctggaa

SEQ ID NO: 17726 - protein, 139 aa, Zea mays
  misc_feature: Ceres CLONE 1383099-F
  misc_feature (1)..(140): Pfam Name: Zein Pfam Description: Zein seed storage protein
MATKILSLLALLALFASATNAFIIPQCSLAPSSIITQFLPPVTSMGFEHPAVQAYRLQQAIAASVLQHQFPRCNNILGTSNIQPIANAQQQQFLPALSHLAMGDPAATWNSSCLHQTHLVLETGLETSKTKVEKVSAKG

SEQ ID NO: 17727 - DNA, 687 bp, Zea mays
  misc_feature: Ceres CLONE 1383107-F
  misc_feature: Encodes the peptide sequence at SEQ ID NO. 17728
  misc_feature (597)..(597): n is a, c, t, g, unknown, or other
  misc_feature (599)..(599): n is a, c, t, g, unknown, or other
  misc_feature (602)..(602): n is a, c, t, g, unknown, or other
  misc_feature (614)..(614): n is a, c, t, g, unknown, or other
  misc_feature (616)..(616): n is a, c, t, g, unknown, or other
  misc_feature (658)..(658): n is a, c, t, g, unknown, or other
  misc_feature (659)..(659): n is a, c, t, g, unknown, or other
  misc_feature (680)..(680): n is a, c, t, g, unknown, or other
  misc_feature (682)..(682): n is a, c, t, g, unknown, or other
  misc_feature (683)..(683): n is a, c, t, g, unknown, or other
aaactggagctccccgcggtggcggccgctctagaactagtggatcccccgggctgcaggaattcgcacgagaccattacctagaacatcctaatcgaaaaaacacacacacacaccactagtaggctagcctagccttttagtcgtcgaggaggagcaagaagggcgcgcacgcaagcaggcaagcaagaagagaagccgatcgaccgagagctagcacgcgatggcgaggtcttccaagatgatggtggcggcagctctgctggccttggccctggccgtgtcgaccgccgaggcgaggaacatcaagaccacgacgacggagaagaaggacgacgcggtggtgcagccgcagaacttcccgcccttcgaccgcctcggcggcggcgcgtccccggcgttcggcggcctccccggcggcagcattcctggcagcagcattcccgggttcagcatgcccggcagcggcagcagcctacccgggttcagcttgcccggcagcggcagatgcccctcttttcgcggcggctccccgggcttcagcggcttcggcggcatggcccgggtcgccaccgcccggttccgtcccgagcacgncnacnagccctgaacgncnaccagcgtggaaaaatagagtggtgctactgggtactgtaannacgtcgtcgcttatgcatggnanngggg

SEQ ID NO: 17728 - protein, 128 aa, Zea mays
  misc_feature: Ceres CLONE 1383107-F
  misc_feature (125)..(125): Xaa is any aa, unknown, or other
  misc_feature (126)..(126): Xaa is any aa, unknown, or other
  misc_feature (127)..(127): Xaa is any aa, unknown, or other
MARSSKMMVAAALLALALAVSTAEARNIKTTTTEKKDDAVVQPQNFPPFDRLGGGASPAFGGLPGGSIPGSSIPGFSMPGSGSSLPGFSLPGSGRCPSFRGGSPGFSGFGGMARVATARFRPEHXXXP

SEQ ID NO: 17729 - DNA, 713 bp, Zea mays
  misc_feature: Ceres CLONE 1383111-F
  misc_feature: Encodes the peptide sequence at SEQ ID NO. 17730
  misc_feature (321)..(321): n is a, c, t, g, unknown, or other
  misc_feature (369)..(369): n is a, c, t, g, unknown, or other
cgctctagaactagtggatcccccgggctgcaggaattcgcacgagaccattacctagaacatcctaattgaaaacttttaatttcatttcctctcttttgacgacggaaacgaggcacgatcacacgctgaacgcttccgccccgccgccaccttccccgctctcctccctccgctcgcctccgcttccgttccgcgccctgcccccggaaggcaagcaaagccctcgctacttgcggagcgtcgttggtcaaaccctagcacacgtacgagcaggccagccccgcccgctcccattcccaggccctcatccatggcggngctctccgtgcccctccacgccgccgccggatcccgcgccgccgcggncgaccccgtcaaggttcccgtgcgtgaggagcactggttcagcccatttcggccgcgccttcccctccgtcgcggtctcctctttggctgcgaggcacatcgagccgatgagagcgatagctacacagcgcccccggccgtgcaaaatatttgagtggcgagaagacaaaaacggcatcaacggctttggcgaatggcaggtttgtccctgcaattgcacctagcaaaaacaattttgaattggggttggaaagaccctttcgttgaggctaagaaatgggcaaatatgtcaagatgacctccaccctgggccggttaaagggctaaattggggtgggggagaa

SEQ ID NO: 17730 - protein, 69 aa, Zea mays
  misc_feature: Ceres CLONE 1383111-F
  misc_feature (3)..(3): Xaa is any aa, unknown, or other
  misc_feature (19)..(19): Xaa is any aa, unknown, or other
MAXLSVPLHAAAGSRAAAXDPVKVPVREEHWFSPFRPRLPLRRGLLFGCEAHRADESDSYTAPPAVQNI

SEQ ID NO: 17731 - DNA, 675 bp, Zea mays
  misc_feature: Ceres CLONE 1383112-F
  misc_feature: Translation starting site: 166
  misc_feature (383)..(383): n is a, c, t, g, unknown, or other
  misc_feature (384)..(384): n is a, c, t, g, unknown, or other
  misc_feature (394)..(394): n is a, c, t, g, unknown, or other
  misc_feature (475)..(475): n is a, c, t, g, unknown, or other
  misc_feature (485)..(485): n is a, c, t, g, unknown, or other
tggagctccccgcggtggcggccgctctagaactagtggatcccccgggctgcaggaattcgcacgagaccattacctagaacatcctaatcgaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgcnncgccgccggntcatctggccgccgccaccatgccactaccctactcaaccgccccggcctcagcctcatccccaggccacaccatggccgntgggcacagncgcatccaagcccgtggcagctgcagggaaccctgcggcgttggcagcaccccgatcctgggccagtgcgtcgagttcctgaggcatcagtgcagcccgacggcgacgccttactgctcgcctcagtgccagtccgtgcggcagcagtgttgccagcagctcaggcaagtggaggcgcagcaccggtacc

SEQ ID NO: 17732 - DNA, 682 bp, Zea mays
  misc_feature: Ceres CLONE 1383122-F
  misc_feature: Encodes the peptide sequence at SEQ ID NO. 17733
  misc_feature (505)..(505): n is a, c, t, g, unknown, or other
tggcggccgctctagaactagtggatcccccgggctgcaggaattcgcacgagaccattacctagaacatcctaatcgaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaacctgcggcngtggcagcaccccgatcctggggcagtgcgtcaagtttctggaggatcagggaagcccggacgggaaccccctatgggtccccctaatggccaatcttttggggaaaaaaggttgtccccccaccccccccggggggggggggggccccccccccgcccaaacgggttttttttttt

SEQ ID NO: 17733 - protein, 77 aa, Zea mays
  misc_feature: Ceres CLONE 1383122-F
  misc_feature (19)..(19): Xaa is any aa, unknown, or other
MPVPTAASKPVPAAGNLRXWQHPDPGAVRQVSGGSGKPGREPPMGPPNGQSFGEKRLSPHPPRGGGGPPPRPNGFFF

SEQ ID NO: 17734 - DNA, 707 bp, Zea mays
  misc_feature: Ceres CLONE 1383124-F
  misc_feature: Encodes the peptide sequence at SEQ ID NO. 17735
  misc_feature (377)..(377): n is a, c, t, g, unknown, or other
aaagctggagctccccgcggtggcggccgctctagaactagtggatcccccgggctgcaggaattcgcacgagaccattacctagaacatcctaatcgaaaaatcacaattcacagcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagttccccgtcggccggatcgggcgctacctcaagaaggggcggtacgcgcagcgcgtgggcaccggcgcccccgtctatctcgccngccgtgcttgagtaccctcgccgcccgaggtggctggagctgggcgggaaacgcgggcgaaggaccacaaagaggacggcgcattcgtcccgcggaacacttgctccctgggggattccgtaaccgaacgttgaagctccggcaaagctggctggcctgggggtcaaccatccgggggaacgggggggggggccctccccacaaaattaaaacccggggtttttcctgggccccaaaaaaagggggggggggaaaaaagaggggtcccacgggggggggagaaaaaaaaaggaagaaaaaaaaaccccccccccaaaaaaaaaagggggg

SEQ ID NO: 17735 - protein, 67 aa, Zea mays
  misc_feature: Ceres CLONE 1383124-F
  misc_feature (65)..(65): Xaa is any aa, unknown, or other
MDASGAGSKAKKGAAGRKAGGPRKKSVSRSVKAGLQFPVGRIGRYLKKGRYAQRVGTGAPVYLAXRA

SEQ ID NO: 17736 - DNA, 682 bp, Zea mays
  misc_feature: Ceres CLONE 1383125-F
  misc_feature: Encodes the peptide sequence at SEQ ID NO. 17737
  misc_feature (491)..(491): n is a, c, t, g, unknown, or other
  misc_feature (540)..(540): n is a, c, t, g, unknown, or other
  misc_feature (572)..(572): n is a, c, t, g, unknown, or other
aaagctggagctccccgcggtggcggccgctctagaactagtggatcccccgggctgcaggaattcgcacgagaccattacctagaacatcctaatcgaaaattacctcacgctctctcgtggtcgttgcttcctggcggcggcgccgccctcttcgtcgggccattcaccggcgacgagcattcatctggaggagagcatcacactcatctaactgatattaggatgagtctatgtacaatagcacgccgactatgtctttcaaaaccatcctctgtgaatcgtctttcagtaatttgggctcatctatacagcaccgaggctgcaaaggacacgggtgctaagaagtcaagtaccctgatgtatacgacccatacgggcctatgtcgctaccgtcagagaaaagttgtgggatctagctgaccgcatcgctgctctccctccctgagagatcaacagattgctccagccctttctatcagactgaaccnagagccgcacaggctatctccggccagggtttcagttttgtgctcaggngggggccggggggtcggtgccggaaaggctgnagaaaagaagctgaaaaacagtcttcgatgtcaggtggagaaattcgagctgctgcaagatcagattatcaaggagacaggactttttcacgatttggggctgaaggagg

SEQ ID NO: 17737 - protein, 140 aa, Zea mays
  misc_feature: Ceres CLONE 1383125-F
KAGAPRGGGRSRTSGSPGLQEFARDHYLEHPNRKLPHALSWSLLPGGGAALFVGPFTGDEHSSGGEHHTHLTDIRMSLCTIARRLCLSKPSSVNRLSVIWAHLYSTEAAKDTGAKKSSTLMYTTHTGLCRYRQRKVVGSS

SEQ ID NO: 17738 - DNA, 684 bp, Zea mays
  misc_feature: Ceres CLONE 1383130-F
  misc_feature: Encodes the peptide sequence at SEQ ID NO. 17739
  misc_feature (558)..(558): n is a, c, t, g, unknown, or other
  misc_feature (676)..(676): n is a, c, t, g, unknown, or other
tggagctccccgcggtggcggccgctctagaactagtggatcccccgggctgcaggaattcgcacgagaccattacctagaacatccaatcgaaaaatccccaaatcggcctacgcccacggttccacctcctcgtccacgaggtgaggaaaccctagcgaccgaccatggcgttgctcccgcgcaccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctccagccctcccgcaaggtttatgaccaaatgctgaanccctagggtgggttatttcaatgggcagctgtgcccaacggtggtggatactaccattactcctactctgtgggaaacgtgggatgtgaccgtataagtccctgggggactctaccgntccctggg

SEQ ID NO: 17739 - protein, 125 aa, Zea mays
  misc_feature: Ceres CLONE 1383130-F
  misc_feature: SWISSPROT Homolog: EC 1.6.5.3 NADH dehydrogenase (ubiquinone)
MALLPRTARLALLSTPRAYSAAAAAGASPTSPAPYGGAPPPAMSKTAEFVVSKVDDLMNWARKGSIWPMTFGLACCAVEMMHAGASRYDFDRFGVIFRPSPRQSDCMIVAGTLTNKMAPALPQGL

SEQ ID NO: 17740 - DNA, 740 bp, Zea mays
  misc_feature: Ceres CLONE 1383131-F
  misc_feature: Encodes the peptide sequence at SEQ ID NO. 17741
  misc_feature (419)..(419): n is a, c, t, g, unknown, or other
  misc_feature (421)..(421): n is a, c, t, g, unknown, or other
  misc_feature (422)..(422): n is a, c, t, g, unknown, or other
  misc_feature (487)..(487): n is a, c, t, g, unknown, or other
aaagctggagctccccgcggtggcggccgctctagaactagtggatcccccgggctgcaggaattcgcacgagaccattacctagaacatcctaatcgaaaaactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgacttcgcgngnntttggtggggggccggccgccatcgcgctggcgtccatgggcggcccgggttcgtcaccttcggngggcctcggcggtcgctgcggcttgtccgtgttcctcctgggatgtaacagtaccttgacggggcaagcacccgcccgggcggccgaccagctgggaccacgccaaggcgaaggctgggcgtccaaagccccgcgaaatcaagggatgcagcacggaaccgcatcgaccaagggggcaaggggggctttggaaaagaaaaccacccttggaggggaaccggggggggggttctccttggaaccaatggccggg

SEQ ID NO: 17741 - protein, 186 aa, Zea mays
  misc_feature: Ceres CLONE 1383131-F
  misc_feature (36)..(155): Pfam Name: Oleosin Pfam Description: Oleosin
  misc_feature (80)..(80): Xaa is any aa, unknown, or other
  misc_feature (102)..(102): Xaa is any aa, unknown, or other
MADHHRGATGGGGGYGDLQRGGGMHGEAQQQQKQGAMMTALKAATAATFGGSMLVLSGLILAGTVIALTVATPVLVTSRXFGGGPAAIALASMGGPGSSPSXGLGGRCGLSVFLLGCNSTLTGQAPARAADQLGPRQGEGWASKAPRNQGMQHGTASTKGARGALEKKTTLGGEPGGGFSLEPMAG

SEQ ID NO: 17742 - DNA, 680 bp, Zea mays
  misc_feature: Ceres CLONE 1383133-F
  misc_feature: Encodes the peptide sequence at SEQ ID NO. 17743
  misc_feature (537)..(537): n is a, c, t, g, unknown, or other
  misc_feature (538)..(538): n is a, c, t, g, unknown, or other
  misc_feature (564)..(564): n is a, c, t, g, unknown, or other
  misc_feature (601)..(601): n is a, c, t, g, unknown, or other
  misc_feature (606)..(606): n is a, c, t, g, unknown, or other
ggagctccccgcggtggcggccgctctagaactagtggatcccccgggctgcaggaattcgcacgagaccattacctagaacatcctaatcgaaaaagttcgttcgcgttgcccgcgactctctccgtcctcctactgcccacccgactcacacgcttggcacgcgcgtgcttccacccgtccgtcgcctctctctcggctgcctgattgatttggttgccccggttccagcaatggcggtccaggcgcattatcaccaccactaccaccgcgagtcccctttcctcgtcagcggcgcgccggagggcagccggttggcggcagcgatggagctgcatcatcaggcgcagaaggaggctatggcgccgcagcaggctcaggctccgcccctctttcttggacttctcgcatgggagattacgggcgcggaaggaaagcgcagcgcgaggcgaacccatgtcgtcgcagttcttctctctgcagcagcaccgcaggcgcaggggccaagggtgatcacctggcgcacttcagaagcgnnacgcgatgggctccggctcgacttcnacgagggctcgagcacgtgtcgtgcacgtcccccggnctcgncctcggctcatgtctcctctctaaagactcgccgcgcagcgcgtcagacagggacgaaatgaacggctgatccg

SEQ ID NO: 17743 - protein, 144 aa, Zea mays
  misc_feature: Ceres CLONE 1383133-F
  misc_feature (102)..(102): Xaa is any aa, unknown, or other
  misc_feature (111)..(111): Xaa is any aa, unknown, or other
  misc_feature (123)..(123): Xaa is any aa, unknown, or other
  misc_feature (125)..(125): Xaa is any aa, unknown, or other
MAVQAHYHHHYHRESPFLVSGAPEGSRLAAAMELHHQAQKEAMAPQQAQAPPLFLGLLAWEITGAEGKRSARRTHVVAVLLSAAAPQAQGPRVITWRTSEAXRDGLRLDFXEGSSTCRARPPXSXSAHVSSLKTRRAARQTGTK

SEQ ID NO: 17744 - DNA, 644 bp, Zea mays
  misc_feature: Ceres CLONE 1383134-F
  misc_feature: Encodes the peptide sequence at SEQ ID NO. 17745
  misc_feature (416)..(416): n is a, c, t, g, unknown, or other
  misc_feature (456)..(456): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
ggagctccccgcggtggcggccgctctagaactagtggatcccccgggctgcaggaattcgcacgagaccattacctagaacatcctaatcgaaaactaatcgagcatcgcagagataggcgtcttcgtactcgcctacctccgcggctcaaacctttcccccttctcccaattccctccgtcggccgccgctccatcccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgtttttgntgacctttgaaccactgtcatcgatgaggtgaggactggnacnnntacgcagctcttccaccctgagcagctcatcagtgggaaaggagatgcagccaacaactttgcccgtgtccctacaccattgcaaaggagatggtggactatggcttgatcgatcaggaaactgccgaaaatggactgggtcccagggctcctcgctttcaacttttgggggaagaccggtct

SEQ ID NO: 17745 - protein, 70 aa, Zea mays
  misc_feature: Ceres CLONE 1383134-F
  misc_feature (68)..(68): Xaa is any aa, unknown, or other
MRECISIHIGQAGIQVGNACWELYCLEHGIQADGQMPGDKTIGGGDDAFNTFFSETGAGKHVPRAVFXDL

SEQ ID NO: 17746 - DNA, 702 bp, Zea mays
  misc_feature: Ceres CLONE 1383136-F
  misc_feature: Encodes the peptide sequence at SEQ ID NO. 17747
  misc_feature (557)..(557): n is a, c, t, g, unknown, or other
  misc_feature (687)..(687): n is a, c, t, g, unknown, or other
  misc_feature (702)..(702): n is a, c, t, g, unknown, or other
aaagctggagctccccgcggtggcggccgctctagaactagtggatcccccgggctgcaggaattcgcacgagaccattacctagaacatcctaatcgaaaaaaaaataggctccccaagaaacccacggacaacagagtagcttaaacacgcgctcgcgtacagcgaagaaatggcgatggcgatgcagccatcttagtccccttccctgatcccctctccctctccttctccatggccgcccctcctctggtgtttgtcgccgctgccatagccgcgctcgccatcttcgtcctcgtcctcgtcgtcttcgccttccggcgatgggggtgggtggcggcggcagcgccgcccgctccaggccgcggcggaggcctcgaccccggtcgctgtccaggaggaggatatagataggcctcttctttccgaaaatcgggacgatcactctagacaaagtaattattttttcttggaagttctgtaggagaaccttcaaagattcaatcaaataggagtaacatttccgcctagaagtcatgcaattgctgatacagggnaggacttatccagatgaatggtgtgctacacaagggagaaactcatgtaaatcatattgaaaatgatattttctggagaagtttcgattaaggaagcacgttaagacggacatcaccagcaaaattgacnacacctgctcgaagn

SEQ ID NO: 17747 - protein, 59 aa, Zea mays
  misc_feature: Ceres CLONE 1383136-F
MAAPPLVFVAAAIAALAIFVLVLVVFAFRRWGWVAAAAPPAPGRGGGLDPGRCPGGGYR

SEQ ID NO: 17748 - DNA, 733 bp, Zea mays
  misc_feature: Ceres CLONE 1383144-R
  misc_feature (489)..(489): n is a, c, t, g, unknown, or other
cgattgggtaccgggccccccctcgaggtcgacggtatcgataagcttttttttttttttttttagttcagcaacaatacataatacatagatgtaaaataatacagagatggtccagaaaagattcttgtcgtttttacataataaaatggagactcatttttctttctttgggttgagaagaaatcaacagatgcacaagcaagcaaagaagagacgatagtaaacattagttcccacatgtttcactccgtacccatcactacttggtttctgtatgtacagagagatacaataaacaaacaccttcttaatcatggctcaagcttcatctgtagtgttggctcagaacagctgttgttgttgctctgctgctgaacatctccaaaacccatctgaaacatgctttgaagatcattttcccagaatccctgtgtctcagcttgaacaatgcatcggtggaaggggattgagcgtctgagaatctangcatgttcttggcaagaagatagtatgctgatggaagtctttgctctgagcaggcattgagtatagagactgcgtttaatgcctctcccggtgaaaccatctctgtggaaaagcagccctaggggtaaactcccaccctggattaataagacgccgcttcttaaacaaaacctcaccttggcccgcaaggactggacaaatttaatgatttcctcaaacataacggcttttcccgaaaaccggg

SEQ ID NO: 17749 - DNA, 647 bp, Zea mays
  misc_feature: Ceres CLONE 1383146-F
  misc_feature: Encodes the peptide sequence at SEQ ID NO. 17750
gctctagaactagtggatcccccgggctgcaggaattcgcacgagacaattacctagaacatcctaatcgaaaacgggatactacactacccagctcctctccagtctcaacccagcccgcctctcgaacttccagaaccgtcctctcgctacctgcggctgcggctgctatctctgtcatctagaggagagtgtaagggcactagatagagagtgatggcttctcctgatccatcggcggcagatgccggcaccgggggcgagtcgacgagccaggcggcggccgtggaaccgatccggatgccgacggtggaggagatcaaggggcaggacatctggaacaactgcgccgttcgcagcgtcgtcagtggcgtcatgggaggcggtcttggtgtgcttatgggacttttctttggagctttggaaaatccgataatggcagagcagatgacagcaaggcagcaaatagtatacacagcaaagcagatgggtagtagaagtataagtaatgccaaaacccttgcagtcatgggtctgattttctcagcaactgaatgtacataagaaaggttcgggcaagcatgaccctaccaatacagcggtagctgcctgtgccccggaagaagctttagctgaaaaaggcggcc

SEQ ID NO: 17750 - protein, 115 aa, Zea mays
  misc_feature: Ceres CLONE 1383146-F
MASPDPSAADAGTGGESTSQAAAVEPIRMPTVEEIKGQDIWNNCAVRSVVSGVMGGGLGVLMGLFFGALENPIMAEQMTARQQIVYTAKQMGSRSISNAKTLAVMGLIFSATECT

SEQ ID NO: 17751 - DNA, 653 bp, Zea mays
  misc_feature: Ceres CLONE 1383158-F
  misc_feature: Encodes the peptide sequence at SEQ ID NO. 17752
  misc_feature (311)..(311): n is a, c, t, g, unknown, or other
  misc_feature (328)..(328): n is a, c, t, g, unknown, or other
tccccgcggtggcggccgctctagaactagtggatcccccgggctgcaggaattcgcacgagaccattacctagaacatcctaatcgaaaaatccccaatatatccccactcttcgcctcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcaaaccatccgccacatgatcgnagatgactgcgccgacnacggcatccctcttcctaaacgtacttccagatcctaatccagggtatcggagtactgcaacaaagcacttacatggcgccgggcggcgcgccggcgcctcaaagggcggttccgacgacgtgggtggcggctccggcaaaaggaacgccggcctcgggggaggactcaggaactgggatggggactttcgtaaggtccaaccaggccacccttttccaaccctcttttgggtggcgaattatttgaaaatcagggggtttggttcaacctgacctgggaaaattgtgggtggaatgggtccaggggcaaaaaaccccaaaaaaa

SEQ ID NO: 17752 - protein, 55 aa, Zea mays
  misc_feature: Ceres CLONE 1383158-F
  misc_feature (8)..(53): Pfam Name: Skp1_POZ Pfam Description: Skp1 family, tetramerisation domain
  misc_feature (38)..(38): Xaa is any aa, unknown, or other
  misc_feature (44)..(44): Xaa is any aa, unknown, or other
MAAEGEKKMITLKSSDGEEFEVEEAVAMESQTIRHMIXDDCADXGIPLPKRTSRS

SEQ ID NO: 17753 - DNA, 667 bp, Zea mays
  misc_feature: Ceres CLONE 1383160-F
  misc_feature: Translation starting site: 459
  misc_feature (486)..(486): n is a, c, t, g, unknown, or other
  misc_feature (510)..(510): n is a, c, t, g, unknown, or other
tccccgcggtggcggccgctctagaactagtggatcccccgggctgcaggaattcgcacgagaccattacctagaacatcctaatcgaaaaagaaactgttccgctcccactccgatcggattcggtgggacggtggcatctatgcgcccgcggcaccgtcgctcaaactgtataaacctgcgctcgaacacttcgagctcacccgcaacctcctccgggaagcgcgatcgccatctcgaaggagctgagatccaagattccaagctcttctgtcagttgagggaagttgaagcaaaaatgttttacgggggatatgcttaccatggcaactcgtttgagcaaacataccgttgttatccagcatcgttttttgataagcacacctggaaggcggtgataaagtaataatgccaccttctgcccctgatcgtcttgcttcttgcacatcgagtaccctatgctatttgagctgcacaatgatgcanccaacggattccccactggggtgnttggagtttggtgcaaaagaggcatgatctcctgccttattggaggagcaaaaatgctgcttcaaaaggggaacttgccatggcaaaagggacccttcccagggccatttgggaaattgcccccccccaagggtttttggaatttccaacccaaaac

SEQ ID NO: 17754 - DNA, 732 bp, Zea mays
  misc_feature: Ceres CLONE 1383163-F
  misc_feature: Translation starting site: 314
  misc_feature (10)..(10): n is a, c, t, g, unknown, or other
  misc_feature (14)..(14): n is a, c, t, g, unknown, or other
  misc_feature (15)..(15): n is a, c, t, g, unknown, or other
  misc_feature (22)..(22): n is a, c, t, g, unknown, or other
  misc_feature (35)..(35): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (541)..(541): n is a, c, t, g, unknown, or other
tttttttttntttnnttttttnatttgttcgattncnccgggnnnngnncaaagctgggactccccgcggtggcggccgctctagaactagtggatcccccgggctgcaggaattcgcacgagaccattacctagaacatcctaatcgaaaaagtgcccttctgtctcctatctccccggagtccccgctgcccagcccggtctcactttccagtctccgagactccgagtctcgctcgcaccccgtcccctgcagcctgtgctctgggttggagggaggtgagctgcgagggagcgcggagggggcgaggagatggaggcagattcggcgaggaagagacttgcattgctggccctgcttctcctggcggcgcccgtccgcccggcctcggcggctccggtggaggatggcctgctcagcaatggtgactttgagacagcaccaagtggtggttttgtaaaatctgcttctgttgctgagggtgcatcgtcaatccctggttggacgatcaacggcacggttgaactcatttcagcaggncaacacccagggtggcatgatcctgattgttccacaggcggaccatgcagtaacgctaggcaatgatgctaccgttgcgcaggtggtggacgtcgagaagggttcggagtatcctatcacattcagtgctgcccggacatgtgcacaactggagggaactgaatgtttccgtgctagggggcgtgactcaa

SEQ ID NO: 17755 - DNA, 834 bp, Zea mays
  misc_feature: Ceres CLONE 1383166-F
  misc_feature: Encodes the peptide sequence at SEQ ID NO. 17756
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (19)..(19): n is a, c, t, g, unknown, or other
  misc_feature (35)..(35): n is a, c, t, g, unknown, or other
  misc_feature (36)..(36): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
aaaannnnnnnaacccccnaaaactacccccgccnnttttggggnnnngnaaaagctggagctccccgcggtggcggccgctctagaactagtggatcccccgggctgcaggaattcgcacgagaccattacctagaacatcctaatcgaaaaagacacactcaaccaggggttttgctagggttctcatcctgccgccacagcgatggccgctgccgccgccggcgaggacgacgcggcgtgggagcgcgccatctccgccgccaccaagtccacctcggcgcccaagaccctcaccctcgacggcgccgtcaagtcctccacgggcggcctcccctccgccgcgctcctcgagcgcttcgacgcctccctccgaggagctctcccgccgcgggggcgcgcctctcctcgctcgcggggctgccccgcctcccggggctccgggcgccatctccctccccgacaaaccgcatctagggggggccgccggctctcgcccgcccgtcggccgaggggatggtgggcgcccacccgcggcggccgaccgccgaaccctagggaaaaccatccggctccccgccgcagggtcccaggaagcctcgctggcccacttcccacggggcgttcccgcgggcagaggtcgggatatcaaccctgttaactaaatgcgcccctgttccacccacggggccctagggaggcagcagggggaatgaagaggccttgtaccacgtctatagtctctctcatcacctcgatcgccaccccggaggggggcggcgggtgctgctggagggcggcaaccgggaaggcggctttcggattcaccggggg

SEQ ID NO: 17756 - protein, 151 aa, Zea mays
  misc_feature: Ceres CLONE 1383166-F
MAAAAAGEDDAAWERAISAATKSTSAPKTLTLDGAVKSSTGGLPSAALLERFDASLRGALPPRGRASPRSRGCPASRGSGRHLPPRQTASRGGRRLSPARRPRGWWAPTRGGRPPNPRENHPAPRRRVPGSLAGPLPTGRSRGQRSGYQPC

SEQ ID NO: 17757 - DNA, 689 bp, Zea mays
  misc_feature: Ceres CLONE 1383169-F
  misc_feature: Encodes the peptide sequence at SEQ ID NO. 17758
  misc_feature (353)..(353): n is a, c, t, g, unknown, or other
  misc_feature (356)..(356): n is a, c, t, g, unknown, or other
tggagctccccgcggtggcggccgctctagaactagtggatcccccgggctgcaggaattcgcacgagaccattacctagaacatcctaatcgaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaancgncaggtggagacgcacgactacgtctcccggctcaaccaggactccctccagtgggccgtctatgactcccgacaaggccgacgccggtctcatcgggcggggagtacatcggggccaaggaaaatcttcaactccctgcccgggggaggaccaacgggtgggggactctccccccccccaaaatcaattcaggccttggggacaaaccccccccggggggggtttttcttggaaaaagggggattttgaaccaatgggcccccccctttcggaaaatttttggggcacctgggagaggggccccggagaaacccccctgccgcttgggccccc

SEQ ID NO: 17758 - protein, 151 aa, Zea mays
  misc_feature: Ceres CLONE 1383169-F
  misc_feature (26)..(146): Pfam Name: DUF1264 Pfam Description: Protein of unknown function (DUF1264)
  misc_feature (68)..(68): Xaa is any aa, unknown, or other
MASSDGKPLPTPASVGGGGGSSTAPPGQPTTVASKVLDMGAAAMQSLRPVKQAKQHMCTFALYAHDPXRQVETHDYVSRLNQDSLQWAVYDSRQGRRRSHRAGSTSGPRKIFNSLPGGGPTGGGLSPPPKSIQALGTNPPRGGFFLEKGGF

SEQ ID NO: 17759 - DNA, 673 bp, Zea mays
  misc_feature: Ceres CLONE 1383181-F
  misc_feature: Encodes the peptide sequence at SEQ ID NO. 17760
  misc_feature (528)..(528): n is a, c, t, g, unknown, or other
aaagctggagctccccgcggtggcggccgctctagaactagtggatcccccgggctgcaggaattcgcacgagaccattacctagaacatcctaatcgaaaaaaacccaatccatccaaacccatttccctcgctcccatcccgtcccgccccttgtctcttccgcttccccccgaccccgcgcgccgcggaccagcagccatgtcgtgctcccacctctccaccgcctggtcctcctcggcgctcgccagcagcgcctccaccacccgacggcgctcccccccgcgctcgggtctcctggtgcggtgttccctccgtgagctccgcacccgcatcgactccgtcaggaacacgcagaagatcacggaggccatgaagctggtggccgccgccaaggtccggcgcgcgcaggaggccgtcgtctcctctcgccctttctcggaggcgctggtggaggtgctctacaacatgaaccaggagatccagacggaggacatcgacctgcccctcacccgcacccgccccgtnaagaaggtgggccctcgtggtcctgaccggcgaggggcggcctctgcgggagcttcaacaacaacgtgctcaagaggggcggaaacccgcatcgatgagcttcagcagctggggctccagtacacccgtcgtcaggcggggggaa

SEQ ID NO: 17760 - protein, 157 aa, Zea mays
  misc_feature: Ceres CLONE 1383181-F
  misc_feature (36)..(155): Pfam Name: ATP-synt Pfam Description: ATP synthase
  misc_feature: SWISSPROT Homolog: EC 3.6.3.14 H(+)-transporting two-sector ATPase
MSCSHLSTAWSSSALASSASTTRRRSPPRSGLLVRCSLRELRTRIDSVRNTQKITEAMKLVAAAKVRRAQEAVVSSRPFSEALVEVLYNMNQEIQTEDIDLPLTRTRPVKKVGPRGPDRRGAASAGASTTTCSRGAETRIDELQQLGLQYTRRQAGG

SEQ ID NO: 17761 - DNA, 728 bp, Zea mays
  misc_feature: Ceres CLONE 1383187-F
  misc_feature: Encodes the peptide sequence at SEQ ID NO. 17762
  misc_feature (590)..(590): n is a, c, t, g, unknown, or other
  misc_feature (713)..(713): n is a, c, t, g, unknown, or other
tccccgcggtggcggccgctctagaactagtggatcccccgggctgcaggaattcgcacgagaccattacctagaacatcctaatcgaaaaacccaccaatccacagcgacacccgaccccgccgtcgtgatgaggccggcgctgctcaagtccacggccgagctcctccgccgcagccgcggctacgcctcctcggccaacccggagcggaaggtggccatcctgggcgctgcgggcggcatcgggcagccgctctccctcctcatgaagctcaacccgctcgtctcctccctctccctctatgatatcgccgggacccccggcgtcgcggccgacgtctcccacatcaactcccccgccctggtgaaggggttcatgggggacgaccagctcggggaggcgctcgagggctccgacgtcgtcatcatccccgccggggtgcccagaaagcccggcatgactagggacgacctcttcaacatcaacgccggcatcgttaaggggctctgcactgccatcgccaagcactgccccaacgctcttgtcaatatgatcagcaaccctgttaactccactgtcccgattggcnggcggaggttttcaaagaaggctggtacttatgagccgaagaaagctggtttggtggactactccctgggagggttgtccgggctaaaactttttaggctgggaaaaagcggggtgtgccagntaccgggagtgaaaa

SEQ ID NO: 17762 - protein, 199 aa, Zea mays
  misc_feature: Ceres CLONE 1383187-F
  misc_feature (27)..(171): Pfam Name: Ldh_1_N Pfam Description: lactate/malate dehydrogenase, NAD binding domain
  misc_feature: SWISSPROT Homolog: EC 1.1.1.37 Malate dehydrogenase
  misc_feature (154)..(154): Xaa is any aa, unknown, or other
  misc_feature (195)..(195): Xaa is any aa, unknown, or other
MRPALLKSTAELLRRSRGYASSANPERKVAILGAAGGIGQPLSLLMKLNPLVSSLSLYDIAGTPGVAADVSHINSPALVKGFMGDDQLGEALEGSDVVIIPAGVPRKPGMTRDDLFNINAGIVKGLCTAIAKHCPNALVNMISNPVNSTVPIGXRRFSKKAGTYEPKKAGLVDYSLGGLSGLKLFRLGKSGVCQXPGVK

SEQ ID NO: 17763 - DNA, 713 bp, Zea mays
  misc_feature: Ceres CLONE 1383190-F
  misc_feature: Encodes the peptide sequence at SEQ ID NO. 17764
  misc_feature (628)..(628): n is a, c, t, g, unknown, or other
  misc_feature (629)..(629): n is a, c, t, g, unknown, or other
gctctagaactagtggatcccccgggctgcaggaattcgcacgagaccattacctagaacatcctaatcggaaaatcacggcggcggtggcggagcgtaaggcgaaggagtagcagcagcaggcggcgccgagtagcggctccccatctcgagcttgccaccatggctagaggattgaagaagcatttgaagaggctcaatgcccccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccttatctgaacacgtatgacggccgcaccatccgctaccctgaccccctcatcaggnncacgacacccatcagatcgatctggagacccacagattgtggacttcatcaagttgatggtggcacgtcgtcatggtgactgcg

SEQ ID NO: 17764 - protein, 181 aa, Zea mays
  misc_feature: Ceres CLONE 1383190-F
  misc_feature (94)..(171): Pfam Name: Ribosomal_S4e Pfam Description: Ribosomal family S4e
  misc_feature (3)..(40): Pfam Name: RS4NT Pfam Description: RS4NT (NUC023) domain
  misc_feature (42)..(90): Pfam Name: S4 Pfam Description: S4 domain
  misc_feature (156)..(156): Xaa is any aa, unknown, or other
MARGLKKHLKRLNAPKHWMLDKLGGAFAPKPSSGPHKSRECLPLILIIRNRLKYALTYREVISILMQRHVLVDGKVRTDKTYPAGFMDVISIPKTNENYRLLYDTKGRFRLHPIRDEDAKFKLCKVRSVQFGQKGIPYLNTYDGRTIRYPDPLIRXTTPIRSIWRPTDCGLHQVDGGTSSW

SEQ ID NO: 17765 - DNA, 678 bp, Zea mays
  misc_feature: Ceres CLONE 1383192-F
  misc_feature: Translation starting site: 396
  misc_feature: Pfam Name: Di19 Pfam Description: Drought induced 19 protein (Di19)
  misc_feature (520)..(520): n is a, c, t, g, unknown, or other
  misc_feature (577)..(577): n is a, c, t, g, unknown, or other
ggagctccccgcggtggcggccgctctagaactagtggatcccccgggctgcaggaattcgcacgagaccattacctagaacatcctaatcgaaaactccactcctcctcctctctctctccacatttcctctcccgataagagtgaggcctcggctaagcttgagcttcccctccctcccctccagcgctccagctcccctccatcctcggccaaaaattctgcggcgagctccgatccggtccgactactaacccacgccgcagaagccgcgcgacctgatcgcgcgggggtcgaggagaggggaagcgcggcgccgcggttgcctgccaccgtaccgccgcaggagaaggaaagagagcccgtatccctccgccccgctgcccgccggaccgatggactccgagcactggatctcgcgcctgggcgccgcgaagcgcttctacgcggcgcagctcggccacagcgatcgggccgggatggacgagctggagatggacgagggagtcaggccccgagntcccctggccctactgctacgaggaacacgacgtcggatccctctgcgcggactggnagagggagacccgttcgaccccaagcccggggctgccctgtctggtcaaaaatgggtaccaaggaattggttaccaatttactaccgcacgtggaatttta

SEQ ID NO: 17766 - DNA, 731 bp, Zea mays
  misc_feature: Ceres CLONE 1383194-F
  misc_feature: Encodes the peptide sequence at SEQ ID NO. 17767
  misc_feature (373)..(373): n is a, c, t, g, unknown, or other
  misc_feature (429)..(429): n is a, c, t, g, unknown, or other
  misc_feature (463)..(463): n is a, c, t, g, unknown, or other
  misc_feature (584)..(584): n is a, c, t, g, unknown, or other
  misc_feature (585)..(585): n is a, c, t, g, unknown, or other
  misc_feature (616)..(616): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (722)..(722): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
  misc_feature (727)..(727): n is a, c, t, g, unknown, or other
  misc_feature (729)..(729): n is a, c, t, g, unknown, or other
gctctagaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggatgcnaagagcgagtgccgcgagcggcaccagcaagctgacgcggggcgaggacggcgacnagcggcgtgggacgcctacgtctcccccttcggnaagggggggcgagtggccggcgccagtgcctgcgcccgccacgagggccaggccgtgggaggacccaggagtggcatgaggcggtgccgccgccgcgggactggccgtcgacatggaggcnnagagtacggtcgcggcagcgagaggcgcggncaagtgcccgggaagaggtgcgagcgccaccaccgcgggggacttggtgggagaggcagcgctgcctgtgatgnnnannncccgggggggggggnnnnnnnannnnnnnnncnct

SEQ ID NO: 17767 - protein, 175 aa, Zea mays
  misc_feature: Ceres CLONE 1383194-F
  misc_feature (82)..(82): Xaa is any aa, unknown, or other
  misc_feature (134)..(134): Xaa is any aa, unknown, or other
  misc_feature (169)..(169): Xaa is any aa, unknown, or other
  misc_feature (170)..(170): Xaa is any aa, unknown, or other
  misc_feature (171)..(171): Xaa is any aa, unknown, or other
MGKGSVGASWWAFLLLAGVLLVVAATAGAEDGVVERDRKEDLRWCKQACEWQYGKDTPRKRDAKSECRERHQQADAGRGRRXAAWDAYVSPFGKGGRVAGASACARHEGQAVGGPRSGMRRCRRRGTGRRHGGXEYGRGSERRGQVPGKRCERHHRGGLGGRGSAACDXXXPGGG

SEQ ID NO: 17768 - DNA, 689 bp, Zea mays
  misc_feature: Ceres CLONE 1383195-F
  misc_feature: Encodes the peptide sequence at SEQ ID NO. 17769
tggcggccgctctagaactagtggatcccccgggctgcaggaattcgcacgagaccattacctagaacatcctaatcgaaaaaaggttctaggctcgattgaacaaattggagcggcactacactcctccacgcctccacctccagcctcccactgatctggcctctctcgaggtgagcgcgcctttaatcctagatcaatatgagaaggggctacagttacagtccttcaccaccaaggggctacaggagaagggcgcgcagtccaagtcctcatgatcattatggtggtcgtggtagggatctcccaaccagtcttctggtcaggaatctccgtcgggactgcaggccagaagacctccgtcgcccatttggacagtttggtcgagttaaagatatatatcttccaagagattattacactggggagccccgagggtttgggtttgtccagtattatgatcctgctgatgctgctgatgccaagtactatatggatggggcaggtagttcttggtaggcaaataacagttgtttttgcagaagagaacagaaagagccctcagagatgagagctaggacaggagtcaggggtcattcttagaatgacaggaggattcctcgctctaggtcgctcccttaattatagggggcgctctccttccgcagcaaaagcttactcgaggtctc

SEQ ID NO: 17769 - protein, 105 aa, Zea mays
  misc_feature: Ceres CLONE 1383195-F
  misc_feature (39)..(104): Pfam Name: RRM_1 Pfam Description: RNA recognition motif. (a.k.a. RRM, RBD, or RNP domain)
MRRGYSYSPSPPRGYRRRARSPSPHDHYGGRGRDLPTSLLVRNLRRDCRPEDLRRPFGQFGRVKDIYLPRDYYTGEPRGFGFVQYYDPADAADAKYYMDGAGSSW

SEQ ID NO: 17770 - DNA, 683 bp, Zea mays
  misc_feature: Ceres CLONE 1383197-F
  misc_feature: Encodes the peptide sequence at SEQ ID NO. 17771
tggagctccccgcggtggcggccgctctagaactagtggatcccccgggctgcaggaattcgcacgagaccattacctagaacatcctaatcgaaaaaatctgacggtggcagtgacgactccaacgaccaggcgcggaggctgcactgctccagcgaaggcaccatgtcattcatgtctccattcccggggatggatctaagtaaaatggatcccgggactctgaccctccttggggcagctggttgtgtaatgctgactatgcatttcactgtgcaattggtgtcacaacatctcttctattggaaaaaccccaaggagcagaaagccatacttattattgtgctgatggctccactatacgctatctcttccttcgtgggtcttcttgatatcccaggtagcaagacatttttcacattcttagatgctgttaaagaatgctatgaggcactggtgattgctaagtttatggcattgatgtacagctacttggatatatctatcaccaagaacatagtccctgatggaatcaaagggagggggctccatcattccctccctggttccccttttcctggcccccaatgtcccaattggaaccaaaaaattttaagctttctgaaaattggaccctgccatttttgtttattgtaaggcccattatgccccctctcgaataa

SEQ ID NO: 17771 - protein, 163 aa, Zea mays
  misc_feature: Ceres CLONE 1383197-F
  misc_feature (18)..(163): Pfam Name: DUF300 Pfam Description: Domain of unknown function
MSFMSPFPGMDLSKMDPGTLTLLGAAGCVMLTMHFTVQLVSQHLFYWKNPKEQKAILIIVLMAPLYAISSFVGLLDIPGSKTFFTFLDAVKECYEALVIAKFMALMYSYLDISITKNIVPDGIKGRGLHHSLPGSPFPGPQCPNWNQKILSFLKIGPCHFCLL

SEQ ID NO: 17772 - DNA, 653 bp, Zea mays
  misc_feature: Ceres CLONE 1383200-R
cgattgggtaccgggccccccctcgaggtcgacggtatcgataagcttttttttttttttttttcatatgacaacagcaggcacactccttttattcgcaaaagccagccaagtattacagtgtcacgtatcagaaggacgcactccactcagcagctatacctatatgttccgttcttctcactggacagtgatagacggagatcctcacactgcatgcgtaccattttcacaactcagctgatgtatgttccttcatttacagtgtgatgcatgtgcacgtgtaaccggatcaggctgcggcgacatgactctgttccttgaccacgctctctccaccctgttccagattctgtacatgcgcaggcttctcttcgttggccttccccttgccgcctccttccagttccagctctttcagctgcctcaggatatcttctctcttggcatgtaggtcttgcagtttggtgtccaccttctccagctttgctctgagcttcacgggatcggtcgtcttctccttggcgcccttgtctttcttcttctctccacccttgtctttcttcttctctttcttctccttgtcattcttctcacccttgtccttcttatctttcttttctttgcccttctcctcgcctccgtcgtcccca

SEQ ID NO: 17773 - DNA, 732 bp, Zea mays
  misc_feature: Ceres CLONE 1383200-F
  misc_feature: Encodes the peptide sequence at SEQ ID NO. 17774
  misc_feature (548)..(548): n is a, c, t, g, unknown, or other
  misc_feature (652)..(652): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (708)..(708): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (727)..(727): n is a, c, t, g, unknown, or other
gcggtggcggccgctctagaactagtggatcccccgggctgcaggaattcgcacgagaccattacctagaacatcctaatcgaaaaattctcgaagtcgctgcggcacgcgtcccgcttctggtttgcttgcctgttgcctcccagatcttgccaactaattggaggcagccgagctgatctcccattctcccatcccgcaacgcgccgtctcgacggcggatcggtttcttctgcttctactgcgtgatctttgggcaagaagataagacacgtccaagcgtcgccacagtcaagggcggcttggttgcaggcaagatggggaaggacggagaatctgccaagctgaaggaggagaaggagtccaaggaagagatccatgtgaaggtcaagagcaagggcgagcggtccggcgaggaagacggcaaggaggaggtcgaggtagagattgaggccaagtttgttgagaaggaagaggtcaaagactcgggtgacggtgcgggaggaaagggtaccaagaagaaggatacaaagaagaaagacaagaanaagaaggaaggtggtgacgattcagggaaggcagaggaagacaagaaggataaagcgaaggattcagagggcaaggaccaagtgaagaagaaagaaaggatggntggtggggacnnnacgaggcgaggagaaagggcaagaaagaaaagatagaaggacnaggtgnnnaaaaaatgacnaggag

SEQ ID NO: 17774 - protein, 127 aa, Zea mays
  misc_feature: Ceres CLONE 1383200-F
  misc_feature (77)..(77): Xaa is any aa, unknown, or other
  misc_feature (112)..(112): Xaa is any aa, unknown, or other
  misc_feature (116)..(116): Xaa is any aa, unknown, or other
MGKDGESAKLKEEKESKEEIHVKVKSKGERSGEEDGKEEVEVEIEAKFVEKEEVKDSGDGAGGKGTKKKDTKKKDKXKKEGGDDSGKAEEDKKDKAKDSEGKDQVKKKERMXGGDXTRRGERARKKR

SEQ ID NO: 17775 - DNA, 823 bp, Zea mays
  misc_feature: Ceres CLONE 1383201-F
  misc_feature: Encodes the peptide sequence at SEQ ID NO. 17776
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnccgcggcnnnncnnnagggcgggccctaaaaaannnnnnnnaaaagctggggctccccgcggtggcggccgctctagaactagtggatcccccgggctgcaggaattcgcacgagaccattacctagaacatcctaatcgaaaaaccccgacggtgaattccccattcacatctgtagccgcgcctctccgtttcactccgcgcctctctcccgccaggccgccacccaagcaaccatggcgaccgcgctgctccgccgcgcgctccacctccgccgtgtgctcccctcgcccgccgtcaccgccgccgcctcccagcgcctcatccccgccttctcgaccacccccacgccgaccccgaccacctcccagcagaacggcccgccacccactaacgatccgaccctctcctcccgaagaaaagccgcccggccggcctccctcaataaggttgggggtaccgggagcaaagcaggcagcaagtgcggtccagggcttgcggagcggcccggcgaaaaagaagggggggggggaaacccgtggactccaacggtccaaagaaggacgaaagggggacccggggggggccaaaaaaaaaatgggcgggggccccaaaagtaattcgggaggggggaggggaagggggggggggggaacggcctttgcgggggggggagcacacacgggggggggggcgccccccccccccaaaaaaaaaaaaaaaaaagggggcccggggcgcaaaaaaaaaaagcccccccccccccccggctatctctggagaaagagagagcagggggggcgggccacacccc

SEQ ID NO: 17776 - protein, 127 aa, Zea mays
  misc_feature: Ceres CLONE 1383201-F
MATALLRRALHLRRVLPSPAVTAAASQRLIPAFSTTPTPTPTTSQQNGPPPTNDPTLSSRRKAARPASLNKVGGTGSKAGSKCGPGLAERPGEKEGGGGNPWTPTVQRRTKGGPGGGQKKNGRGPQK

SEQ ID NO: 17777 - DNA, 698 bp, Zea mays
  misc_feature: Ceres CLONE 1383203-F
  misc_feature: Translation starting site: 101
  misc_feature: Pfam Name: Glucosamine_iso Pfam Description: Glucosamine-6-phosphate isomerases/6-phosphogluconolactonase
  misc_feature: SWISSPROT Homolog: EC 3.1.1.31 6-phosphogluconolactonase
  misc_feature (614)..(614): n is a, c, t, g, unknown, or other
tccccgcggtggcggccgctctagaactagtggatcccccgggctgcaggaattcgcacgagaccattacctagaacatcctaatcgaaaaaccacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggagaagttcgcggccgagaggggtgccttcaccgccgtgctctctggcggatccctcatcgaggcactcaggaagctgacggagccgccgtacctggattcagtggactggagcaagtggcacgtcttctggggtggatgagagggtcgtgcccaagggacatgtggatagcaactacagctcgccttatgatgggtttctctccaaggtgccgattcctcctggnacagttatgctataaaacgatgcgttgtcagctgaaggagcggagacgaactacgaagcgtgcctgagcacttggccaagaaag

SEQ ID NO: 17778 - DNA, 720 bp, Zea mays
  misc_feature: Ceres CLONE 1383205-F
  misc_feature: Encodes the peptide sequence at SEQ ID NO. 17779
  misc_feature (364)..(364): n is a, c, t, g, unknown, or other
  misc_feature (377)..(377): n is a, c, t, g, unknown, or other
  misc_feature (396)..(396): n is a, c, t, g, unknown, or other
  misc_feature (460)..(460): n is a, c, t, g, unknown, or other
  misc_feature (461)..(461): n is a, c, t, g, unknown, or other
  misc_feature (480)..(480): n is a, c, t, g, unknown, or other
  misc_feature (510)..(510): n is a, c, t, g, unknown, or other
  misc_feature (526)..(526): n is a, c, t, g, unknown, or other
  misc_feature (556)..(556): n is a, c, t, g, unknown, or other
  misc_feature (692)..(692): n is a, c, t, g, unknown, or other
  misc_feature (693)..(693): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (717)..(717): n is a, c, t, g, unknown, or other
  misc_feature (718)..(718): n is a, c, t, g, unknown, or other
  misc_feature (719)..(719): n is a, c, t, g, unknown, or other
cgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagagggatgccnagagcgagtgccgcgagcngcacagcaagctgacgcggggcgaggacgggaccagcggcgtggacgcctactctcccgctcgnnaaaggggccgaagtgccgncgccagtgcctggcccgcccgagggccagnccgtggaaaacccagnagggccatggaggcgtgccgccggcgcggnactgggcgtcgaatgggaaccaagagtacggtcgcggcagcgagagcgcggccaaggggcccgggaaaaggtgccagcgccacccccgcgggggactgggggggaggagcaacgctgctgtgtgaaaaaaaaaaanngggggggggggcnnnnnnnnnnnnnnc

SEQ ID NO: 17779 - protein, 173 aa, Zea mays
  misc_feature: Ceres CLONE 1383205-F
  misc_feature (64)..(64): Xaa is any aa, unknown, or other
  misc_feature (70)..(70): Xaa is any aa, unknown, or other
  misc_feature (92)..(92): Xaa is any aa, unknown, or other
  misc_feature (98)..(98): Xaa is any aa, unknown, or other
  misc_feature (108)..(108): Xaa is any aa, unknown, or other
  misc_feature (113)..(113): Xaa is any aa, unknown, or other
  misc_feature (169)..(169): Xaa is any aa, unknown, or other
MGKGSVGASWWAFLLLAGVLLVVAATAGAEDGVVERDRKEDLRWCKQACEWQYGKDTPRKRDAXSECREXHSKLTRGEDGTSGVDAYSPARXRGRSAXASAWPARGPXRGKPXRAMEACRRRGTGRRMGTKSTVAAARARPRGPGKGASATPAGDWGGGATLLCEKKKXGGGA

SEQ ID NO: 17780 - DNA, 722 bp, Zea mays
  misc_feature: Ceres CLONE 1383208-F
  misc_feature: Encodes the peptide sequence at SEQ ID NO. 17781
  misc_feature (641)..(641): n is a, c, t, g, unknown, or other
  misc_feature (675)..(675): n is a, c, t, g, unknown, or other
  misc_feature (676)..(676): n is a, c, t, g, unknown, or other
  misc_feature (722)..(722): n is a, c, t, g, unknown, or other
cgcggtggcggccgctctagaactagtggatcccccgggctgcaggaattcgcacgagaccatacctagaacatcctaatcgaaaaattgatccctgaaacccatccacaattggtagctcgttgatccaaatccaagacctcacgtcaacgcactgtctcgcctgttaattagtcgtcgacgtcgtcgtctatgtccaggctgatggctgccatgctgctcggaggcgcgcgcgtcgccggcgccgcaaagctcaccggtaacggcaacgctgctggcatgcaggctcttcccatgccggcgtgcttccttccgccgcgcccgcaggcagcgacctggacccgcctctgcttgcaggctgcgccaagattgtcccaggcatacgacaacgcgccggaagaccggagagaaataggggacaagtacaaggacgcggcggaggaggcgaaggacgccaccggggacgccaaggagcacgccaagaggatggccggggagacgaagagcagggcgcaggacaaggccggccgcgtggcggaccaggcgtcgggcatggccgagcgggccaaggaccaggcgaagggcgtgccggaggacgcccgcggacacgcgtcccgggcgacggagcgagcgaagacganacgcgtgacgcggccgcggaagccgcggacaggnncgggcacgtgaaagagcgggccaaggaggcggacacgaggccgcgn

SEQ ID NO: 17781 - protein, 164 aa, Zea mays
  misc_feature: Ceres CLONE 1383208-F
  misc_feature (150)..(150): Xaa is any aa, unknown, or other
  misc_feature (162)..(162): Xaa is any aa, unknown, or other
MSRLMAAMLLGGARVAGAAKLTGNGNAAGMQALPMPACFLPPRPQAATWTRLCLQAAPRLSQAYDNAPEDRREIGDKYKDAAEEAKDATGDAKEHAKRMAGETKSRAQDKAGRVADQASGMAERAKDQAKGVPEDARGHASRATERAKTXRVTRPRKPRTGXGT

SEQ ID NO: 17782 - DNA, 680 bp, Zea mays
  misc_feature: Ceres CLONE 1383211-F
  misc_feature: Encodes the peptide sequence at SEQ ID NO. 17783
  misc_feature (538)..(538): n is a, c, t, g, unknown, or other
agagctggagctccccgcggtggcggccgctctagaactagtggatcccccgggctgcaggaattccacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgcccggccgcatcgcgctggcgctcatgggcggcgggttcgtcacctccggcggcctcggcgtcgctgcgctgtccgtgttctcctggatgtancagtacctgacggggcagcacccgccgggcgccgaccagctgggacacgccaaggcgaggctggcgtccaggccccgcgacatcaaggatgcagcacagcaccgcatcgaccaggcgcaggggtcctgagaaaggaacacac

SEQ ID NO: 17783 - protein, 156 aa, Zea mays
  misc_feature: Ceres CLONE 1383211-F
  misc_feature (36)..(146): Pfam Name: Oleosin Pfam Description: Oleosin
  misc_feature (114)..(114): Xaa is any aa, unknown, or other
MADHHRGATGGGGGYGDLQRGGGMHGEAQQQQKQGAMMTALKAATAATFGGSMLVLSGLILAGTVIALTVATPVLVIFSPVLVPGRIALALMGGGFVTSGGLGVAALSVFSWMXQYLTGQHPPGADQLGHAKARLASRPRDIKDAAQHRIDQAQGS

SEQ ID NO: 17784 - DNA, 730 bp, Zea mays
  misc_feature: Ceres CLONE 1383214-F
  misc_feature: Encodes the peptide sequence at SEQ ID NO. 17785
  misc_feature (545)..(545): n is a, c, t, g, unknown, or other
  misc_feature (560)..(560): n is a, c, t, g, unknown, or other
  misc_feature (577)..(577): n is a, c, t, g, unknown, or other
  misc_feature (578)..(578): n is a, c, t, g, unknown, or other
  misc_feature (626)..(626): n is a, c, t, g, unknown, or other
  misc_feature (685)..(685): n is a, c, t, g, unknown, or other
ggagctccccgcggtggcggccgctctagaactagtggatcccccgggctgcaggaattcgcacgagaccattacctagaacatccaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggtgcatctcccaccgccggtccacctgccgccgccggtccacctgccaccgccggtccatgtgccgccgccggttcatctgccgccgccaccatgccactaccctactcaaccgccccggcctcagcctcatccccagccacacccatgcccgtgccaacagccgcatccaagcccgtgccagctgcagggaaacctgcggcgttggcagcaccccgatcctgggccagntggcgtcgagttccntgaggcatcagtgcagnnccgacggcgacgccctatggctcgcctcagtggccagtcgttgcgggnaaagcagtggtgccagcagcttcaaggcagggtggagccgcagcacgggtaccaggcgnattcttttcggctttggggccccccagtccatccctgcagagagg

SEQ ID NO: 17785 - protein, 189 aa, Zea mays
  misc_feature: Ceres CLONE 1383214-F
  misc_feature (128)..(128): Xaa is any aa, unknown, or other
  misc_feature (133)..(133): Xaa is any aa, unknown, or other
  misc_feature (139)..(139): Xaa is any aa, unknown, or other
  misc_feature (155)..(155): Xaa is any aa, unknown, or other
  misc_feature (175)..(175): Xaa is any aa, unknown, or other
MRVLLVALALLALAASATSTHTSGGCGCQPPPPVHLPPPVHLPPPVHLPPPVHLPPPVHLPPPVHLPPPVHVPPPVHLPPPPCHYPTQPPRPQPHPQPHPCPCQQPHPSPCQLQGNLRRWQHPDPGPXGVEFXEASVQXRRRRPMARLSGQSLRXKQWCQQLQGRVEPQHGYQAXSFRLWGPPVHPCRE

SEQ ID NO: 17786 - DNA, 762 bp, Zea mays
  misc_feature: Ceres CLONE 1383217-F
  misc_feature: Encodes the peptide sequence at SEQ ID NO. 17787
  misc_feature (130)..(130): n is a, c, t, g, unknown, or other
  misc_feature (325)..(325): n is a, c, t, g, unknown, or other
  misc_feature (374)..(374): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagcntcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgancaggggccgacggcgtcgcaggcgctgacggtggcgacgctgttccccngctggcggctgctgctggtgctgtcggggctggcgctgaacgcctcccgtgtggggctggcccgtggccaccccggtgttcctgatcttcagccccgtggtggtccccgccgggctgctcatcgggaacggccggtaagggggttcctccagtcgggggccgtgggggctcggggggctggccctccctcacgtgcctccgcaaaccggggcgggaagggggtcccagggacccccggaataagggggaggaaggccccccccaaaaatggcggaaaggccccggcaaaacggggcccaaaaacccggcgggggagggccacgcccccccgggggggggggcaagagccccggcccccgcgggaaagggcagagggcccccccctttt

SEQ ID NO: 17787 - protein, 185 aa, Zea mays
  misc_feature: Ceres CLONE 1383217-F
  misc_feature (40)..(40): Xaa is any aa, unknown, or other
  misc_feature (57)..(57): Xaa is any aa, unknown, or other
MADRDRSGIYGGAHATYGQQQQQGGGGRPMGEQVKGMLHXQGPTASQALTVATLFPXWRLLLVLSGLALNASRVGLARGHPGVPDLQPRGGPRRAAHRERPVRGFLQSGAVGARGAGPPSRASANRGGKGVPGTPGIRGRKAPPKNGGKAPAKRGPKTRRGRATPPRGGGQEPRPPRERAEGPPL

SEQ ID NO: 17788 - DNA, 664 bp, Zea mays
  misc_feature: Ceres CLONE 1383223-F
  misc_feature (354)..(354): n is a, c, t, g, unknown, or other
  misc_feature (360)..(360): n is a, c, t, g, unknown, or other
  misc_feature (385)..(385): n is a, c, t, g, unknown, or other
  misc_feature (391)..(391): n is a, c, t, g, unknown, or other
  misc_feature (421)..(421): n is a, c, t, g, unknown, or other
  misc_feature (423)..(423): n is a, c, t, g, unknown, or other
  misc_feature (490)..(490): n is a, c, t, g, unknown, or other
  misc_feature (548)..(548): n is a, c, t, g, unknown, or other
  misc_feature (563)..(563): n is a, c, t, g, unknown, or other
  misc_feature (585)..(585): n is a, c, t, g, unknown, or other
tccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaagaatggcaagcctttcatgtgctcgggcggnacgtgntgtcggttccgcgctctgcccgccnagctgntgctgtgggccagctgctgctttcctacgncngctccagtcgcgaaccgagaagtgcaagtgcttgccttgcgccacatctccacgcttgccgaggggnagggatttcgtcgcaggggcccgggccgtcccatctcaaggtcgtcgggctccacagnagcgcgaagcgcggnctttttaaattggcagggccgncaaaccccggggggggggcggggttccaaaaacgggcgcccctgaaaacccccccgggcgcaaacggccaaattttccc

SEQ ID NO: 17789 - DNA, 654 bp, Zea mays
  misc_feature: Ceres CLONE 1383228-F
  misc_feature: Encodes the peptide sequence at SEQ ID NO. 17790
  misc_feature (476)..(476): n is a, c, t, g, unknown, or other
  misc_feature (507)..(507): n is a, c, t, g, unknown, or other
  misc_feature (654)..(654): n is a, c, t, g, unknown, or other
tggagctccccgcggtggcggccgctctagaactagtggatcccccgggctgcaggaattcgcacgagaccattacctagaacatcctaatcgaaaaaacccgggtgccttcacgcttgacaggcacccatcccacgccacgggctcctcctcccctccgcttctcctctaggtccctctcctgcagaaccctcccaatccaaagcgattcctccgggccgccgcggcggcgtctccccgggcgcccctagcacagctcgcgttccggtggaacagagaagagaggcgcgaggatggagatccagtcgtctggccgctccatcgaggggctgatggagaaggtgctgtccgtgaacatcctctcctcggactacttcaaggagctcttcaagtacaagacctaccacgagggcgtcgacgagatctacaaccaggtggaccacgtcgaggcctggatgaccggcaactggcgcggnccctcctccggcttctgcctcctctacaagntattcaccatgaagctcaccggccagcagatgcacgggctgctcaagcaccaggactccccctacatacagagagtattggatttctctaccctaccataaggtggcgaaccgagacacttttgttgggcgggaatgaccctataan

SEQ ID NO: 17790 - protein, 104 aa, Zea mays
  misc_feature: Ceres CLONE 1383228-F
  misc_feature (72)..(72): Xaa is any aa, unknown, or other
MEIQSSGRSIEGLMEKVLSVNILSSDYFKELFKYKTYHEGVDEIYNQVDHVEAWMTGNWRGPSSGFCLLYKXFTMKLTGQQMHGLLKHQDSPYIQRVLDFSTLP

SEQ ID NO: 17791 - DNA, 720 bp, Zea mays
  misc_feature: Ceres CLONE 1383229-F
  misc_feature: Encodes the peptide sequence at SEQ ID NO. 17792
  misc_feature (493)..(493): n is a, c, t, g, unknown, or other
  misc_feature (624)..(624): n is a, c, t, g, unknown, or other
  misc_feature (625)..(625): n is a, c, t, g, unknown, or other
  misc_feature (666)..(666): n is a, c, t, g, unknown, or other
tccccgcggtggcggccgctctagaactagtggatcccccgggctgcaggaattcgcacgagaccattacctagaacatcctaatcgaaaactctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcagcagtgcgatccagagaaagagaacttgtgcctttatggtttgccaaatgagacttgggaggtcactcttccagctgaggaagtacctcctgagcttccagaaccagcactggggataaactttgcccgtgatggaatggtcgaaaaagactggttgtctctangttgcagtcatagtgatgcatggctcctggtctgtgcattctactttggagctcgttttggatttgacaaagatgcccaggagagggctcctcaccatgattaacaacctgcccactgtttatgaagttgnntgacggggttgctaaaaaagcaatcgaaagcccccaacggnaggcagaaaagcagcaagcctacctctaaaccattcaaaactggacaatcctaa

SEQ ID NO: 17792 - protein, 133 aa, Zea mays
  misc_feature: Ceres CLONE 1383229-F
  misc_feature (100)..(100): Xaa is any aa, unknown, or other
MDGDGGGAGALHHHTRSPEDVFRDFRARRAGIVKALTTDVEKFYQQCDPEKENLCLYGLPNETWEVTLPAEEVPPELPEPALGINFARDGMVEKDWLSLXCSHSDAWLLVCAFYFGARFGFDKDAQERAPHHD

SEQ ID NO: 17793 - DNA, 693 bp, Zea mays
  misc_feature: Ceres CLONE 1383231-F
  misc_feature: Encodes the peptide sequence at SEQ ID NO. 17794
  misc_feature (518)..(518): n is a, c, t, g, unknown, or other
  misc_feature (526)..(526): n is a, c, t, g, unknown, or other
  misc_feature (532)..(532): n is a, c, t, g, unknown, or other
  misc_feature (571)..(571): n is a, c, t, g, unknown, or other
  misc_feature (584)..(584): n is a, c, t, g, unknown, or other
  misc_feature (585)..(585): n is a, c, t, g, unknown, or other
  misc_feature (659)..(659): n is a, c, t, g, unknown, or other
cgcggtggcggccgctctagaactagtggatcccccgggctgcaggaattcgcacgagaccattacctagaacatcctaatcgaaaattctctcccctgagcctgactggaaccttcccgagagaggatacaaaggcacccggatcgaggaaaccaatccattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgcccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggnccgcatcnggcacnttcgtggaggccagaaccctggagggcccgtgggcgtcnactacgtgacccnnaaaagggaaggtgctgaccccccggccgacgacgcgcaccacatcaacaagcacaaacttccgcgttccccttncgttctgcggctggcgcggaacctcgggaggggg

SEQ ID NO: 17794 - protein, 164 aa, Zea mays
  misc_feature: Ceres CLONE 1383231-F
  misc_feature (29)..(164): Pfam Name: SOR_SNZ Pfam Description: SOR/SNZ family
  misc_feature (106)..(106): Xaa is any aa, unknown, or other
  misc_feature (109)..(109): Xaa is any aa, unknown, or other
  misc_feature (111)..(111): Xaa is any aa, unknown, or other
  misc_feature (124)..(124): Xaa is any aa, unknown, or other
  misc_feature (128)..(128): Xaa is any aa, unknown, or other
  misc_feature (153)..(153): Xaa is any aa, unknown, or other
MASDGSGVVTVYGSNGAELLEPSKQPKSATFSVKVGLAQMLRGGVIMDVVPPEQARLAEEAGACAVMALERVPADIRAQGGVARMSDPGLIRDIKRAVTIPVMAKXRIXHXRGGQNPGGPVGVXYVTXKREGADPPADDAHHINKHKLPRSPXVLRLARNLGRG

SEQ ID NO: 17795 - DNA, 708 bp, Zea mays
  misc_feature: Ceres CLONE 1383233-F
  misc_feature (664)..(664): n is a, c, t, g, unknown, or other
  misc_feature (665)..(665): n is a, c, t, g, unknown, or other
  misc_feature (694)..(694): n is a, c, t, g, unknown, or other
  misc_feature (695)..(695): n is a, c, t, g, unknown, or other
gcggtggcggccgctctagaactagtggatcccccgggctgcaggaattcgcacgagaccattacctagaacatcctaatcgaaaactgtgtcttgtccagtccgggtctccagggctccggcaccggcaggcagagagctaccaaaccccaccaccacgaacggccgccggcgacgagacgggggcgcatggcgactgcatcctccttcaccgccatcttcttcagcagcgccttcgcgggctgcttcgcggagccaaagtgcggctcctgctgcaaaggaaggcaccactaccgtcgccaccagtggctgcagcagctgctgctggaggcacgctagccacaatcatgtgcatcgccagggaggaaagggttgccgcgctctggaaggacgtcatccccgggctccaccgacagttcctctatggcggcctccgcatcggcttgtatgagcctgtgaaggctttcttcgtcgcaggcgctgttgatgggtgatgtcagtttactaagcaagatccttgctgcacttaccacaggcgtgatagcgattgttgcggcaacatccaactgagcttgtcaaagttaggttgcaagctgatgggaagagctaacactaaatcagaggagttattctggagcccttaatgcatacgctacaatatccnnacccaggaaggtattggccagctttgtgnnactggactttggt

SEQ ID NO: 17796 - DNA, 645 bp, Zea mays
  misc_feature: Ceres CLONE 1383233-R
caattgggtaccgggccccccctcgaggtcgacggtatcgataagcttttttttttttttttttaaaaaccactggtagaggtctattgaaccgagactttgtctgtctttcatatcgccggggtcttgatgaataatttgcgtctcccaaatattaccaaattggctctgaatgataaccatgcggcatgtgatcgtattggtcttggcttccgacaaaggcattggtcagtcgaactatcccttggcctaggatcttcccgctcgttgacgataggaccagtgatcacaaaacctttcatttgccccttggggttccaatgactcctgtttatcttctaactactgaaaacgccacctttctgcgcccgggttcctctgacctggatgacagctggaacaacctttttccttatatcacgcttccatttcttctcggtgggcatcccctggtcaccgacccaagcgcatcgctctcggttgacacgacccttgattcccttcacgtcaggacgtagaagctctcggcaccctgtgttgtcggcacagttcacggtcgccgcttcagggagaccaaaccacctcctgaacttgtttcgagatatacctccacgtccccgcttaaactttttgtacggcttgacc

SEQ ID NO: 17797 - DNA, 672 bp, Zea mays
  misc_feature: Ceres CLONE 1383235-F
  misc_feature: Encodes the peptide sequence at SEQ ID NO. 17798
  misc_feature (444)..(444): n is a, c, t, g, unknown, or other
  misc_feature (529)..(529): n is a, c, t, g, unknown, or other
  misc_feature (540)..(540): n is a, c, t, g, unknown, or other
  misc_feature (672)..(672): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttncatcacgggcggaccaactaccccggcgtggccggcaacggcgcgacgttctacttccctggtgtcgccatcctggccggcgtgnggggcgccgcntccaagctggcggggcgggcacaactggcgcgcctgggggccacgacagcctgggccaccaacggccgggcgtcccctcatcgccctgggccatcacgggggttcccctttcggttgggcctcgaaggaaan

SEQ ID NO: 17798 - protein, 109 aa, Zea mays
  misc_feature: Ceres CLONE 1383235-F
  misc_feature (14)..(110): Pfam Name: AWPM-19 Pfam Description: AWPM-19-like family
  misc_feature (34)..(34): Xaa is any aa, unknown, or other
  misc_feature (63)..(63): Xaa is any aa, unknown, or other
MAGIGRNMVAPLLVLNLIMYIIVIGFASWNLNHXHHGRTNYPGVAGNGATFYFPGVAILAGVXGAASKLAGRAQLARLGATTAWATNGRASPHRPGPSRGFPFRLGLEG

SEQ ID NO: 17799 - DNA, 685 bp, Zea mays
  misc_feature: Ceres CLONE 1383238-F
  misc_feature: Encodes the peptide sequence at SEQ ID NO. 17800
  misc_feature (320)..(320): n is a, c, t, g, unknown, or other
  misc_feature (378)..(378): n is a, c, t, g, unknown, or other
  misc_feature (419)..(419): n is a, c, t, g, unknown, or other
cgcggtggcggccgctctagaactagtggatcccccgggctgcaggaattcgcacgagaccattacctagaacatcctaatcgaaaaatcgcacatattattgagaccaactatcaacatagaaagcacaatagtgtaccaacaatggcagccaaaatattttgcctccttatgctccttggactttctgcaagtgctgctacggcgaccattttcccgcaatgctcacaagctcctatagcttcccttcttcccccgtacctctcaccagtggtgtcttcggtatgtcaaaacccaattcttgcaccctacaggatccnacaggcaatcgcagctgacatcttacctgtatcacccttgttcctcgaacatcatcangcctattacagcaggttacttttggtgcatttattggcacnaaacatcagggcacaacaactacaacaactttgtggctagcaaaaccttgcttggctactcctcaggaaacagcagtttctttccattcacccacttaactgcattgaaatcccgcttctttatttgaaaaaaaaaaaaataacattttagcccagttacctggtggcaaacccccaaaaatttttttcattttaaacaaatggggaaaaattgaaccccccgggtttaattacagggggaaaaaacctataaaccaaagtttttg

SEQ ID NO: 17800 - protein, 104 aa, Zea mays
  misc_feature: Ceres CLONE 1383238-F
  misc_feature (59)..(59): Xaa is any aa, unknown, or other
  misc_feature (78)..(78): Xaa is any aa, unknown, or other
  misc_feature (92)..(92): Xaa is any aa, unknown, or other
MAAKIFCLLMLLGLSASAATATIFPQCSQAPIASLLPPYLSPVVSSVCQNPILAPYRIXQAIAADILPVSPLFLEHHXAYYSRLLLVHLLAXNIRAQQLQQLCG

SEQ ID NO: 17801 - DNA, 725 bp, Zea mays
  misc_feature: Ceres CLONE 1383243-F
  misc_feature: Encodes the peptide sequence at SEQ ID NO. 17802
  misc_feature (512)..(512): n is a, c, t, g, unknown, or other
  misc_feature (529)..(529): n is a, c, t, g, unknown, or other
  misc_feature (530)..(530): n is a, c, t, g, unknown, or other
  misc_feature (555)..(555): n is a, c, t, g, unknown, or other
  misc_feature (598)..(598): n is a, c, t, g, unknown, or other
  misc_feature (705)..(705): n is a, c, t, g, unknown, or other
tccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtgacgccgctcctggtgctcaacctcatcatgtacatcatcgtcatcggcttcgcgagctggaacctgaaccacttcatcaacgggcagaccaattaccccggcgtggccggcaacggcgcgacgttctacttcctggtgtccctcctgccccgncgtggggggcggcaccnntttgggggggggggggggggggggncccccgggggcccggctgggccccccgactgcctgccaccaangcgccgggtcgtcgcttcatcgcctgggccatcacggcgctcgcccttcggttggccgcttgaaggaagatccacatcggggaacacccggggtggggccctggccngtggtgttggagggcctttc

SEQ ID NO: 17802 - protein, 131 aa, Zea mays
  misc_feature: Ceres CLONE 1383243-F
  misc_feature (14)..(127): Pfam Name: AWPM-19 Pfam Description: AWPM-19-like family
  misc_feature (66)..(66): Xaa is any aa, unknown, or other
  misc_feature (75)..(75): Xaa is any aa, unknown, or other
  misc_feature (89)..(89): Xaa is any aa, unknown, or other
  misc_feature (125)..(125): Xaa is any aa, unknown, or other
MAGIGRNMVTPLLVLNLIMYIIVIGFASWNLNHFINGQTNYPGVAGNGATFYFLVSLLPRRGGRHXFGGGGGGGXPGGPAGPPDCLPPXRRVVASSPGPSRRSPFGWPLEGRSTSGNTRGGALAXGVGGPF

SEQ ID NO: 17803 - DNA, 677 bp, Zea mays
  misc_feature: Ceres CLONE 1383244-F
  misc_feature: Encodes the peptide sequence at SEQ ID NO. 17804
  misc_feature (411)..(411): n is a, c, t, g, unknown, or other
  misc_feature (443)..(443): n is a, c, t, g, unknown, or other
  misc_feature (531)..(531): n is a, c, t, g, unknown, or other
tccccgcggtggcggccgctctagaactagtggatcccccgggctgcaggaattcgcacgagaccattacctagaacatcctaatcgaaaagtcacccacgagcccaacaaaccactcccacccggtggctcgtcctcggacgccaagccactccgcgccccaatccggaagcgccgccgccgccgatcgaccggccgtcgacccatgctccgctcggcgctcttccgctcagcccccgggctccgccggtctccggcgacggcccacttatccaccgccgccgccgccgccgcagcgtggctctccaacggccctgcctccgccccgtctagggtgcgcctcctcatcggcggggagttcgtcgagtcgcgcgccgacgagcacgtcgacgtcaccaaccccgcgacgcnaggaggtggtgtcccggatcccgctcaccacnggccgatgagttcaaagctgccgtcgatggcgccaggacggcctttccccggctggcggaacacgcccgtcacgacgcggcagcgcgnccatgttcaagttccaggagctcatccgggctaacatggacaagcttgcagagaactcccctacggaagcaggggaagacgctaaaagaggtggggggggcgacgtgtccgcggcccaaaaagggggtggagcatggctttgtgga

SEQ ID NO: 17804 - protein, 119 aa, Zea mays
  misc_feature: Ceres CLONE 1383244-F
  misc_feature: SWISSPROT Homolog: EC 1.2.1.27 Methylmalonate-semialdehyde dehydrogenase (acylating)
  misc_feature (69)..(69): Xaa is any aa, unknown, or other
  misc_feature (80)..(80): Xaa is any aa, unknown, or other
  misc_feature (109)..(109): Xaa is any aa, unknown, or other
MLRSALFRSAPGLRRSPATAHLSTAAAAAAAWLSNGPASAPSRVRLLIGGEFVESRADEHVDVTNPATXGGGVPDPAHHXPMSSKLPSMAPGRPFPGWRNTPVTTRQRXHVQVPGAHPG

SEQ ID NO: 17805 - DNA, 672 bp, Zea mays
  misc_feature: Ceres CLONE 1383245-F
  misc_feature: Translation starting site: 168
tggagctccccgcggtggcggccgctctagaactagtggatcccccgggctgcaggaattcgcacgagaccattacctagaacatcctaatcgaaaactcttcctctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattcccccgtctctttggtcctggtctcaccaagggagggcaagttcccgaccctggttactcaccaagaatccctcgagtccaagggtgacgagactaaggcaaccgtcaagttccagctcaagaaagccctttgcatggggggcccccc

SEQ ID NO: 17806 - DNA, 807 bp, Zea mays
  misc_feature: Ceres CLONE 1383247-F
  misc_feature: Encodes the peptide sequence at SEQ ID NO. 17807
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (19)..(19): n is a, c, t, g, unknown, or other
  misc_feature (35)..(35): n is a, c, t, g, unknown, or other
  misc_feature (37)..(37): n is a, c, t, g, unknown, or other
  misc_feature (51)..(51): n is a, c, t, g, unknown, or other
  misc_feature (737)..(737): n is a, c, t, g, unknown, or other
ttttttttccnnnccccnncccccccccccccctntngggggtgggtaatntgcaaggctggggctccccgcggtggcggccgctctagaactagtggatcccccgggctgcaggaattcgcacgagaccattacctagaacatcctaatcgaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaacctcgtgaagaacagagccgccactgaggaaaccctagcgacggcggcggggctacccggtggaaattggtccccctccggcccctccatcccttgacgccagcgggcgcccaggcctggccaggaaggcccagccccccttaattcgaaaacaaggggccggatcttcttggctggcccttggggggaagcttccaaccccgaaatcaaaggggtccgaggccattggcccgggccagggcccaagtctaaaatagcaaggggaaccccagaaaaccccctttcacaaaattaaaagggaaaaaaccttctctgggaaaacaaaacccccggaaaccccggggccggcccaccaccccagggcggggtacacctggccgcccgattccgcgcatctcgcgcccctctccntccgtcccccctgcgagaggcctggggtaaaccccccaaaggggggggtcagagccggcaaacaattggg

SEQ ID NO: 17807 - protein, 105 aa, Zea mays
  misc_feature: Ceres CLONE 1383247-F
  misc_feature (4)..(4): Xaa is any aa, unknown, or other
  misc_feature (5)..(5): Xaa is any aa, unknown, or other
  misc_feature (7)..(7): Xaa is any aa, unknown, or other
  misc_feature (12)..(12): Xaa is any aa, unknown, or other
  misc_feature (13)..(13): Xaa is any aa, unknown, or other
  misc_feature (17)..(17): Xaa is any aa, unknown, or other
FFFXXPXPPPPXXGWVXCKAGAPRGGGRSRTSGSPGLQEFARDHYLEHPNRKISLFSSPRLGVHAVASACRGEASALPGARLGSSSARQLLRVNTVTPVRQYHAT

SEQ ID NO: 17808 - DNA, 667 bp, Zea mays
  misc_feature: Ceres CLONE 1383248-F
  misc_feature: Encodes the peptide sequence at SEQ ID NO. 17809
  misc_feature (435)..(435): n is a, c, t, g, unknown, or other
  misc_feature (484)..(484): n is a, c, t, g, unknown, or other
  misc_feature (578)..(578): n is a, c, t, g, unknown, or other
  misc_feature (624)..(624): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgncggcgaggacggcgacagcggcgtggacgcctacgtctcccgctccggnaggggcgagtgccggcgccagtgcctgcgcccgcacgagggccagccgtgggagacccaggagtgcatgagggcgtgccgcccgcgcggactgnccgtcgacatggagcaagagtacggtcgcggcagcgagagcgcggncaagtgccgggagaggtgcgagcgccaccacggcggggactgg

SEQ ID NO: 17809 - protein, 153 aa, Zea mays
  misc_feature: Ceres CLONE 1383248-F
  misc_feature (76)..(76): Xaa is any aa, unknown, or other
  misc_feature (124)..(124): Xaa is any aa, unknown, or other
  misc_feature (139)..(139): Xaa is any aa, unknown, or other
MGKGSVGASWWAFLLLAGVLLVVAATAGAEDGVVERDRKEDLRWCKQACEWQYGKDTPRKRECESECRERHQQADXGEDGDSGVDAYVSRSGRGECRRQCLRPHEGQPWETQECMRACRPRGLXVDMEQEYGRGSESAXKCRERCERHHGGDW

SEQ ID NO: 17810 - DNA, 731 bp, Zea mays
  misc_feature: Ceres CLONE 1383250-F
  misc_feature: Encodes the peptide sequence at SEQ ID NO. 17811
  misc_feature (548)..(548): n is a, c, t, g, unknown, or other
  misc_feature (600)..(600): n is a, c, t, g, unknown, or other
tccccgcggtggcggccgctctagaactagtggatcccccgggctgcaggaattcgcacgagaccattacctagaacatcctaatcgaaaagccctcccgctcggctcggcgaacgcgatctgttccccaacctccgcagccgcttcaccgccctccactccggctgccgaatcgacccgccccgatccagatcaggagctgagggatggacgcgaacaggcgccagagtgggatccagcagttgctggctgcggagcaggaggctcagcaaattgtgaatgcggctagagctgccaagtcagcgaggcttaggcaagcaaaagaggaggctgagcgggaaatagctgaataccgtgcccagatggagtctgagtttcagaggaaggttgcagagagcagcggcgactccggtgcaaacgtcaagcgtctcgaggaagaaacggcggcgaagattgaacaactcacccagcaggccgcaagcatctccccggatgtcattcagatgcttctgcggcatgtcaccaccgtcaagaactgaggagtgctngtcccgaactatgctcgcagacttgtaccgtcgatctatttatttttgtcangagtgagagtggtgaggaataatatgcccgcttgatccataaatcctggtcgtaactacgaataagccgcgcagctttacgcaaacgtggactagtactgtcagactaaccattggtatttggtacattgg

SEQ ID NO: 17811 - protein, 110 aa, Zea mays
  misc_feature: Ceres CLONE 1383250-F
  misc_feature (5)..(109): Pfam Name: V-ATPase_G Pfam Description: Vacuolar (H+)-ATPase G subunit
  misc_feature: SWISSPROT Homolog: EC 3.6.3.14 H(+)-transporting two-sector ATPase
MDANRRQSGIQQLLAAEQEAQQIVNAARAAKSARLRQAKEEAEREIAEYRAQMESEFQRKVAESSGDSGANVKRLEEETAAKIEQLTQQAASISPDVIQMLLRHVTTVKN

SEQ ID NO: 17812 - DNA, 723 bp, Zea mays
  misc_feature: Ceres CLONE 1383255-F
  misc_feature: Encodes the peptide sequence at SEQ ID NO. 17813
  misc_feature (470)..(470): n is a, c, t, g, unknown, or other
  misc_feature (471)..(471): n is a, c, t, g, unknown, or other
  misc_feature (489)..(489): n is a, c, t, g, unknown, or other
  misc_feature (498)..(498): n is a, c, t, g, unknown, or other
  misc_feature (511)..(511): n is a, c, t, g, unknown, or other
tccccgcggtggcggccgctctagaactagtggatcccccgggctgcaggaattcgcacgagaccattacctagaacatcctaatcgaaaaagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgnnttacggtggtggccgtgnaggcggcgnctacggcggtggncggcgccgtgatggcgtcggcgtctacggcggtgccggcgactacggtgatgccggcgtcggctaccttggttgttggcgacggctactgtcgagcaaccgtggcggcgactacgtaactccgacgggaagtgaggaaatgggcggtggggcccgggcggccagttatcctgttggtaacgtgttgttacgcaatccggaattgttgtttgt

SEQ ID NO: 17813 - protein, 113 aa, Zea mays
  misc_feature: Ceres CLONE 1383255-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (97)..(97): Xaa is any aa, unknown, or other
  misc_feature (103)..(103): Xaa is any aa, unknown, or other
  misc_feature (111)..(111): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGXLRWWPXRRRLRRWXAP

SEQ ID NO: 17814 - DNA, 709 bp, Zea mays
  misc_feature: Ceres CLONE 1383259-F
  misc_feature: Encodes the peptide sequence at SEQ ID NO. 17815
  misc_feature (683)..(683): n is a, c, t, g, unknown, or other
  misc_feature (684)..(684): n is a, c, t, g, unknown, or other
cgcggtggcggccgctctagaactagtggatcccccgggctgcaggaattcgcacgagaccattacctagaacatcctaatcgaaaaacaaacccaacttccaccagacccctaaccttttcgcagctccagcgcacagccgccgccgtttcttcatcttcttcgcagagccggcgctccatcttcggctccctcccttacttgcgctcggcacgcaggcggcgctgtggctcgggatctcagtgacggcatcaagggcttcccctcccgcctctcgccagtcgcctccggtcctccgcacaccggccggtgatctctctcctcccgcctccggtggatcgtcaacggcgcccggccccggcggctgcgtcgcgcgcgtcctgagggcagctgcaggcgctgctcgactaaggcggtcgcgccgctttgggagcggtttatgccccaaagtgaagcgtgctcttagtgccgctctttggaaccctggtaatggctactgctgttaaatggctcaaccttcagtcattctagcaactgcaagttatgatcacacaatcagattttgggaagccaagaagcggtcgctgttaccgcactattcagtatccagactctcaagttaatcgccttgagataccccctgaccagcggttcttagctgctgctggcaatctcatatccgnnctttttgacgtcactcaatagcccc

SEQ ID NO: 17815 - protein, 53 aa, Zea mays
  misc_feature: Ceres CLONE 1383259-F
  misc_feature (47)..(47): Xaa is any aa, unknown, or other
MITQSDFGKPRSGRCYRTIQYPDSQVNRLEIPPDQRFLAAAGNLISXLFDVTQ

SEQ ID NO: 17816 - DNA, 658 bp, Zea mays
  misc_feature: Ceres CLONE 1383260-F
  misc_feature: Encodes the peptide sequence at SEQ ID NO. 17817
  misc_feature (285)..(285): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (472)..(472): n is a, c, t, g, unknown, or other
  misc_feature (547)..(547): n is a, c, t, g, unknown, or other
gctctagaactagtggatcccccgggctgcaggaattcgcacgagaccattacctagaacatcctaatcgaaaaaaacgcaccgtcgtctactcgtctcccacaacacggtccactaaccctagcgacagcctcggctcgtttgatccccgcggggagctctagttccgccaagcgtgcgtaccggcgtccggatccgggaccgaagatgacggagtccctggtgcggaacaagccggggatggccagcatcaaggagatgccggtggtgcaggacgggccgccngcccggcggtttcgcgcccgtgcgcttcgcccgccggatcccccactcggggcccagcgcccacggcatcttcnnntcacactttcgtgctttcgcatatggcatgtacccaggtcggcagggggaacagggtccgccggcgctcaaagagaagaaattgctgctcgcagtgtatactggcgatgcntcagcagaggaggatgaagattgtcaagagtggaagagtgtcttgaggaggagcgagatccttgaaacgtcccanggtgggaaggtcgcaaaagcgttacactctgggaagtggtgccccggctatgtaccccccccctggggtttggaaagggcctgtttaggactgatgcatcatgtccgggga

SEQ ID NO: 17817 - protein, 90 aa, Zea mays
  misc_feature: Ceres CLONE 1383260-F
  misc_feature (53)..(53): Xaa is any aa, unknown, or other
MYPGRQGEQGPPALKEKKLLLAVYTGDASAEEDEDCQEWKSVLRRSEILETSXGGKVAKALHSGKWCPGYVPPPWGLERACLGLMHHVRG

SEQ ID NO: 17818 - DNA, 676 bp, Zea mays
  misc_feature: Ceres CLONE 1383262-F
  misc_feature: Encodes the peptide sequence at SEQ ID NO. 17819
  misc_feature (471)..(471): n is a, c, t, g, unknown, or other
  misc_feature (569)..(569): n is a, c, t, g, unknown, or other
gcggtggcggccgctctagaactagtggatcccccgggctgcaggaattcgcacgagaccattacctagaacatcctaatcgaaaaataagaaaaaaacacacacacacacacacacaaagcgcacttttcaaatcgacaaaggggaaaggttcgcttcttctcgcatcttgctttacttcgagtgccatggccgatccggcggaggagaacgttgtctcgccgccaccgacccctgcggccccagccgtgggcgcctcagactcgcccctgcagcctgttgctgacggcgcctcaacggagaaggtgtctgccccggcgccggaggtaaggtcccggggattcaggcttcttggagaggacacttccgtgcacaaatcccttgggggcggtaaaactgctgacgttctgttatggaaagacaagaaaacttctgctgttgtaataagcggcgcactggtcatcctgggtnctggtcgaagtgcttgattaccacctcctgacctgatatccatgtactgattggtgtgcttgccaccttattcctgtggtcaaagcaccacgttcatncagagagtcaccggatatccagtaggcaggtatcgaggacttggttggaatgttcccgggcatacggatgaatcaacgagggttccttggtccggaatccaagggga

SEQ ID NO: 17819 - protein, 99 aa, Zea mays
  misc_feature: Ceres CLONE 1383262-F
  misc_feature (95)..(95): Xaa is any aa, unknown, or other
MADPAEENVVSPPPTPAAPAVGASDSPLQPVADGASTEKVSAPAPEVRSRGFRLLGEDTSVHKSLGGGKTADVLLWKDKKTSAVVISGALVILGXGRSA

SEQ ID NO: 17820 - DNA, 668 bp, Zea mays
  misc_feature: Ceres CLONE 1383263-F
  misc_feature: Encodes the peptide sequence at SEQ ID NO. 17821
  misc_feature (428)..(428): n is a, c, t, g, unknown, or other
  misc_feature (525)..(525): n is a, c, t, g, unknown, or other
  misc_feature (551)..(551): n is a, c, t, g, unknown, or other
  misc_feature (589)..(589): n is a, c, t, g, unknown, or other
  misc_feature (591)..(591): n is a, c, t, g, unknown, or other
tccccgcggtggcggccgctctagaactagtggatcccccgggctgcaggaattcgcacgagaccattacctagaacatcctaatcgaaaaagcaccgctacttgtgctcccccaacgctactaccgccgctagctggttcaagtgcggcgagcggagccggagaccggtagaggaaattaagaggcgtcgatcgggcatggggtgcgacgacaagtgcgggtgcgccgtgccgtgccccggcggcaaagactgcaggtgcacgtcggggagcggcgggcagcgggagcacacgacttgcggctgcggggagcactgcgagtgcagcccgtgcacgtgtggccgggccacgatgccgtccggccgcgagaacaggagggctaactgctcctgcggggcgtcctggcactgcgcatcctgcgcctcggnctgatccatgcgcctcgccctcgtgctaccgcgctgcctagtgggagggagttgtctagtgaggctctggagacgaagcaactagcactacttctantaagggggctggtgtcatgctcgccngacgcatcacgggctgatcttgatcgggggatccgggnanaaagtttgggaattgaataaccctacccattttatggcccgcaaaaaaaaaaaaaaaaaacttatcgaaccgccccc

SEQ ID NO: 17821 - protein, 76 aa, Zea mays
  misc_feature: Ceres CLONE 1383263-F
  misc_feature (2)..(76): Pfam Name: Metallothio_PEC Pfam Description: Plant PEC family metallothionein
MGCDDKCGCAVPCPGGKDCRCTSGSGGQREHTTCGCGEHCECSPCTCGRATMPSGRENRRANCSCGASWHCASCAS

SEQ ID NO: 17822 - DNA, 715 bp, Zea mays
  misc_feature: Ceres CLONE 1383264-F
  misc_feature: Encodes the peptide sequence at SEQ ID NO. 17823
  misc_feature (394)..(394): n is a, c, t, g, unknown, or other
  misc_feature (395)..(395): n is a, c, t, g, unknown, or other
  misc_feature (446)..(446): n is a, c, t, g, unknown, or other
  misc_feature (469)..(469): n is a, c, t, g, unknown, or other
  misc_feature (474)..(474): n is a, c, t, g, unknown, or other
  misc_feature (488)..(488): n is a, c, t, g, unknown, or other
  misc_feature (573)..(573): n is a, c, t, g, unknown, or other
  misc_feature (674)..(674): n is a, c, t, g, unknown, or other
  misc_feature (675)..(675): n is a, c, t, g, unknown, or other
  misc_feature (704)..(704): n is a, c, t, g, unknown, or other
gctctagaactagtggatcccccgggctgcaggaattcgcacgagaccattacctagaacatcctaatcgaaaaatatttcgacggctcgccacctctcttctctcctcggccctcgccaatctcactccgccacgccggagcacgccgctgcggcgcgcctgcgcccgccacacacgaggggactatggacacggtggctccccgcctgagtcgctcctctacgcgatacgggcccatcagcagcagtgctgcctccttcagtgggcccgtccggaagtggcgcaaggcctgggtgcccctcaccggcaccggcaccggcaccggccgggtccgggggagggagctcacgaggagacaacaaggtggttctgtttagatggacgccggtaatnngggttgttcaggagggagggggaggcaccgacggggggcatggagctcgcntgctgcgggggcctccacatgcnagcgncgctacgtcccggntgcaggggaggcgcaaagcaccaccaaaagggcaccagcagcgagctcaacttgaacctcgagctgaaagacccagacgacgacnctgatgccgacatgagcaccgacgagccacccgatgtaaaaagatacagcgcccgtctagaagccgcttgaagcggaaagcattttagcgctgtcacctannagatgcgatcggcctgaacgtctgcctanctagggcgaat

SEQ ID NO: 17823 - protein, 63 aa, Zea mays
  misc_feature: Ceres CLONE 1383264-F
MDTVAPRLSRSSTRYGPISSSAASFSGPVRKWRKAWVPLTGTGTGTGRVRGRELTRRQQGGSV

SEQ ID NO: 17824 - DNA, 733 bp, Zea mays
  misc_feature: Ceres CLONE 1383265-F
  misc_feature: Translation starting site: 159
  misc_feature (590)..(590): n is a, c, t, g, unknown, or other
  misc_feature (658)..(658): n is a, c, t, g, unknown, or other
ccccgcggtggcggccgctctagaactagtggatcccccgggctgcaggaattcgcacgagaccattacctagaacatcctaatcgaaaaatcaaccatattattgagaccaacaagcaacatagaacgtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatctttggtgcagtcattgctacaaaccatcagggcacagcagctgcagcaactcgtgctacctgtgatcaaccaagtagctctggcaaacctttctccctactctcagcaacaacaatttcttccattcaaccaactgtctacattgaaccgtgctgcttatttgcagcaacaactattaccattcagccagctnagctactgcctactctcagcaacaacaacttcttccatttaaccaattggccgcactgaaccccgctngcttatttgcagcagcaaatactactaccatttagccagctagctgcagcaaagccgtgcttcctttctgacaca

SEQ ID NO: 17825 - DNA, 725 bp, Zea mays
  misc_feature: Ceres CLONE 1383266-F
  misc_feature: Translation starting site: 191
  misc_feature (490)..(490): n is a, c, t, g, unknown, or other
  misc_feature (494)..(494): n is a, c, t, g, unknown, or other
  misc_feature (523)..(523): n is a, c, t, g, unknown, or other
  misc_feature (568)..(568): n is a, c, t, g, unknown, or other
  misc_feature (711)..(711): n is a, c, t, g, unknown, or other
cgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtgggtggggctggccgggcccacgccggtgttcctgatcttcagccccgtgctcgtccccgccgcgctggctcatcggacggncggntcatggggtccctcacgtcggacgcgctnggggggctcgggggcctgtccctcgctcacgtgcctcggcaaacnggaggcggaaggcggtccagcgcacccgggacttaccgtgaaggaggcgcaacgcaagaaatggcgaagcccgcggcgcacgcggaccacaatgaccgcgcaaggcaggccaggccctcacggctggggcgccaggaggccgntttcccggggaaaa

SEQ ID NO: 17826 - DNA, 691 bp, Zea mays
  misc_feature: Ceres CLONE 1383267-F
  misc_feature: Encodes the peptide sequence at SEQ ID NO. 17827
  misc_feature (566)..(566): n is a, c, t, g, unknown, or other
  misc_feature (614)..(614): n is a, c, t, g, unknown, or other
agtggatcccccgggctgcaggaattcgcacgagaccattacctagaacatcctaatcgaaaaattgagtctaagacgtcgtctgcgtttggtaccaaaatatttgtgtgttaattcgctcccttcaaaactcaaaatgaagttccagtacaaggaagagcacgcgtttgagaagaggaagagcgagggcgagaagatcaggaggaaataccccgacagagtgcctgtcattgtagagaaggcacctaaagcaaggattggggatcttgacaagaagaaatatttagtgccgtctgacttgactgttggtcagttctacttcttgatccgcaagcgtatccatcttcgacctgaggatgcccttttcttcctcgtaaacagtgtagttccacccagcagtgccaccatgggttcactctatcaggagcaccatgaagaggactttttcttgtacattgcttacagtgatgagaatgtttatggaaaattataacttaaacacctaaactacagccaggaatttcgaagcagaatcaacaaaatgaaaaaatcaacaaaaagcttanaacctacttagaaaccttacaaaaaaaaattaaaaaccctctgaggcnatctgctttttagaatgatcttattttaattgggaggagggtttatcttcctctttgaccttgggaacaaggggttg

SEQ ID NO: 17827 - protein, 118 aa, Zea mays; identical to SEQ ID NO: 12523
  misc_feature: Ceres CLONE 1383267-F
  misc_feature (13)..(116): Pfam Name: MAP1_LC3 Pfam Description: Microtubule associated protein 1A/1B, light chain 3

SEQ ID NO: 17828 - DNA, 669 bp, Zea mays
  misc_feature: Ceres CLONE 1383273-F
  misc_feature: Translation starting site: 183
  misc_feature (451)..(451): n is a, c, t, g, unknown, or other
  misc_feature (464)..(464): n is a, c, t, g, unknown, or other
tccccgcggtggcggccgctctagaactagtggatcccccgggctgcaggaattcgcacgagaccattacctagaacatcctaatcgaaaaatcgcactcgtagtcgtagctcaagcatcagcggcaggagctctgggcagcgtgcgcacgtggggtacctagctcgctctgctagcctaccatggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctgggtgccggccgccatcgcgctgncgctcatggcggncgggttcgtcacctccggcggcctcggcgtcgctgcgctgtccgtgttctcctggatgtacagtacctgacgggcaagcacccgccggcgccgaccagctggacacgccaaggcgaggctggcgtccaggcccgccgacatcaagatgcaggacagcacgcatcgacagggggcaggggtcttgaaagaagaaccacactcgagg

SEQ ID NO: 17829 - DNA, 702 bp, Zea mays
  misc_feature: Ceres CLONE 1383276-F
  misc_feature: Translation starting site: 181
  misc_feature (422)..(422): n is a, c, t, g, unknown, or other
  misc_feature (423)..(423): n is a, c, t, g, unknown, or other
  misc_feature (440)..(440): n is a, c, t, g, unknown, or other
  misc_feature (493)..(493): n is a, c, t, g, unknown, or other
  misc_feature (540)..(540): n is a, c, t, g, unknown, or other
tccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaaccttcggcgggtcgatgctggtgctgtccgggctgatcctggccggcaccgtgatcgcgctcacggtggccacccccgtgctggtgatcttcagcgggnntttggggggggggccgncccccattcgcgttggggctccatgggcggcccgggtttcgtcaccctccgcnggcctcggcggccgctggcgctggtccgtggtcctcctgggatgtancaggaccctgacggggcaagcaccccgccggggcgccgaccaggctggaccacgccaaaggcgaggcttggcgtcccaagccccgcgacatccagggatggcagcacagcacccgcatcgacaagggggcagggggtctttgagagaaagaaccacactcgg

SEQ ID NO: 17830 - DNA, 739 bp, Zea mays
  misc_feature: Ceres CLONE 1383280-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (12)..(12): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (23)..(23): n is a, c, t, g, unknown, or other
  misc_feature (24)..(24): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (739)..(739): n is a, c, t, g, unknown, or other
nnnaaacccccncccnnnncccnncaccccggcgcnnttcgannnnnnnaaaagctggagctccccgcggtggcggccgctctagaactagtggatcccccgggctgcaggaattcgcacgagaccattacctagaacatcctaatgcgaaaagtattaagaaaaagatttgaacatgagtgagcatcatcattttgcgtttgtgcacggtgcagggcatggaggatggtgttggtacaagctcgccaattcactgagagagaatggacataaggccacctgcatcgacctccaggggcgctgggatcaaacctaaactgatcccaaacactgggcctccctctccctggaaggactaacaaaccaaggccttctcccatgggagctttccccccccccccccacaaacttttcccccccctccgggggaagaaaaaaaagggggggcccccctctcccccggcggggataggggaaaccccacccacccccttctttaaaaaaaagggaaaaaaaaaaataaacactcttctcccccggtgggcgccgcatattttctctcttccaaaaagagcacccccgggggggggggggtataaacgccgccccgccaaaaaccccggcggtgggagcaaaaacgcggggggggaacacaaataaataactcccccccgccctctttcgttgggggggggggggggggggccagcgaaaagaggggttgggtgtgggcgggggn

SEQ ID NO: 17831 - DNA, 735 bp, Zea mays
  misc_feature: Ceres CLONE 1383281-F
  misc_feature: Translation starting site: 165
  misc_feature (477)..(477): n is a, c, t, g, unknown, or other
aagctggagctccccgcggtggcggccgctctagaactagtggatcccccgggctgcaggaattcgcacgagaccattacctagaacatcctaatcgaaaaacccccaggccccagccccccattcctgcctcttctctctctcgcccacccgccccggccccaatgtcgccgcccctcgagccccacgactacatcggcctctccgccgccgccgcggcgccgccgaccccgacctcctcctcgtcgtcctcgtcctcgccggcgccccgcctcaccctccgcctcggcctgccgggctccgagtcccccgaccgcgaccgcgaccgctgcgaggacgtcgccgccgcgctctccctcggcccgctgcctgctacccccaaggcgcccgctggcgtctccgccaagcgcgcctttccggacccggcccagcgccccggcgctgccaagctagcgacgacaggcaaggctcccccgncgcgccgccgggcggcaaggggcaggtggggggatggccgcccgtgcggaactaccggaaaaaaaccctcgccgcgagcgcctcaaggaacaagggcccggcgccggggaagaaagacgccgcgtttgcggcccgggccatgtacgtgaaagggaaacattggatggccccccctaccctccggagggggggattccaaaaaggacccccggtcaacaaggaccctccccgggggggcttcaaaaaaaatgttcccct

SEQ ID NO: 17832 - DNA, 688 bp, Zea mays
  misc_feature: Ceres CLONE 1383283-F
  misc_feature: Encodes the peptide sequence at SEQ ID NO. 17833
  misc_feature (351)..(351): n is a, c, t, g, unknown, or other
tccccgcggtggcggccgctctagaactagtggatcccccgggctgcaggaattcgcacgagaccattacctaaaacatcctaatcgaaaaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggaggccgtccggatttgatgccttcgcgtctttcgccggaaggtcttcgtggatgaggcgattggaggcgaatatggggaagggcttcaaaacatttcgaatggatggaccactcaaggntgatgtggattatctgaatgaaaaattgcaagagtgcttccctcaaaggataaggcatgctatgaagccgggatgaggcgtttggtctatttttttcgggggaccatgtaattgctgatacaaactcccctaaagttaaatgctgtgaaacactttgctttggaggaaggtagggatatccccaagtggtgctcatgtcccggaggaccattatacagtggggctcgctgaccatgttcttaaaaaaggtttttgaacttggccaaaaagagaaaataaaatggaaaaaattgagggcccccccttaaaaaggttgtactaccgagaaacctgttta

SEQ ID NO: 17833 - protein, 111 aa, Zea mays
  misc_feature: Ceres CLONE 1383283-F
  misc_feature (87)..(87): Xaa is any aa, unknown, or other
MESCSFRAATAPSPFPSAPSSSSSPRAPCPILRFPRPRKGRQIGVRRRPSGFDAFASFAGRSSWMRRLEANMGKGFKTFRMDGPLKXDVDYLNEKLQECFPQRIRHAMKPG

SEQ ID NO: 17834 - DNA, 695 bp, Zea mays
  misc_feature: Ceres CLONE 1383284-F
  misc_feature: Encodes the peptide sequence at SEQ ID NO. 17835
tacccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgcccgcgcggggaaggatgccaaacaggctcctaaggatttccttcaaatcattgattttgacaagatacaataatgaagattcttaatcgagccatcgaggttaagggattgataaaggtctggagaaaagagcttcccaaccggttcaaaggggaaaccatgggcccatgattttttgccaagcccatccaaggaaggaacccgtgttttccattttgaagacggggaattcctttttttaccttgagtggggccatggctaattttaattttgggggaccccagcaa

SEQ ID NO: 17835 - protein, 82 aa, Zea mays
  misc_feature: Ceres CLONE 1383284-F
MTPAAAISGSSSHVVVSSARLRQPFTLPPRTACPIAAAASPVTRRGVAVAAVSSPVVSARAGKDAKQAPKDFLQIIDFDKIQ

SEQ ID NO: 17836 - DNA, 735 bp, Zea mays
  misc_feature: Ceres CLONE 1383286-F
  misc_feature: Encodes the peptide sequence at SEQ ID NO. 17837
  misc_feature (536)..(536): n is a, c, t, g, unknown, or other
  misc_feature (547)..(547): n is a, c, t, g, unknown, or other
ggagctccccgcggtggcggccgctctagaactagtggatcccccgggctgcaggaattcgcacgagaccattacctagaacatcctaatcgaaaaatcgtgtcgtttcttccctttcccgtttcccccgttcagttcagcttcggttggctcgccgtactcgggttgttcctcgcctcgcttcgcttccttcctccgcagtcctcgtctcgaattcgctcgcggtgggagaaatcggggcgcgaggatgaccgtgatcgacatcctcacccgggtggacgcgatctgccagaagtacgacaagtacgacgtcgacaagctcaacggcgccaacgtcgccggcgacgacccgttcgcccgcctctacgcgtccgtcgacgcggacatcaaccaatgcgtcgataaagcggaaacggcgaagcaagagaagaaccgggccgcggtggtggcgcttaacgccgagatccggcgcaccaaggccaagctcctcgaggaggacttttccaagctgcagcgcctcgccgttaaagaaggtngaagggctgancagagagaaattgcgacccgtagtgatctggttgccgcttttactgacagaatacaatcatcccagatggtagttctactggccacaagaaaaatgaaggtggggagcctcaggatctcgcactggaggaagcataagttcgactctactgctgatggaaactttgatgatgagtactttaaggggaa

SEQ ID NO: 17837 - protein, 162 aa, Zea mays
  misc_feature: Ceres CLONE 1383286-F
  misc_feature (97)..(97): Xaa is any aa, unknown, or other
  misc_feature (100)..(100): Xaa is any aa, unknown, or other
MTVIDILTRVDAICQKYDKYDVDKLNGANVAGDDPFARLYASVDADINQCVDKAETAKQEKNRAAVVALNAEIRRTKAKLLEEDFSKLQRLAVKEGXRAXQREIATRSDLVAAFTDRIQSSQMVVLLATRKMKVGSLRISHWRKHKFDSTADGNFDDEYFKG

SEQ ID NO: 17838 - DNA, 679 bp, Zea mays
  misc_feature: Ceres CLONE 1383287-F
  misc_feature: Encodes the peptide sequence at SEQ ID NO. 17839
  misc_feature (386)..(386): n is a, c, t, g, unknown, or other
  misc_feature (415)..(415): n is a, c, t, g, unknown, or other
  misc_feature (447)..(447): n is a, c, t, g, unknown, or other
aagctggagctccccgcggtggcggccgctctagaactagtggatcccccgggctgcaggaattcgcacgagaccattacctagaacatcctaatcgaaaaataatttcccctcattcatctcacagtcccaggcctcccctccctcctccccgtcgccaaccaacctccaacccccagccgatcgcgtcggagatgctgggcgtcgcgcggaggcggctcggatccggatgcgtgctcgcccagctggcgcaggccctccgccccgccgccgctcccgccaggacctactccgccgcggccaaggagataactgtacgggaagcattgataccgcattagatgaagaatgtcgcagaccctctgttttctgatgggagaagaggntgcgagtaccaggtgcatacagatatccnaggggttgcttgacagtatggccccgataggntctcgatactccgacactgaggcggcttcattggcattggggtggggccgttaccatggcctcgacctatgggaaaggtcggacttttactttttcagggcgggaattggtcccttaataaatccgtgggccagcaaaaaaaatggcgggggggaaaaaaccgggccaatgggcctaaggggcccaaaggggtgtttccttggaaattgggccccaacctcccgggggttgg

SEQ ID NO: 17839 - protein, 48 aa, Zea mays
  misc_feature: Ceres CLONE 1383287-F
MLGVARRRLGSGCVLAQLAQALRPAAAPARTYSAAAKEITVREALIPH

SEQ ID NO: 17840 - DNA, 845 bp, Zea mays
  misc_feature: Ceres CLONE 1383290-F
  misc_feature: Encodes the peptide sequence at SEQ ID NO. 17841
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (47)..(47): n is a, c, t, g, unknown, or other
  misc_feature (444)..(444): n is a, c, t, g, unknown, or other
nnnnnnnnnnnnnnnnnnnncccgggcccgggttttgcgcggggtgntacaaaccggggctccccgcggtggcggccgctctagaactagtggatcccccgggctgcaggaattcgcacgagaccattacctagaacatcctaatagaaaaacactgatggccccgccagatccaagccgcgacccagacggcaagatagagcgagcgacctctcgattctccccatcccgccgtgcttcccgtcttcaccaaatccttcgccacgatggcgcgcctgctcatccccctccccttcgccgccgcctctgcctcatcgctccacctcgccgtctcccgccttcctctcgccgcggtctccgccgcgcgtcccgagtgtctcttttgcggaagggtggtaggagggaggggtgagggccccccccaaggcttttctaggcgcgggnttgtgcccccgccgcaaaaggctgggcgacttcgggccgtcacgggggggaggcccattggaaatggggccaaaaaagggaccaggagggcccccttggctcccaccttccgtcctaacccggggtcggggggaaccctccgaccaaggacggattcaaagttccttacccccgggagctggccctgggggccattgaaaacctggtttgaaggaaaaaagagggacaatttcccccggagaggggagggggaccccccatgtgcccttttccctggggggtaccgcgggccttgaaaggaatcccccatttttttgggtgggggagacctccccgttaacaaattattgggggggggggaaaagtataataaacaccccggggaacttgggttttttggg

SEQ ID NO: 17841 - protein, 157 aa, Zea mays
  misc_feature: Ceres CLONE 1383290-F
  misc_feature (60)..(60): Xaa is any aa, unknown, or other
MARLLIPLPFAAASASSLHLAVSRLPLAAVSAARPECLFCGRVVGGRGEGPPQGFSRRGXVPPPQKAGRLRAVTGGRPIGNGAKKGTRRAPLAPTFRPNPGSGGTLRPRTDSKFLTPGSWPWGPLKTWFEGKKRDNFPRRGEGDPPCALFPGGYRGP

SEQ ID NO: 17842 - DNA, 695 bp, Zea mays
  misc_feature: Ceres CLONE 1383291-F
  misc_feature: Translation starting site: 221
  misc_feature (362)..(362): n is a, c, t, g, unknown, or other
  misc_feature (379)..(379): n is a, c, t, g, unknown, or other
  misc_feature (395)..(395): n is a, c, t, g, unknown, or other
  misc_feature (411)..(411): n is a, c, t, g, unknown, or other
  misc_feature (528)..(528): n is a, c, t, g, unknown, or other
tcaccgcggtggcggccgctctagaactagtggatcccccgggctgcaggaattcgcacgagaccattacctagaacatcctaatcgaaaactctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcagaggcgacacgctggtgctcgntcacgccccgcgcccgngcccggtctaacgcgncatggacagcgcaggntacatgatgacctcggacgtgctggcaagcgtcaagaagcacgccaacgcggtctccgcggcggcggtcaacaaggcaagggggtctggcgggaccaccgaacgttaagtggaaacnatgggggaaaagcgggacccgcggaagtttttttgggaaccgccaaaaaatgcccggaacctgttccattgaacaacaatggtatcgtttatccaaaggggttttttgggaagttaaaaaccatggggggaaaaattgaaagcccggtccctttttgaaaagcccaa

SEQ ID NO: 17843 - DNA, 688 bp, Zea mays
  misc_feature: Ceres CLONE 1383293-F
  misc_feature: Encodes the peptide sequence at SEQ ID NO. 17844
  misc_feature (592)..(592): n is a, c, t, g, unknown, or other
  misc_feature (683)..(683): n is a, c, t, g, unknown, or other
ggagctccccgcggtggcggccgctctagaactagtggatcccccgggctgcaggaattcgcacgagaccattacctagaacatcctaatcgaaaaaccaacaggaaaaaaggcccagaggcggtgccgtgaccgattcgagacgcaagagaaggatcgagacgaggcggcggttttccgggggcagcatcggcgcggccacgaaagatgtcttactcaagaggctcaaggtatggatctcgctcgccttactcgagaagcacaaggtaccgaagtcgctctaggagtgtcgactctagtgatgctgaaaaccctgggaacaacctgtatgtgactggtttgtcagctcgtgtaacggatcgagatctggagaagcacttctccactgagggtgaggtgattgatgcaagcgttgtatatgatccttggacagggaatcacggggtttttggttttgttaccatggctgctgttaaagatgcagatcgctgcatcaaatatctgggaccgtctggtgttggcaggtcgggtcatacctggtgagaaagattttgttgcagcaccaggggtagatggtgggtagctgctctgncacaaactgatacaacctagcaccaaacatgccaactcaggccaaaggggtggatggcctacattggcaagagaagacgagtagaacccanccacc

SEQ ID NO: 17844 - protein, 111 aa, Zea mays
  misc_feature: Ceres CLONE 1383293-F
  misc_feature (40)..(110): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSYSRGSRYGSRSPYSRSTRYRSRSRSVDSSDAENPGNNLYVTGLSARVTDRDLEKHFSTEGEVIDASVVYDPWTGNHGVFGFVTMAAVKDADRCIKYLGPSGVGRSGHTW

SEQ ID NO: 17845 - DNA, 740 bp, Zea mays
  misc_feature: Ceres CLONE 1383296-F
  misc_feature (352)..(352): n is a, c, t, g, unknown, or other
  misc_feature (728)..(728): n is a, c, t, g, unknown, or other
  misc_feature (730)..(730): n is a, c, t, g, unknown, or other
tccccgcggtggcggccgctctagaactagtggatcccccgggctgcaggaattcgcacgagaccattacctagaacatcctaatcgaaaacctcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgtaagaatttatcgattctgcttctgcttgttattttttatctacaaatcanaataataaaaaaaataataaaaactagtactacgcaatccagctttctccttataaagaaatcaatggataaatttaaaaaaagcagagcatcaaaccaagaagaaaaactgatgtcacgaacttgacagttgacttttcgcgcaaacaaacaaacaaacactacgtactgtgctctgcttatggatacatacatgcatactagtagctcatatatgcgtacaatgggcgccccgcaggccccacttcgtgggcatctgggaagaagcgtgcggtggagcagtactccgccgatcccgtacgtggcgacgctgctgaactgcatgatgtggggtgctgtacgggctgccgctggtgccccgcacaagcatgctggntntgaccatcac

SEQ ID NO: 17846 - DNA, 676 bp, Zea mays
  misc_feature: Ceres CLONE 1383297-F
  misc_feature: Encodes the peptide sequence at SEQ ID NO. 17847
  misc_feature (274)..(274): n is a, c, t, g, unknown, or other
  misc_feature (343)..(343): n is a, c, t, g, unknown, or other
  misc_feature (367)..(367): n is a, c, t, g, unknown, or other
  misc_feature (384)..(384): n is a, c, t, g, unknown, or other
  misc_feature (416)..(416): n is a, c, t, g, unknown, or other
  misc_feature (441)..(441): n is a, c, t, g, unknown, or other
ggagctccccgcggtggcggccgctctagaatagtggatcccccgggctgcaggaattcgcacgagaccattacctagaacatcctaatcgaaaactctcctttaaagcggactgctctcctcaattgtcagtcagtagcatccaattgattgttctatcctcttctctgttctcacccccttgcaagcaacaatcgttcaccgatcgatccagtgcgtcctgcatggaaactgccgccgtcgcccgcgccggtgccgggcgccgcatcatggntgccgtgaacgaaggcgaagagaagctgcacgcgctcaactggtgcctcgccaacgtcgtctccccggnaggaggcgacacgctggtgctcgntcacgcccggcgcccgngccgggtttacgcccgcatggacagcgcaggntacatgatgaccctcgacgtgctgncgagcgtcaagagcacgccaacgcggtctcggcgggggcggtcgacaggccaagcgcgtctgcgcgaaccaccgcacgtcaaggtggagaccatggtgaagagcggggaccccgggggacgtatctgcgacgccgccacaagaatggcgcggacctgctcgtcatgaacaaccatggttacggctccatcccagagggcggttcttggggaagggtcaacaaaccactgggcgaa

SEQ ID NO: 17847 - protein, 112 aa, Zea mays
  misc_feature: Ceres CLONE 1383297-F
  misc_feature (2)..(2): Xaa is any aa, unknown, or other
  misc_feature (25)..(25): Xaa is any aa, unknown, or other
  misc_feature (33)..(33): Xaa is any aa, unknown, or other
  misc_feature (39)..(39): Xaa is any aa, unknown, or other
  misc_feature (58)..(58): Xaa is any aa, unknown, or other
MXAVNEGEEKLHALNWCLANVVSPXGGDTLVLXHARRPXRVYARMDSAGYMMTLDVLXSVKSTPTRSRRGRSTGQARLREPPHVKVETMVKSGDPGGRICDAATRMARTCSS

SEQ ID NO: 17848 - DNA, 717 bp, Zea mays
  misc_feature: Ceres CLONE 1383298-F
  misc_feature: Translation starting site: 292
  misc_feature: Pfam Name: Thymidylate_kin Pfam Description: Thymidylate kinase
  misc_feature: SWISSPROT Homolog: EC 2.7.4.9 dTMP kinase
  misc_feature (422)..(422): n is a, c, t, g, unknown, or other
  misc_feature (448)..(448): n is a, c, t, g, unknown, or other
  misc_feature (467)..(467): n is a, c, t, g, unknown, or other
  misc_feature (477)..(477): n is a, c, t, g, unknown, or other
  misc_feature (483)..(483): n is a, c, t, g, unknown, or other
  misc_feature (484)..(484): n is a, c, t, g, unknown, or other
  misc_feature (504)..(504): n is a, c, t, g, unknown, or other
  misc_feature (529)..(529): n is a, c, t, g, unknown, or other
  misc_feature (550)..(550): n is a, c, t, g, unknown, or other
  misc_feature (553)..(553): n is a, c, t, g, unknown, or other
  misc_feature (656)..(656): n is a, c, t, g, unknown, or other
tggagctccccgcggtggcggccgctctagaactagtggatcccccgggctgcaggaattcgcacgagaccattacctagaacatcctaatcgaaaagaaaactaggaaccccactccccctcccgaaactaccgccgccgccgctgccgccgcgatccaggtctcccgcggtcccgccccgcctgagctctcgacctcttcactcctcgccgccgctgctcgccctcccgcgtatcctcgtctcagctctcaggttttcagcctgatcaaaccggtgtaaccagccgtgcatgactgcattggttcggctcgccggaagagcagcttcgcggagcagggtcggcatagcggcggcggcggcaccctctcctgtcggcttgtccgtgcagcgccggagggcgttccagggcgtgagaatggnagacgggggcagcaagggcgccgtgncgctctggtggtcctgaangcctggaccngagcgnnaaaacttcgcagtgtgcccngctgctgtccttccctcaaggcaanggctacatggcgaaagatggnagntccccgataggccaccagtgtgggggagatgatatctggctacctcgctaacgattcgcagcttgatgacaggacgattcatctgctctttcagcgcaaccgntgggagaaagagctttgatggagagcaagctacttagtggaactactctcattgtagacgt

SEQ ID NO: 17849 - DNA, 690 bp, Zea mays
  misc_feature: Ceres CLONE 1383300-F
  misc_feature: Encodes the peptide sequence at SEQ ID NO. 17850
  misc_feature (433)..(433): n is a, c, t, g, unknown, or other
  misc_feature (483)..(483): n is a, c, t, g, unknown, or other
  misc_feature (516)..(516): n is a, c, t, g, unknown, or other
  misc_feature (525)..(525): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaaacaaccatttcttcttcctttttctatatcgcgttacgtccctacccagcgatctaggccgccgcctctcctactgcatctccctcgctctcgtcgcctcgttcgcttcgcctccgccccgccccgccccgagcagagcgcagccctatccggagctgggatggcggacgcgaagcagcagcagcagcagcagcagcagcagccacagcaggcggcagcggcagccaccggcgtgtggaagacggtcaagcccttcgttaacggcggggcctctgggatgctcgcgacctgcgtcatccagcctatcgacatggtcaaggtgaggatccangttgggtgagggctctgctggtcaggtcacaaggaactgcttgcaaatgnagggtgtccgttctttcttacagggtttgtccngccggattngctgaggcagcgacgtacacgactgcttcgtcttggatncctttagggttctaactaacaaagcagttgaaaagaatgaagggaaagcattgcctctatttcagaaagcttttattggtctgactgctggtgcatttgtgcttgggggtgggaacccctgctgat

SEQ ID NO: 17850 - protein, 59 aa, Zea mays
  misc_feature: Ceres CLONE 1383300-F
  misc_feature (57)..(57): Xaa is any aa, unknown, or other
MADAKQQQQQQQQQPQQAAAAATGVWKTVKPFVNGGASGMLATCVIQPIDMVKVRIXVG

SEQ ID NO: 17851 - DNA, 701 bp, Zea mays
  misc_feature: Ceres CLONE 1383302-F
  misc_feature: Translation starting site: 253
ggagctcaccgcggtggcggccgctctagaactagtggatcccccgggctgcaggaattcgcacgagaccattacctagaacatcctaatcgaaaaaaaaaaaactccaaaaacgcaacacatcgcgtcgcgattcgcgagggctccccccaaccccatcaagtctggccaggtctctcccatatcgggttctcccttcctcttcctgtttccgcgcgcgagatcgccgccccgggtgggctctagatcccgatggcctcgcgccgccgcaccctgctcaaggtcatcatcctcggcgacagcggggttgggaagacgtctttgatgaaccaatatgtgaacaagaagttcagcaaccagtacaaggctacgattggggcggatttcctcaccaaggaggtgcagttcgaggacaggctcttcactctgcaaatatgggacactgctggtcaggaaaggttcagagtcttggcgttgcattctaccggggagcagattgttgtgtcctagtctatgatggtaattctatgaaatcgtttgataatcttcacaactggcgtgaagagtttctaattcaggcgagcccatcagatcctggacatttccctttttgttctggtgggtaacaaagttgatgtagatgttgggaaacagccgtgtggtgtccgagaaaaaggcaaaggcatggtgcgcctctaagg

SEQ ID NO: 17852 - DNA, 701 bp, Zea mays
  misc_feature: Ceres CLONE 1383305-F
  misc_feature: Encodes the peptide sequence at SEQ ID NO. 17853
  misc_feature (505)..(505): n is a, c, t, g, unknown, or other
  misc_feature (513)..(513): n is a, c, t, g, unknown, or other
  misc_feature (521)..(521): n is a, c, t, g, unknown, or other
  misc_feature (628)..(628): n is a, c, t, g, unknown, or other
  misc_feature (629)..(629): n is a, c, t, g, unknown, or other
  misc_feature (681)..(681): n is a, c, t, g, unknown, or other
  misc_feature (701)..(701): n is a, c, t, g, unknown, or other
tccccgcggtggcggccgctctagaactagtggatcccccgggctgcaggaattcgcacgagaccattacctagaacatcctaatcgaaaagcactcaagccctgcccatcagcacaaccaccaccaccaccgcctggccgtaacgtcacacgctcgcctccttccatggcgcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggcaagaccaacttccccgtcgcgttcgccgcgcttccgccgccgccgccgcccaagaagccggccgccgtgaccgtgagccccagcagcagcagcaccgtggagtcctcctcctcctccntccgggantcgcccgncacgccgcccaggcccgcgtctccgtcccagcaggccccgtcgctcgacctcagcctaaggcgcacacccggcatggtggccgcccagccgttcctcttccctgacnncgagctcgcgtgaccgtgccgtgccggcgcccgtgcctaccggccgacgcgntcgccgcggtgccaaaagan

SEQ ID NO: 17853 - protein, 96 aa, Zea mays
  misc_feature: Ceres CLONE 1383305-F
  misc_feature (21)..(72): Pfam Name: AP2 Pfam Description: AP2 domain
MAPRNALPAASAVANGMVMEPRFRGVRKRPWGRFAAEIRDPARKARVWLGTFDTAEAAARAYDAAALHFRGPKARPTSPSRSPRFRRRRRPRSRPP

SEQ ID NO: 17854 - DNA, 766 bp, Zea mays
  misc_feature: Ceres CLONE 1383306-F
  misc_feature: Encodes the peptide sequence at SEQ ID NO. 17855
  misc_feature (292)..(292): n is a, c, t, g, unknown, or other
  misc_feature (299)..(299): n is a, c, t, g, unknown, or other
  misc_feature (525)..(525): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgtgcgcccgatggntgagcangtgaagggcatgctccacgaacaggggccgacggcgtcccaagcgctgacggtggcgaccctgttcccgctgggcagactgctgctgttggctgccgggctggccctaacggcctcggggtggggctgaaccgggcccaccccggggttcctggatttttacccccgggtgggcccccccgggggtggcccctcgggaaagggggaaaaggggttcccaccagccngggcgcttgtggtttccggggcctttccctcctctcagggccccccccaaacagggggggtgtgggttcccccccacccccgatttccggggaggggcgccccccccaagtgggaaaagaccccgccaccagggaccaaaaactccccggaagtggggagaataaaaagggggcccccaaaacggccccccccggaagaagttttcccccacacccttgcgggggtgagggcacaccaaaa

SEQ ID NO: 17855 - protein, 75 aa, Zea mays
  misc_feature: Ceres CLONE 1383306-F
  misc_feature (31)..(31): Xaa is any aa, unknown, or other
  misc_feature (33)..(33): Xaa is any aa, unknown, or other
MADRDRSGIYGGAHATYGQQQQQGGGVRPMXEXVKGMLHEQGPTASQALTVATLFPLGRLLLLAAGLALTASGWG

SEQ ID NO: 17856 - DNA, 682 bp, Zea mays
  misc_feature: Ceres CLONE 1383309-F
  misc_feature: Encodes the peptide sequence at SEQ ID NO. 17857
  misc_feature (512)..(512): n is a, c, t, g, unknown, or other
  misc_feature (576)..(576): n is a, c, t, g, unknown, or other
  misc_feature (643)..(643): n is a, c, t, g, unknown, or other
  misc_feature (645)..(645): n is a, c, t, g, unknown, or other
  misc_feature (646)..(646): n is a, c, t, g, unknown, or other
  misc_feature (654)..(654): n is a, c, t, g, unknown, or other
  misc_feature (655)..(655): n is a, c, t, g, unknown, or other
  misc_feature (665)..(665): n is a, c, t, g, unknown, or other
ggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcngcagcgcccgcgccgtcgccatcctcagctcgtcggcctccaccagcagccgcgacagcgcggncttgtagctgtccagcgcgcgtcccacctcgggcgtcgcggctcctaagccggcccgccctgagcgncnngcgcgcgnnacgtcgaaantttccgctggcagcagc

SEQ ID NO: 17857 - protein, 108 aa, Zea mays
  misc_feature: Ceres CLONE 1383309-F
  misc_feature (72)..(72): Xaa is any aa, unknown, or other
MLLTSCRQGRGMASLSCARADGVVRSGALPAKLLLCASCCFPTAAPVADGEVQVLACRQHLHRLPRRQDLRXQRPRRRHPQLVGLHQQPRQRGLVAVQRASHLGRRGS

SEQ ID NO: 17858 - DNA, 728 bp, Zea mays
  misc_feature: Ceres CLONE 1383312-F
  misc_feature: Encodes the peptide sequence at SEQ ID NO. 17859
  misc_feature (533)..(533): n is a, c, t, g, unknown, or other
  misc_feature (603)..(603): n is a, c, t, g, unknown, or other
  misc_feature (682)..(682): n is a, c, t, g, unknown, or other
  misc_feature (728)..(728): n is a, c, t, g, unknown, or other
tccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatggtcaggcaaagatcccaggacaggagggcatnccacctgaccagcaacgtctcatctttgccggcaagcagttggaggatgggaggacccttgctgactacnacatccagaaggagagcaccctccacttggtgctgcgtcttaggggtggtatgcagatctttgtgaaacccttactggncagacatcactcttgaggtggagtcttcagataccatggaaatgcn

SEQ ID NO: 17859 - protein, 166 aa, Zea mays
  misc_feature: Ceres CLONE 1383312-F
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (112)..(112): Xaa is any aa, unknown, or other
  misc_feature (136)..(136): Xaa is any aa, unknown, or other
  misc_feature (162)..(162): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNGQAKIPGQEGXPPDQQRLIFAGKQLEDGRTLADYXIQKESTLHLVLRLRGGMQIFVKPLLXRHHS

SEQ ID NO: 17860 - DNA, 740 bp, Zea mays
  misc_feature: Ceres CLONE 1383313-F
  misc_feature: Encodes the peptide sequence at SEQ ID NO. 17861
  misc_feature (298)..(298): n is a, c, t, g, unknown, or other
  misc_feature (301)..(301): n is a, c, t, g, unknown, or other
  misc_feature (359)..(359): n is a, c, t, g, unknown, or other
ggagctccccgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactanccngagagaaaaaaaaacaaaaaataacgcgagaaagcatgagccacttcgccgccgccgncgtgaagagccccctcgccgtgggcgcgcccgccgccggcgacgccaagagcccgctctttctgcccaagccgcggcgccccgcggcgcccctgcggtgccaccagggcggcgacgccggcatggatttgctcaactcctcctgtcaagcacagtggttagggtgatgaaaaggggacccctgaaaccctatttcctgggggaaaaaaaaggggaccgacacctaagggggcgttgtaaggggaccccttgcggccaataaattggctggagggccgcaatttaaccccccccccccccattcctattccttggctaaagggctaaagggggacctcctaagtcccggagagggaaccctttatacgggcccccctttgaa

SEQ ID NO: 17861 - protein, 62 aa, Zea mays
  misc_feature: Ceres CLONE 1383313-F
  misc_feature (8)..(8): Xaa is any aa, unknown, or other
MSHFAAAXVKSPLAVGAPAAGDAKSPLFLPKPRRPAAPLRCHQGGDAGMDLLNSSCQAQWLG

SEQ ID NO: 17862 - DNA, 799 bp, Zea mays
  misc_feature: Ceres CLONE 1383315-F
  misc_feature: Encodes the peptide sequence at SEQ ID NO. 17863
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (350)..(350): n is a, c, t, g, unknown, or other
  misc_feature (421)..(421): n is a, c, t, g, unknown, or other
  misc_feature (422)..(422): n is a, c, t, g, unknown, or other
nnnnnnggggggnnnnnnnnnnggggggggggaactgnnnnngcggcccccccccaaaattggagctccccgcggtggcggccgctctagaatagtggatcccccgggctgcaggaattcgcacgagaccattacctagaacatcctaatcgaaaaaccgcgccgctctctctctctttctctctcgcacgagccgcgccggcgccgccaccacgcgcgcgggagacagagaccacagccgcagccaccgacgggcggaataggaatggtggcgccggggggaggagcaggaggaggtccgttgcggtggccggcggcggaggagcttgacactgtacggaagaaggtgntggagattattggaaagggatgaacaagaggttatggttgctgcttgcccctacagaattttgccctttgnngcctcatattgatgctgcagggtgaactaccccacagctatgaccataaattatggagtacctcccttgggttcgctccctccaagggggttctgaggggtttactttcatttcctggccaagtttggagggggttataaaaattccgaaaggtgatgcaccttggaaaagcccctaatttggataaacctgaagaaaaataaaactggggggaaggtaatggcaaaaggggggctggttaaggggcacttgcaaacataaggggaatatggaccccaagggaaagggtattccatagggataatattttccgtggggggggaaaagggtctttaaataagtccaggggcctccaggttctttcctgtgcggggggg

SEQ ID NO: 17863 - protein, 35 aa, Zea mays
  misc_feature: Ceres CLONE 1383315-F
  misc_feature (29)..(29): Xaa is any aa, unknown, or other
MVAPGGGAGGGPLRWPAAEELDTVRKKVXEIIGKG

SEQ ID NO: 17864 - DNA, 696 bp, Zea mays
  misc_feature: Ceres CLONE 1383316-F
  misc_feature: Encodes the peptide sequence at SEQ ID NO. 17865
  misc_feature (459)..(459): n is a, c, t, g, unknown, or other
  misc_feature (506)..(506): n is a, c, t, g, unknown, or other
  misc_feature (517)..(517): n is a, c, t, g, unknown, or other
  misc_feature (524)..(524): n is a, c, t, g, unknown, or other
  misc_feature (550)..(550): n is a, c, t, g, unknown, or other
  misc_feature (657)..(657): n is a, c, t, g, unknown, or other
tccccgcggtggcggccgctctagaactagtggatcccccgggctgcaggaattcgcacgagaccattacctagaacatcctaatcgaaaactaattgagcatcgcagagataggcgtcttcgtactcgcctacctccgcggctcaaacctttcccccttctcccaattccttccgccggccgccgctccacccgtacgacgacaccatgagggagtgcatttcgatccacatcggccaggccggtatccaggtcggaaacgcgtgctgggagctgtactgccttgagcatggcattcaggctgacggtcagatgcccggtgacaagaccattgggggaggtgatgatgctttcaacaccttcttcagtgagactggtgctgggaagcacgtgccccgtgctgttttttgtgaccttgaacccactgtcatcgatgaggtgagaactggcacctaccgncagctcttccaccctgagcagctcatcagtgggaaggaggatgcagnccaacactttngccgtgntcactacaccattggcaaggagattngtgaccctgtgcttgatcgcatcaggaagcttgccgacaactgcactggtctccagggcttcctcgtcttcaacgctgttggtggaggaacgggctctggccttggntccctcctcctagagcgcctgtctggtgactacggcaaa

SEQ ID NO: 17865 - protein, 163 aa, Zea mays
  misc_feature: Ceres CLONE 1383316-F
  misc_feature (49)..(162): Pfam Name: Tubulin Pfam Description: Tubulin/FtsZ family, GTPase domain
  misc_feature (100)..(100): Xaa is any aa, unknown, or other
  misc_feature (104)..(104): Xaa is any aa, unknown, or other
  misc_feature (106)..(106): Xaa is any aa, unknown, or other
  misc_feature (115)..(115): Xaa is any aa, unknown, or other
MRECISIHIGQAGIQVGNACWELYCLEHGIQADGQMPGDKTIGGGDDAFNTFFSETGAGKHVPRAVFCDLEPTVIDEVRTGTYRQLFHPEQLISGKEDAXQHFXRXHYTIGKEIXDPVLDRIRKLADNCTGLQGFLVFNAVGGGTGSGLGSLLLERLSGDYGK

SEQ ID NO: 17866 - DNA, 671 bp, Zea mays
  misc_feature: Ceres CLONE 1383317-F
  misc_feature: Translation starting site: 458
  misc_feature (331)..(331): n is a, c, t, g, unknown, or other
  misc_feature (349)..(349): n is a, c, t, g, unknown, or other
  misc_feature (422)..(422): n is a, c, t, g, unknown, or other
  misc_feature (433)..(433): n is a, c, t, g, unknown, or other
  misc_feature (434)..(434): n is a, c, t, g, unknown, or other
  misc_feature (467)..(467): n is a, c, t, g, unknown, or other
  misc_feature (516)..(516): n is a, c, t, g, unknown, or other
  misc_feature (593)..(593): n is a, c, t, g, unknown, or other
ggagctccccgcggtggcggccgctctagaatagtggatcccccgggctgcaggaattcgcacgagaccattacctagaacatcctaatcgaaaaaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctggcagccaccgccccgcggtcatctaccgccggcggtgcatctgccacctccggttcacctgccaccctccgtgcatctcccaccgncggtccacccctgcgcgncggtccacctgccaccgccggtcatgtgccggcgccggttcatctgccccgcgcacatggcactaccctactncaccgcccggnnctcagctcatccccagcacacccatgcccgtgncaaacagcgcatccaagcccgtggcagctgcagggaacctgcggcgttngcaacaccccgatcctggggcagtgcgtcgagttcctgagggatcagtgcagcccgacggggacgccctactggtcngctcaagtgcagtcgtttgcggcagcagtgtttgcaccacctcaggggagtgggagccgcaccaccggtaacaggggg

SEQ ID NO: 17867 - DNA, 723 bp, Zea mays
  misc_feature: Ceres CLONE 1383321-F
  misc_feature: Pfam Name: Utp11 Pfam Description: Utp11 protein
  misc_feature (572)..(572): n is a, c, t, g, unknown, or other
  misc_feature (608)..(608): n is a, c, t, g, unknown, or other
  misc_feature (614)..(614): n is a, c, t, g, unknown, or other
tccccgcggtggcggccgctctagaactagtggatcccccgggctgcaggaattcgcacgagaccattacctagaacatcctaatcgaaaaagatggctgagagcctgagacgggcgacgcccgcacgcccgcacaagctgctccgggctccgctgctaggctagggtttggactttggattggagccgcaccgccgcaccgccaccgcagccgccgcagtgccgcacagccgccactcccgtcttggtcttgcggccagtcgccctcgggcctcgaccatcagcccctcgcccgctcgccgagacaccgagtcggcatcgaccgtcgtcgcgtctccgaggtccagcgcctagtggcccagctccaagcctccagccatcggcgcccgccctcctccgccgagacgccgagtgccgagcgcccgagcaccccggtccccagcgcccaacaagctagcaggctgcaggtatgcgctctttgttgatgcgtccaaggagttgagctgaatgcccagaaggctagcaggctgcagaaactgaaggaaaaggcggcattcaggaacccggatgangtctattttaaaatgatcaacagtaggactggtggntggaanttcaagaccctagcctgaagataataagtatactggaagaggacttcatctggtgaaaaataaagaatgggatatatccctttagagcgtcaaagtgaaaaaggtactg

SEQ ID NO: 17868 - DNA, 672 bp, Zea mays
  misc_feature: Ceres CLONE 1383330-F
  misc_feature: Encodes the peptide sequence at SEQ ID NO. 17869
  misc_feature (336)..(336): n is a, c, t, g, unknown, or other
  misc_feature (396)..(396): n is a, c, t, g, unknown, or other
  misc_feature (400)..(400): n is a, c, t, g, unknown, or other
  misc_feature (401)..(401): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (450)..(450): n is a, c, t, g, unknown, or other
  misc_feature (474)..(474): n is a, c, t, g, unknown, or other
  misc_feature (567)..(567): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctagaacatcctaatcgaaaaaaagccgtcccttcccaaccctcccttcgatccctggggcggcggccgggaccatgacgaccggatccaacggcgacggaggcggcgcggggtcctggtacccgcagcgccgcccgcactacgggtacggcggggggtccgcctccttccgcggctgctgctgctgcctcttcctgctgctcaccttcctggcgctcctcgctctgggcgtcgcgctcgtcgtcgtgctcgtggntgagcccccgcaaacgcagttcgaccctcaccaggtgtccgtgcagtagctcctggtggnctcnncgacgacgtccccggccggggtgccccccggnnngcgctacctctcccntcacatcacgctgctctttcacgncgagaaccccccacaggtgggcatccggtacggcgccacggcgtcgacgtcatgtaacacgggtgccgctcgggggtgggcgcggggccgggnttcgaggagcccggcacaggcacccgctgctccagaaccgcgtcattgtcgancggcttcacgtgctccagaccgacgcgcaggacctcatcggggacgcgggaa

SEQ ID NO: 17869 - protein, 76 aa, Zea mays
  misc_feature: Ceres CLONE 1383330-F
  misc_feature (61)..(61): Xaa is any aa, unknown, or other
MTTGSNGDGGGAGSWYPQRRPHYGYGGGSASFRGCCCCLFLLLTFLALLALGVALVVVLVXEPPQTQFDPHQVSVQ

SEQ ID NO: 17870 - DNA, 767 bp, Zea mays
  misc_feature: Ceres CLONE 1383331-F
  misc_feature: Encodes the peptide sequence at SEQ ID NO. 17871
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (767)..(767): n is a, c, t, g, unknown, or other
nnnnnnnnnnccccnnnnaaccaaccnnnnnnnagaaaagccgcgggcggcaccccgggttccccgcggtggcggccgctctagactagtggatcccccgggctgcaggaattcgcacgagaccattacctagaacatcctaatcgaaaaatctagtcatctcgtctcaggttgcggccgaaccagagccccgtcccaactccaccacctctcttctctacggcgcgagcaagggcggcgccggccgcggcgtcggcgggaacccgggcctccgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctggttacaatgtgccccagaggtcatatcatgggatgaatgcaactgctggactctcatctgtcatgggaccatctccgtgctttgcttctggccccaaaaagaaaggcttttctggaattatgaatcgaactttatgaggggggggaggtttctggctgctggtccccaagaacaggctgcagcttccccatttgagccgcggcccagctttttttgatttccagaacccaggaatagaaatggcctcccaggaattgggcgagggcttttccctgaaaccggtcacaaagggggaatattgcggggacacgtgccttttggggccccggaaacan

SEQ ID NO: 17871 - protein, 85 aa, Zea mays
  misc_feature: Ceres CLONE 1383331-F
MADELRSTSVGQKFHGQSVLLSRISSYSAMNNPVFNNAYSGYNVPQRSYHGMNATAGLSSVMGPSPCFASGPKKKGFSGIMNRTL

SEQ ID NO: 17872 - DNA, 832 bp, Zea mays
  misc_feature: Ceres CLONE 1383333-F
  misc_feature: Encodes the peptide sequence at SEQ ID NO. 17873
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaaggaggcgggcgccccgatgggttgagcaggtggatgggcatgctccaccgacaagggggccgaagggcgtcgcaggggcttgaccgggggaggaccctgcttccctcctggagccggcttggctgcctggtggctgcccggggctgggcggctaaacggcctccgtgggtggggggctgggcccggggcacacccccggtgggttcctggatacatcaagcccccggggggtccttcccccgccccctgcttgtcccaatccggaaaagggcccgccaatggggctgtccccctcacactccggggcgaggcttggggggcctcgggagggccctggtgcccccccccctcactgtgaccctccaccaaacaccgggtggcggcgaaagggggttcccaagcggctacccctcggtaacaaaggttggggagggaaaagcgccacccactataggataagggcgagaataagcccccacgccgccacccccccgaatccccctgaaataaccggggaccaaggaccgtgctccaaccgccactctccaagagggg

SEQ ID NO: 17873 - protein, 51 aa, Zea mays
  misc_feature: Ceres CLONE 1383333-F
MADRDRSGIYGGAHATYGQQQQQGRRRAPRWVEQVDGHAPPTRGPKGVAGA

SEQ ID NO: 17874 - DNA, 612 bp, Zea mays
  misc_feature: Ceres CLONE 1383334-F
  misc_feature: Encodes the peptide sequence at SEQ ID NO. 17875
  misc_feature (329)..(329): n is a, c, t, g, unknown, or other
  misc_feature (367)..(367): n is a, c, t, g, unknown, or other
  misc_feature (419)..(419): n is a, c, t, g, unknown, or other
ggagctccccgcggtggcggccgctctagaatagtggatcccccgggctgcaggaattcgcacgagaccattacctagaacatcctaatcgaaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcatcagcggtgtcttcggtatgtgaaaacccaatccttcaccctacaggatccancaggcaatcgcagctggcatcttacctttatcaccttngttccctccacatcatcagccctattacacagttacttttggtgcattattngcacaaacatcagggaacaacactacacaacttgggctagaaaacttgctgcctactctcacaacagcagtttcttcatcaaccaaaataggtcattgaactctgcttcctatttgaaaaaaaacaattaccatttagccaggtacctgttgcctaccccaagaattccttccatttcaaccagtgggagaat

SEQ ID NO: 17875 - protein, 101 aa, Zea mays
  misc_feature: Ceres CLONE 1383334-F
  misc_feature (59)..(59): Xaa is any aa, unknown, or other
  misc_feature (72)..(72): Xaa is any aa, unknown, or other
  misc_feature (89)..(89): Xaa is any aa, unknown, or other
MAAKIFCLLMLLGLSASAATATIFPQCSQAPIASLLPPYLSSAVSSVCENPILHPTGSXRQSQLASYLYHLXSLHIISPITQLLLVHYXHKHQGTTLHNLG

SEQ ID NO: 17876 - DNA, 750 bp, Zea mays
  misc_feature: Ceres CLONE 1383337-F
  misc_feature: Translation starting site: 193
  misc_feature: Pfam Name: Allene_ox_cyc Pfam Description: Allene oxide cyclase
  misc_feature: SWISSPROT Homolog: EC 5.3.99.6 Allene-oxide cyclase
aaagctggagctccccgcggtggcggccgctctagaactagtggatcccccgggctgcaggaattcgcacgagaccattacctagaacatcctaatcgaaaaacttctagtgccacccaccaacttccccttccccgtcgcatcgcatcgagagcggggctgtaccgtgcgagactctactgctcgatcgccatggccgccgcgctcaggtgcccggcctccgtcagggtctcgggccccgccgccgcggggctcgccaaggtgcgccaggcgtccagagtcgtcgcggtgagcggggcccggcagagccgcggcggcggcgtcgccgtgcgggcgtcgctgttctcggccaagcccgcggcggccaaagacgccgcggccgacaaggtgcaggagctgtacgtgtacgaaatccacgagcgggaccgggagagccccgcgtacctgcgcctcaacgccaagcaaacgggagaacgcgctgggcgacctcctcccctccaccaaaaagtgtaccacgggagccctggaaaaggggttggggggccacggggggaatttgcgggttcatccagcactcccccgaaccggaaggggaaccgaacaaggccatttacagtttctaatttcgagaactcggccaacttccggggggagggcccggaacctgaactaagaaggagtcgtacctgggggcaaacccggggtttccgggggttttcagaggggggctaagggccaaggctatgccca

SEQ ID NO: 17877 - DNA, 739 bp, Zea mays
  misc_feature: Ceres CLONE 1383339-F
  misc_feature: Encodes the peptide sequence at SEQ ID NO. 17878
ggagctccccgcggtggcggccgctctagaactagtggatcccccgggctgcaggaattcgcacgagaccattacctagaacatcctaatcgaaaactagacgcaccccttcctcgtttcgccgcctccgccgacaccgactgcctccctcagctgccgtcgccatgggcagaaggcctgctagatgctatcgccagatcaagaacaagccataccctaagtccaggtactgccgtggtgtccctgacccgaagatcaggatatacgatgtcgggatgaagaggaagggtgttgatgagttcccctactgtgtgcaccttgtctcttgggagaaggagaatgtctccagtgaggcgcttgaggctgcccgcattgcctgcaacaagtacatgaccaagtctgcaggaaaggatgccttccaccttagggtccgggttcacccgttccatgtcctccgtatcaacaagatgctttcgtgtgctggggctgataggctccagactgggatgaggggtgcctttggcaagctcagggcacctgtgctagggtggacattggtcaggtcctccttccgtgcgatgcaggggacacatggctgcccatgcagcgaagctctgcgtcgcgcttagttcaagtccctgccccgcaaaagtcattgagagcagaaagtgggcttcaccaagtcagccgcgctgactacctgaagtacagagcgagggcagattttgtcctgatgtgt

SEQ ID NO: 17878 - protein, 154 aa, Zea mays
  misc_feature: Ceres CLONE 1383339-F
  misc_feature (5)..(153): Pfam Name: Ribosomal_L16 Pfam Description: Ribosomal protein L16
MGRRPARCYRQIKNKPYPKSRYCRGVPDPKIRIYDVGMKRKGVDEFPYCVHLVSWEKENVSSEALEAARIACNKYMTKSAGKDAFHLRVRVHPFHVLRINKMLSCAGADRLQTGMRGAFGKLRAPVLGWTLVRSSFRAMQGTHGCPCSEALRRA

SEQ ID NO: 17879 - DNA, 740 bp, Zea mays
  misc_feature: Ceres CLONE 1383341-F
  misc_feature: Encodes the peptide sequence at SEQ ID NO. 17880
  misc_feature (260)..(260): n is a, c, t, g, unknown, or other
  misc_feature (299)..(299): n is a, c, t, g, unknown, or other
  misc_feature (375)..(375): n is a, c, t, g, unknown, or other
  misc_feature (376)..(376): n is a, c, t, g, unknown, or other
  misc_feature (548)..(548): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcancagcagcagggaggagcgggccgccccatgggggagcanggtgaggggcatgctccaaaaaaaggggccaacggcgtcccaggcgctgaaagggggggaacctgtttccccctgnncggggttggtggttgggcttttcgggggttggcgcctaaacgcccccccgggggggggttggcccgggcccacccccgggggttctcgaaatttataaacccccggggtttcccccccccccgggggtgttctcttaggaaaaggcccgggagggggggtcccccccactcnggggggccggtgggggttttgggggagaatgtgtcccctcttacagggggccccgccacaaaaaggggggggagaagtgtgttccaagcccaccccccccgaaatattggggggggaagaacgcccccccaccgcagatgggggggagcgcaacgccctaccacaccccgcgcaaaaacaaaaacacgcgaa

SEQ ID NO: 17880 - protein, 180 aa, Zea mays
  misc_feature: Ceres CLONE 1383341-F
  misc_feature (20)..(20): Xaa is any aa, unknown, or other
  misc_feature (33)..(33): Xaa is any aa, unknown, or other
  misc_feature (59)..(59): Xaa is any aa, unknown, or other
MADRDRSGIYGGAHATYGQXQQQGGAGRPMGEXGEGHAPKKGANGVPGAERGGTCFPLXGVGGWAFRGLAPKRPPGGGLARAHPRGFSKFINPRGFPPPRGCSLRKRPGRGGPPHSGGPVGVLGENVSPLTGGPATKRGGRSVFQAHPPRNIGGGRTPPHRRWGGAQRPTTPRAKTKTRE

SEQ ID NO: 17881 - DNA, 673 bp, Zea mays
  misc_feature: Ceres CLONE 1383342-F
  misc_feature: Encodes the peptide sequence at SEQ ID NO. 17882
  misc_feature (492)..(492): n is a, c, t, g, unknown, or other
  misc_feature (510)..(510): n is a, c, t, g, unknown, or other
  misc_feature (603)..(603): n is a, c, t, g, unknown, or other
  misc_feature (621)..(621): n is a, c, t, g, unknown, or other
tccccgcggtggcggccgctctagaactagtggatcccccgggctgcaggaattcgcacgagaccattacctagaacatcctaatcgaaaaagatcgggtcctaggctacagcagccgccgcatccgtcaccttcacaccgcgtgcgtgctctctctccccctccccctctccgtgcgacgactgggtgggctaccgccgccctacgcaaggtgccgagaacttcgccgatatctgcgccggagaagagcgcccaccagatcaggcgcttagaaggcgcgctggccggtggatgacgatggcgggtggcgggggactgaaccggtcttcatcgagggggcagctgccgccgcaagagctgcttgacgatctctgcagccggttccttctgaatgtgcccaaggaggagctggagtcgttcgagcggatcctgttcctgctggagcaggcgcactggttctatgaggacaactccgttgagcacaaccccaancctcagtccctctccttncaggacttcacttccctcatgttcaagagctgcactgctctccggccctacatcgcgcacctggatgatatctaccaggactttcacactacnagtttcgtgtgcctgtgntccgcgcatcatcctagacgacacttatgaggagtgcttgcttgtaaaggat

SEQ ID NO: 17882 - protein, 117 aa, Zea mays
  misc_feature: Ceres CLONE 1383342-F
  misc_feature (19)..(103): Pfam Name: DCP2 Pfam Description: Dcp2, box A domain
  misc_feature (65)..(65): Xaa is any aa, unknown, or other
  misc_feature (71)..(71): Xaa is any aa, unknown, or other
  misc_feature (108)..(108): Xaa is any aa, unknown, or other
MAGGGGLNRSSSRGQLPPQELLDDLCSRFLLNVPKEELESFERILFLLEQAHWFYEDNSVEHNPXPQSLSXQDFTSLMFKSCTALRPYIAHLDDIYQDFHTTSFVCLXSAHHPRRHL

SEQ ID NO: 17883 - DNA, 675 bp, Zea mays
  misc_feature: Ceres CLONE 1383344-F
  misc_feature: Translation starting site: 103
tccccgcggtggcggccgctctagaactagtggatcccccgggctgcaggaattcgcacgagaccattacctagaacatcctaatcgaaaaattcggcgactatggcggcggcaccggcaggcggcggccctcgggcattgtcccagcgggagcaggacatccagatgatgctcgccgccgatgtccacctcggcaccaagaactgcgacttccaggtggagcgctacgtgtacaagcgccgcactgatggtatctatattattaaccttggaaagacctgggacaagcttcagttggccgccaggggtcatcgttgccattgagaatccgcaggacattatcgtgcagtctgctaggccctatgggcggagggctgtcctcaagtttgcgcagtacactggtgcccatgccattgctggcaggcacactcctggtacattcaccaaccagttgcaaacctccttcagtgaggcacggccttcttatccttactgacccgaggactgatcatcagcccattagggagtctgcgcttggaaacatcccccacatcgcattctgtgatactgactcccctatgcgctatgttgatattggcatccccgcccataaccaggggaaacagagcattgggtggctgttctgggtgctcgccccgaatgctctcccaaagg

SEQ ID NO: 17884 - DNA, 644 bp, Zea mays
  misc_feature: Ceres CLONE 1383349-F
  misc_feature: Encodes the peptide sequence at SEQ ID NO. 17885
  misc_feature (227)..(227): n is a, c, t, g, unknown, or other
  misc_feature (246)..(246): n is a, c, t, g, unknown, or other
  misc_feature (257)..(257): n is a, c, t, g, unknown, or other
  misc_feature (419)..(419): n is a, c, t, g, unknown, or other
  misc_feature (422)..(422): n is a, c, t, g, unknown, or other
ccccgcggtggcggccgctctagaatagtggatcccccgggctgcaggaattcgcacgagaccattacctagaacatcctaatcgaaaaatagcgaacaaacatcgagtacagtcggctaggtaatctggtggtacgacgacatggcggccaccagcagcaagtcgtcgtcgtcctcgagctcggcgcagcgggcagctgccgcactgctcgtggcccgccgcgtgncgttgtccgtcctggtggntggcgcgccgncgttgtgcaacctgagccaccgagcaatttcatggcgggccaaccccccggggggccaagaacaaagggacccccgccgggccgggcccgtttaaaaggggttggttttcccaccccccgtggggggggggggggggacccccccaagggggggggtggggnggngggttgtaaaaaaaaaaaagcgcccgggggggggggggggaaaaaaaaaacccccccccgggggggggggttttttcccccgggggggggcccccccccccccccccccccccgcaataagggggggggcccccccccccccccccccaaaaaaacgcccccccccccccccccttttttttatagatggggggggggtgggggcgccaacacataagaagg

SEQ ID NO: 17885 - protein, 69 aa, Zea mays
  misc_feature: Ceres CLONE 1383349-F
  misc_feature (29)..(29): Xaa is any aa, unknown, or other
  misc_feature (35)..(35): Xaa is any aa, unknown, or other
  misc_feature (39)..(39): Xaa is any aa, unknown, or other
MAATSSKSSSSSSSAQRAAAALLVARRVXLSVLVXGAPXLCNLSHRAISWRANPPGGQEQRDPRRAGPV

SEQ ID NO: 17886 - DNA, 703 bp, Zea mays
  misc_feature: Ceres CLONE 1383351-F
  misc_feature: Encodes the peptide sequence at SEQ ID NO. 17887
tggagctccccgcggtggcggccgctctagaactagtggatcccccgggctgcaggaattcgcacgagaccattacctagaacatcctaatcgaaaactctacacttcctgacccagatggcggcggcgccctgctctaccaccttctccggcgacgtgtgggcggagctgcgcctggcctccgctagcgatgtgccgcacatccaccgcctgatacaccagatggccgagttcgagctcctcaccgacctcttcgccgccaccgaagagctgctcacctccacgctcttcccctcgccgacgccgcctcccttcacctccttcacagccctcatcctcgacctatccccctccccccgtcccccccgagggggggggggcgatcgcctcccgccgcctcgacctctcccgggtcccgctcgcggaccccgaggccgccgccttcgcctccccgcggcgggaggggggcgcggcacgggccgggatcgggatctggttcccccaactactccacccttcctctccaagcccgggctcttacgtggaggacatccttcgtggggggggcccggggggccggccgggggggtcggccggggatgaggctgcccggccgccccccggcaggggggggcccgaggctcggaatggggccggggggaaagggggggctggcttcgactgggaaacaggagggcccgtc

SEQ ID NO: 17887 - protein, 34 aa, Zea mays
  misc_feature: Ceres CLONE 1383351-F
MRLPGRPPAGGGPRLGMGPGGKGGLASTGKQEGP

SEQ ID NO: 17888 - DNA, 743 bp, Zea mays
  misc_feature: Ceres CLONE 1383353-F
  misc_feature: Encodes the peptide sequence at SEQ ID NO. 17889
  misc_feature (480)..(480): n is a, c, t, g, unknown, or other
  misc_feature (536)..(536): n is a, c, t, g, unknown, or other
  misc_feature (537)..(537): n is a, c, t, g, unknown, or other
  misc_feature (572)..(572): n is a, c, t, g, unknown, or other
  misc_feature (604)..(604): n is a, c, t, g, unknown, or other
  misc_feature (695)..(695): n is a, c, t, g, unknown, or other
  misc_feature (702)..(702): n is a, c, t, g, unknown, or other
aaactggagctccccgcggtggcggccgctctagaactagtggatcccccgggctgcaggaatttgcacgagaccattacctagaacatcctaatcgaaaaattccgtcgtcgtcgtcagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggccacctcgcctactcccacaccaaccaggcgctcctccgccccaggtcgttcgcgggcaaggacgaggtgttctgcctgttcgagggggtgctggacaacctgggtcgtctgangcagcagcacgggctgtcaagcaagggcgccacgaggtgctcctcgtcatcgaggnnctacagacgctgcgcgaccgcgcgcccctaccggncagcttcatgctcgcccagctcaccggctccntacgctttcgtctcttcgacaagtccaccaactccctgctagtcgcacccgacccggagggcagggtgcgctccttctggggggatcacgncgacggntgcgtcgccttctccgacgacatcgacatgctcaaagctca

SEQ ID NO: 17889 - protein, 145 aa, Zea mays
  misc_feature: Ceres CLONE 1383353-F
  misc_feature (91)..(91): Xaa is any aa, unknown, or other
  misc_feature (110)..(110): Xaa is any aa, unknown, or other
  misc_feature (122)..(122): Xaa is any aa, unknown, or other
MLAVFSGQVVEVPAELVAAGSRTPSPKTKASQLVGRFLAASEPAVSVQLGDHGHLAYSHTNQALLRPRSFAGKDEVFCLFEGVLDNLGRLXQQHGLSSKGATRCSSSSRXYRRCATARPYRXASCSPSSPAPYAFVSSTSPPTPC

SEQ ID NO: 17890 - DNA, 746 bp, Zea mays
  misc_feature: Ceres CLONE 1383355-F
  misc_feature: Encodes the peptide sequence at SEQ ID NO. 17891
  misc_feature (305)..(305): n is a, c, t, g, unknown, or other
  misc_feature (306)..(306): n is a, c, t, g, unknown, or other
  misc_feature (401)..(401): n is a, c, t, g, unknown, or other
  misc_feature (495)..(495): n is a, c, t, g, unknown, or other
ggagctccccgcggtggcggccgctctagaactagtggatcccccgggctgcaggaattcgcacgagaccattacctagaacatcctaatcgaaaaagcaaaaggcgaagccacggtaaccgccaccaccaaatcgctaccaccaatccgccatgatgctcccgacggccaccgcgacggccgtcttcctcaccgcggcgccttcctctttctccacccgccgtcggcgcagccgcgccatcttcgcatccctttcgccgtccttctcctcctcggaggagccgctgctggtgcgcgcggcgcgnngcgaggacggcctcccacgcccgcccgcgtggatgatgcggcaggcagggcggtacatggcggagtaccaggcgctgggcaagcgccacccctcngtccgggagcgctccgagaaacacgacctcatcgtcgagatcacgctgcaggcgtgggcgtcctttcgcggccgacggggtcatcctggtctcngaaatactcacgcccctggcggccatcggggtggcgttcgatatctcggactcaagggggccgtgattcaatcgccaggggggccaaaaaacaggggaggcaagtcggccccatccaccttgaatggccccagttccccggggaaccctgaaaatccgggaaagggaatttgaggaaaaccgcttttcaaaaaatttgggggcccccatggaaaattgacatttaattggtgaaaggggggaaacaccccc

SEQ ID NO: 17891 - protein, 109 aa, Zea mays
  misc_feature: Ceres CLONE 1383355-F
  misc_feature: SWISSPROT Homolog: EC 4.1.1.37 Uroporphyrinogen decarboxylase
  misc_feature (53)..(53): Xaa is any aa, unknown, or other
MMRQAGRYMAEYQALGKRHPSVRERSEKHDLIVEITLQAWASFRGRRGHPGLXNTHAPGGHRGGVRYLGLKGAVIQSPGGPKNRGGKSAPSTLNGPSSPGNPENPGKGI

SEQ ID NO: 17892 - DNA, 708 bp, Zea mays
  misc_feature: Ceres CLONE 1383356-F
cgcggtggcggccgctctagaactagtggatcccccgggctgcaggaattcgcacgagaccattacctagaacatcctaatcgaaaagattatataaaattaatgatgcacgcggcagcatgtgcagcgcacatacaaaaccctggatcagccagcgttccattccaacgacagcacagcagagcaagagcgcaccagcacgacacagccaagctccactccaccgacacgctgtgctcgagcccgcccgcgagatccatggcgcgcatgcatagcgacggccgcgacagcgacattctcgtccgtagtcctgctgctgacactgtcgagctggctgcggcggaaatgctcagcagcatttcgagacgggcggccacagactgaccctacgcgtggagatccagatgcatgtcgcttcgatctaaatacgagaagctcgtctgggactactactcccggtctgacagcgtgactacgacttctttgactgcctgattgagagacgagcaagcacttccccaaggtggttcctccccggcggcgcataatacaacactgttctactcctccgagtaccagcacctaaacgacataggatctagaacccgtggaccaacgttcttttcggggtgtccccaatcctcacagccgcaagctcggtggcttccccccctggaaaaggcgagcccctttggttgtggtccccag

SEQ ID NO: 17893 - DNA, 718 bp, Zea mays
  misc_feature: Ceres CLONE 1383359-F
  misc_feature: Encodes the peptide sequence at SEQ ID NO. 17894
  misc_feature (302)..(302): n is a, c, t, g, unknown, or other
  misc_feature (330)..(330): n is a, c, t, g, unknown, or other
  misc_feature (359)..(359): n is a, c, t, g, unknown, or other
  misc_feature (368)..(368): n is a, c, t, g, unknown, or other
  misc_feature (369)..(369): n is a, c, t, g, unknown, or other
tccccgcggtggcggccgctctagaactagtggatcccccgggctgcaggaattcgcacgagaccattacctagaacatcctaatcgaaaaatatccactattctctaggaagcaagggaatcacatcgccatggcagccaagatgtttgcattgtttgcgctcctagctctttgtgcaaccgccactagtgctacccatatcccagggcacttgtcaccactactgatgccattggctaccatgaacccatggatgcagtactgcatgaagcaacagggggttgccaacttgctagcgtgnccgaccctgatgctgcagcaactggtgnccctcacgcttcagccgtgccaaatgccnatgatgatnngcagtatgatgccacccgatgacatgatgcccgatgcgaatatgatgccatcgatgatgggtgcgactatgatgtcacaataacgatagctagtatgatgccaccgatgatgatgccaaacatggtttcacccatgatggatgcgaatatgatgccttccacgatgacgccgagtatgatgccaccgataatgatgcaagtatgataccaccgatgatgatgccgagcatggtgtcatcaatgataatggcaaacatgatgacagtgccccaatgttactctgattcatcctcgcacataatacaaaaacaaaattaccattcatgttcagccccaaggcgtggcgatt

SEQ ID NO: 17894 - protein, 106 aa, Zea mays
  misc_feature: Ceres CLONE 1383359-F
  misc_feature (57)..(57): Xaa is any aa, unknown, or other
  misc_feature (67)..(67): Xaa is any aa, unknown, or other
  misc_feature (79)..(79): Xaa is any aa, unknown, or other
  misc_feature (80)..(80): Xaa is any aa, unknown, or other
MAAKMFALFALLALCATATSATHIPGHLSPLLMPLATMNPWMQYCMKQQGVANLLAXPTLMLQQLVXLTLQPCQMPMMXXSMMPPDDMMPDANMMPSMMGATMMSQ

SEQ ID NO: 17895 - DNA, 714 bp, Zea mays
  misc_feature: Ceres CLONE 1383361-F
  misc_feature (395)..(395): n is a, c, t, g, unknown, or other
  misc_feature (396)..(396): n is a, c, t, g, unknown, or other
  misc_feature (432)..(432): n is a, c, t, g, unknown, or other
ggagctccccgcggtggcggccgctctagaactagtggatcccccgggctgcaggaattcgcacgagaccattacctagaacatcctaatcgaaaaactccaccctccctccctctctctctctctctccacctccaccaccagcacccaccatcccggctcgaagaccgcttccctccctccgctccacccccgcaaccctctcccgccgcgcacgcgccaccttccattcctccgctccccgcttcctcccaatcttaaccacccgccgcgccccctcccgccacccggtttcctctccccctcttcttcctccctcaaaccagacgctcgccccccatttccccatctcttcttcttcttcccccatcagaggaggaaggaagaaaagatanngcagagcctctcccccccagcccagccaccccgtancgacaacggagggcggaagaagatgagcgcgtccagttcataaagtgcgtcacggtcgggggacgcggccgtcgcaagactgcatgctcattttctaacctcccaaaacttcccaacgattatgttccgaacggggttgacaacttcagggctacagtgggggttgaggaaaaacctgccaacctccggccttgggaaactgggagggcaaaggttttcaacaaaacggaaacccctggcttatcggggggcggggggttttcctcggggtttcccacgaga

SEQ ID NO: 17896 - DNA, 724 bp, Zea mays
  misc_feature: Ceres CLONE 1383362-F
  misc_feature: Encodes the peptide sequence at SEQ ID NO. 17897
  misc_feature (429)..(429): n is a, c, t, g, unknown, or other
  misc_feature (568)..(568): n is a, c, t, g, unknown, or other
  misc_feature (586)..(586): n is a, c, t, g, unknown, or other
ggagctccccgcggtggcggccgctctagaactagtggatcccccgggctgcaggaattcgcacgagaccattacctagaacatcctaatcgaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatanagagtgttggagagggtgtgactgacgtagctccgggcgacatgtccttcctgtgtcactggggagtgcaaggagtgtgcccactggcagtcggcagagagcaacatgtgtgatctgctcaggatcacaccgaccgcgntgtgatgattgccgatgncaagtcgcggttttcaaatcatgggaaagctatctaccacttttgtgggacttccacttcagcgagacacgtcatgccattgtgggttgtgttgcaagatcaccctcagctccccttgataaagttgcgtccttagct

SEQ ID NO: 17897 - protein, 112 aa, Zea mays
  misc_feature: Ceres CLONE 1383362-F
  misc_feature (34)..(104): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (76)..(76): Xaa is any aa, unknown, or other
MATAGKVIKCKAAVAWEAGKPLSIEEVEVAPPQAMEVRVKILFTSLCHTDVYFWEAKGQTPVFPRIFGHEAGGIIXSVGEGVTDVAPGDMSFLCHWGVQGVCPLAVGREQHV

SEQ ID NO: 17898 - DNA, 812 bp, Zea mays
  misc_feature: Ceres CLONE 1383365-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (47)..(47): n is a, c, t, g, unknown, or other
  misc_feature (48)..(48): n is a, c, t, g, unknown, or other
nnnnnnnnnnnnnnnnnnnnnnnnaatcaggcgccccccgcctcctnncaaaatggagctccccgcggtggcggccgctctagactagtggatcccccgggctgcaggaattcgcacgagaccattacctagaacatcctaatcgaaaaccctgcatgtgttcaaaacggaaagtctgatcctgaagcagcagacgtgaaaccgacagcacgtacgtacgtgtgagggctgagggctgctcggcggccatgggacatggtgctttaaaaacgcccactctggggatattgggccattaactccctgcagctgctcctgatactgctcagaacctgaagaaaccacgagggggggtcgtccccatcctccccggccggtggtcgtggtgggggtgcccgtctccctccccaaccgccggattgggccggacggcccaaaaattccggtggggtcgcgaaaaacagaggtgcttttctcgtgcccaaaagctccggaagcccgcggggggccagcgggcgcccgggccgccccgcggggccaacctccccaggttggtgggggggggccggtgtacccttgggaaagatggtcgccgcgctcgcggggggcctctcgtcggccctcgccccggacgctcctcccggccccggggcgagctcccgccccgcgggcgcccctctcccgaagaccgcggcggtgggggggggggggcggggggccgcccgctggggcccctcacgctcggcgacgcgtgcggcggtcccggggtggcgggatgcgtgggtggggggcgggggtgggggcgggggggg

SEQ ID NO: 17899 - DNA, 724 bp, Zea mays
  misc_feature: Ceres CLONE 1383366-F
gctcaaaactagtggatcccccgggctgcaggaattcgcacgagaccattacctagaacatcctaatcgaaaatcgcttcagctcggcgtcttcacaaacgccggcgcaaactctcgcccgagcccgacagatcttcaattccccattccgcccaccgatcgaccttcacgccagtctcggtctcttccgaagcgtcgcgcgcggttgtttgagaggagaggaggaagatgagggagtgcatctccggtcacatcggggcaggccggcatccaagtcggcaacgcgtggtgggaacttttactggctcgagcacgggatcccagctgatgggccaggggccttgcagataaaacgggggggacttcaccaatgatgccttccaggacccttctttcaaccagaactgggggcttgggaaaacaccgttcccccgggggaaaaccttccgttggatctaaaacaccccacttgggaattcgaggggagggggggccacttgggaaacgaaaccggccaggttttttcccccccctgggacaactttcctctcaaggggcaaagggaggaatgcccccttaaaaaattttcccccgcggggggccccctaaaacaaatttgggccaaggaaaaatttgtttatatttgtggccctttgaccccgaatcccccaaaggttttttttgaaacaattgggcccccgggccttcccggggggtttgcccg

SEQ ID NO: 17900 - DNA, 789 bp, Zea mays
  misc_feature: Ceres CLONE 1383367-F
  misc_feature: Encodes the peptide sequence at SEQ ID NO. 17901
  misc_feature (1)..(1): n is a, c, t, g, unknown, or other
  misc_feature (18)..(18): n is a, c, t, g, unknown, or other
  misc_feature (19)..(19): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (49)..(49): n is a, c, t, g, unknown, or other
  misc_feature (52)..(52): n is a, c, t, g, unknown, or other
  misc_feature (735)..(735): n is a, c, t, g, unknown, or other
nttttccccccccccccnnccccccccccgcccggcggggnnnnnnntnttnaaaagctggcgctccccgcggtggcggccgctctagaactagtggatcccccgggctgcaggaattcgcacgagaccattacctagaacatcctaatcgaaaaatcgcacatattattgagaccaactagcaacatagaaggcacaatagtgtaccaacaatggcagccaaaatattttgcctccttatgctccttggtctttctgcaagggctgctacggcgaccattttcccgcaatgctcgcaagctcctatagcttcccttcttcccccgtacctctcaccaggggggtcttcggtatgtgaaaacccaattcttcaaccctacaggatccaacaggcaatcacaggtggcatctttacctttatcacccttgggccctcccaacaatccatcagcccctattacatccggttacccttttgggggattttaattggggacaaaaacattggggggcaccaccaactaaccaacgagcttgggggctaagcaaaacccttgggtggccttacctcctccgggaaacggggcagtttttcctttcgcatttcaaacccaaactaaggcttggagttgagaacctccggggctttcctaaatttggggaaagaaacaaaccaaccttaccctttttcggggcccagggtgtagccgggggggggcgctaaccccccccganagaaattttttcgttccccaatgtcaagaccccaaatggggggacaaacaaatt

SEQ ID NO: 17901 - protein, 110 aa, Zea mays
  misc_feature: Ceres CLONE 1383367-F
MAAKIFCLLMLLGLSARAATATIFPQCSQAPIASLLPPYLSPGGSSVCENPILQPYRIQQAITGGIFTFITLGPSQQSISPYYIRLPFWGILIGDKNIGGHHQLTNELGG

SEQ ID NO: 17902 - DNA, 650 bp, Zea mays
  misc_feature: Ceres CLONE 1383368-F
  misc_feature: Translation starting site: 157
  misc_feature: SWISSPROT Homolog: EC 3.5.1.52 Peptide-N(4)-(N-acetyl-beta-glucosaminyl)asparagine amidase
  misc_feature (372)..(372): n is a, c, t, g, unknown, or other
  misc_feature (373)..(373): n is a, c, t, g, unknown, or other
  misc_feature (413)..(413): n is a, c, t, g, unknown, or other
  misc_feature (438)..(438): n is a, c, t, g, unknown, or other
  misc_feature (628)..(628): n is a, c, t, g, unknown, or other
cgctctagaactagtggatcccccgggctgcaggaattcgcacgagaccattacctagaacatcctaatcaaaaaacaacaacaacaaccatctccaacgcagcatcagacagaaggacaggcaggcagcgagtgcaaccgcgagagcgatcagcgatgggctccttcttctcgaccttagtgacgccccctccggccgccgacgacccgaactgcgccgtggtggccgcgcactccaaggccacctacgacgagcagtgggcggcccacaagagcagcagcaagctgatgggtgatcgacttctcggcgtcctggtgcggggcctgccgcttcatcgagccggccttcaaggagctgggctcccgcttcanncgatgcatcttcgtcaaggttgacgtcgacgagctcgcgnaggtcgcagggacatggaagggtanaggcgatgcccacgttcgtgctggtcaaggatgggaaggaggtagggccgtgtgattggggctaagaaggacgagcttgagaggaagatcaggatgttcgtcacgtcatcttcctcgtcctaacttagcagtgcataccctcccaccttcttactggtttctcaactccggtggtcacctgggacggggntgctgaaatgcttcccttctcc

SEQ ID NO: 17903 - DNA, 671 bp, Zea mays
  misc_feature: Ceres CLONE 1383369-F
  misc_feature (594)..(594): n is a, c, t, g, unknown, or other
  misc_feature (595)..(595): n is a, c, t, g, unknown, or other
gctctagaactagtggatcccccgggctgcaggaattcgcacgagaccattacctagaacatcctaatcgaaaacttccccatctccggataaaagataaggagtgtctctcctttgccatcctcctctctttcagctaagtccctgccccctctctttttcttacattcaggtcctcgcagctcctctcttttttcttgtttctttcgatctgcgagccgtccaagtccagtactcttctttccctcaaggaactcttgcagccggcccctctggtttcctcgaattcttggttccccggtccctcctcctgtcccgcgtagatccgtccgtccgaggagcacaccgtccccacccccatgtttacccaccagttcctctgacgggcgccgtgctccgatgaggctgaacgtggtccgtatccgccgctcccactccttctccggcgcttcctctactggttctacgcctcctcatgaacgcatcgcccctctccaactggtgatccttgcgccggctctccctcctctctttctctctgagataatcctttccaatccatctctaggggtctcctggttctccccatctttnncccccaacccaacccgccgaaaaaacaagattcaaatccgaacaaaaaaagggttcccatgtgcggccctccgccg

SEQ ID NO: 17904 - DNA, 705 bp, Zea mays
  misc_feature: Ceres CLONE 1383374-F
  misc_feature: Encodes the peptide sequence at SEQ ID NO. 17905
  misc_feature (323)..(323): n is a, c, t, g, unknown, or other
  misc_feature (389)..(389): n is a, c, t, g, unknown, or other
tggagctccccgcggtggcggccgctctagaactagtggatcccccgggctgcaggaattcgcacgagaccattacctagaacatcctaatcgaaaaattccattccacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcgaaggaggccgncgcgtggcgcgtgatggcgctggagcgggtccccgccgacatccgcgcgcagggcggcgtggcgcncatgtcggacccgggcctcatccgcgacatcaagcgcggcgtcaccatcccgggtcatgggcaaggcccgcatcggggcacttcgtggagggccaaaatccctggagggccgtggggcgtcaactacctggaccgaaaagggaggtgctgaaccccccgccgacgacgcgcaaccacattcacaaggcacaaactgccggcgtccccttttcgtctgggggctggccgcgaacctcggggagggcgcttcccgcaggggtggcggggagggcccccgccatgatccgccacccaaggggggagggccggcaccggg

SEQ ID NO: 17905 - protein, 133 aa, Zea mays
  misc_feature: Ceres CLONE 1383374-F
  misc_feature (62)..(62): Xaa is any aa, unknown, or other
  misc_feature (84)..(84): Xaa is any aa, unknown, or other
MASDGSGVVTVYGSNGAELLEPSKQPKSATFSVKVGLAQMLRGGVIMDVVTPEQARLAKEAXAWRVMALERVPADIRAQGGVAXMSDPGLIRDIKRGVTIPGHGQGPHRGTSWRAKIPGGPWGVNYLDRKGRC

SEQ ID NO: 17906 - DNA, 664 bp, Zea mays
  misc_feature: Ceres CLONE 1383375-F
  misc_feature: Translation starting site: 148
  misc_feature (286)..(286): n is a, c, t, g, unknown, or other
  misc_feature (355)..(355): n is a, c, t, g, unknown, or other
  misc_feature (579)..(579): n is a, c, t, g, unknown, or other
  misc_feature (599)..(599): n is a, c, t, g, unknown, or other
tccccgcggtggcggccgctctagaatagtggatcccccgggctgcaggaattcgcacgagacattacctagaactcctaatcgaaaatttttcgcccgccgcccccagtcccgatccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaagggcggcgcctttccccaagcccgacaggccgccgcccgcgtgnaaacccaagtctaccctggcgacgacgtcaagccccgcgttcccagcaccccgcagcctaagcctaccnagctcaggtcgagcatcacgcctgggacggtgctgatcctcctcgcagggcgcttcatggggaagagagtgggtgtttctcagcagctcaggtccgggctgctccttatctctgggcctttttcagatcatggagtaccgatcccgcgtgtgaatcagacctatgtcattgctacatcaaccaaagtgacatctctggtggtgatgtcgcccagtttgatgacnagtactttgccagggagaanaagcagaaggtgaagaagaccgagggcgagctttttgagacgaaaaggagcatcccagtcactgg

SEQ ID NO: 17907 - DNA, 674 bp, Zea mays
  misc_feature: Ceres CLONE 1383376-F
  misc_feature: Encodes the peptide sequence at SEQ ID NO. 17908
  misc_feature (357)..(357): n is a, c, t, g, unknown, or other
tccccgcggtggcggccgctctagaactagtggatcccccgggctgcaggaattcgcacgagaccattacctagaacatcctaatcgaaaaaatctctctcttctcctcgcctcgccttggtgttcacgccgtcgctagcgcctgccgcggcgaagcttctgccctccccggcgccaggctcgggtcgtcgtcggccaggcagctgctacgcgtgaacacggtcacaccagtacggcagtaccacgcgacgtgaacggtgaactcgtgaagaacagagccgccactgaggaaaccctaagcgacgcggcgggctaccggtgacattgtccccctcgggccctccatccctgaagaancggcgccaggctggagggaaccagcccctaatcgaggacagggcgatcttttgtgccctggggagcttcagcccgaatcaagggcgacaatgcgggcggcccataaaatagagcaacccaaacccctccaaattaaggggaaactctgggagaaccgcgaccggggcggcaaaccaggggggccatttccccattgccattgcccctctttgttgggggaggggtgggggaggcaaggggggcaaggcaaaatggggcaaaccggggggcccactcgtaacccccccccaaggaaaagggggttgcccccctttttt

SEQ ID NO: 17908 - protein, 76 aa, Zea mays
  misc_feature: Ceres CLONE 1383376-F
MRAAHKIEQPKPLQIKGKLWENRDRGGKPGGPFPHCHCPSLLGEGWGRQGGQGKMGQTGGPTRNPPPRKRGLPPFF

SEQ ID NO: 17909 - DNA, 714 bp, Zea mays
  misc_feature: Ceres CLONE 1383379-R
  misc_feature (327)..(327): n is a, c, t, g, unknown, or other
  misc_feature (342)..(342): n is a, c, t, g, unknown, or other
  misc_feature (446)..(446): n is a, c, t, g, unknown, or other
  misc_feature (477)..(477): n is a, c, t, g, unknown, or other
  misc_feature (533)..(533): n is a, c, t, g, unknown, or other
  misc_feature (556)..(556): n is a, c, t, g, unknown, or other
  misc_feature (558)..(558): n is a, c, t, g, unknown, or other
  misc_feature (618)..(618): n is a, c, t, g, unknown, or other
  misc_feature (649)..(649): n is a, c, t, g, unknown, or other
  misc_feature (652)..(652): n is a, c, t, g, unknown, or other
  misc_feature (675)..(675): n is a, c, t, g, unknown, or other
  misc_feature (693)..(693): n is a, c, t, g, unknown, or other
  misc_feature (699)..(699): n is a, c, t, g, unknown, or other
cgattgggtaccgggccccccctcgaggtcgacggtatcgataagcttttttttttttttttttgacagacttatatagatacatagatttgctgaccccaagccaagccatgtggagctatgaacagccttcagactgacaagctcaaaaatgaaaaacggaagagaaaacgagcaagtgcgggtgggaaaaaaacctgctattcacatggatcgcattatcaaaattcagaacctgactgactgtacttctagtaacataagttactttctatggctcagataacactactgtgcagttagcatctaataccatcatcgatcgcnttcttcaaacgtttncgtttcgctcgtcatcatccaacacaaagacgacggtggatccctgcgtcagtccgtcagtgcagcctctgtcgcttggcgatgaagcccgcgagcagctggcngcgggcagcacggggcaaggcgccgccatcngccgcttcgtgcagccgctgggcggcagcgtgaccgcgtcgtcggcgtaccgggcngcccgggaagcgcccaagcgcancntgtcccgtgcgcgcaccgtgggcgggttgcgccagcgcgggagctgcccggcaaaagcangttctgcagcaggggcccgggctccatgacngcngccagcaaggcggcccctgggcngcagggggctctttggcngcgagnatctcgaggcgcggg

SEQ ID NO: 17910 - DNA, 684 bp, Zea mays
  misc_feature: Ceres CLONE 1383381-F
  misc_feature: Encodes the peptide sequence at SEQ ID NO. 17911
  misc_feature (306)..(306): n is a, c, t, g, unknown, or other
  misc_feature (426)..(426): n is a, c, t, g, unknown, or other
  misc_feature (427)..(427): n is a, c, t, g, unknown, or other
gagctccccgcggtggcggccgctctagaactagtggatcccccgggctgcaggaattcgcacgagaccattacctagaacatcctaatcgaaaaatctatcgcactcgtagtcgtagctcaagcatcagcggcaggagctctgggcagcgtgcgcacgtggggtacctagctcgctctgctagcctaccatggctgatcaccaccggggtgcgacgggaggtgggcggggctacggcgacctccagcgcgggggcggcatgcacggcgaggcgcagcagcagcagaagcaggccgccatgatgancgcgctcaaggccgcgacggccgcgacccttcgcgggtcgatgctggtgctgtccgggctgatcctgggcggcaccgtgatcgcgctcacgggggcccccccgtgctggtgactcagcgnnggctgggggggccgcccccaatcggctggggttctgggggggcgggttcctcccctccgggggcctcggggtcgctgggcttgtccgggttccccggggatggacaaggacctggcgggcaagccccccgccgggcgccgaaccaggtgggacccgcgcaagggggagggtggcggtcaaagggcccggaaaatttagaggggcgcgcacagcgccccgcttccacccagggggcagaggggccttgagaaaaaaag

SEQ ID NO: 17911 - protein, 75 aa, Zea mays
  misc_feature: Ceres CLONE 1383381-F
  misc_feature (39)..(39): Xaa is any aa, unknown, or other
MADHHRGATGGGRGYGDLQRGGGMHGEAQQQQKQAAMMXALKAATAATLRGSMLVLSGLILGGTVIALTGAPPCW

SEQ ID NO: 17912 - DNA, 671 bp, Zea mays
  misc_feature: Ceres CLONE 1383383-F
  misc_feature: Encodes the peptide sequence at SEQ ID NO. 17913
  misc_feature (416)..(416): n is a, c, t, g, unknown, or other
  misc_feature (440)..(440): n is a, c, t, g, unknown, or other
  misc_feature (560)..(560): n is a, c, t, g, unknown, or other
  misc_feature (671)..(671): n is a, c, t, g, unknown, or other
tccccgcggtggcggccgctctagaactagtggatcccccgggctgcaggaattcgcacgagaccattacctagaacatcctaatcgaaaaagtactttcgctagctcccttccgttcccttcccacgaaaaccggagagggagtgagaagaagcaacaagaagcggagagccaacgcgcaacgcaacgccctgagatggcggcgccggcgccggcgccgaagcaggaggagctgcagccgcacgccgtcagggaccagctgccctccgtctcctactgcctgacaagcccgcccccatgcccggaggccgtcctcctcggcttccagcactacctcgtcatgctcggcaccaccgtcatcatccccaccgcgctcgtgccccagatgggcggcgccaatgaggaaaaggcgcggntggtgcaaacgctgctggtcgtgnccgggatccacacgctgggtcagagcttcctcgggacgcgcctccccggcggcatgggggcctcctaaaaccttcgtcgggcccaccatcctcatcgtcctcgccgggcgctaacggggnttccccgatccccacgaagaattcgtgggccatcatgggggggaaggaaggggcgttctttgggggcctccccgctccaaatcatcttgggcttcaggggcctttggggcn

SEQ ID NO: 17913 - protein, 103 aa, Zea mays
  misc_feature: Ceres CLONE 1383383-F
  misc_feature (74)..(74): Xaa is any aa, unknown, or other
  misc_feature (82)..(82): Xaa is any aa, unknown, or other
MAAPAPAPKQEELQPHAVRDQLPSVSYCLTSPPPCPEAVLLGFQHYLVMLGTTVIIPTALVPQMGGANEEKARXVQTLLVVXGIHTLGQSFLGTRLPGGMGAS

SEQ ID NO: 17914 - DNA, 691 bp, Zea mays
  misc_feature: Ceres CLONE 1383384-F
  misc_feature: Encodes the peptide sequence at SEQ ID NO. 17915
  misc_feature (604)..(604): n is a, c, t, g, unknown, or other
  misc_feature (605)..(605): n is a, c, t, g, unknown, or other
  misc_feature (691)..(691): n is a, c, t, g, unknown, or other
ggagctccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtggtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccggggtgtggggcagccgagccgcatggtccagccgctccgggcacagtgctgccagcagcagatggaggatgatggacgtgcagtccgtcccgcagcagctgcagatgatgatgcagcttgagcgtgccgctgccgccagcagcaggctgtacgagccagctctgatgcagcagcagcagcagctgctgggagcccagggtctcaaccccatggccatgatgatgccccannacatggccggccatgggtggactctaccagaaccagctgccaagttaccggcccaacccctgggggggcttcgctggccatccccn

SEQ ID NO: 17915 - protein, 157 aa, Zea mays
  misc_feature: Ceres CLONE 1383384-F
  misc_feature (128)..(128): Xaa is any aa, unknown, or other
  misc_feature (129)..(129): Xaa is any aa, unknown, or other
MQMPCPCAGLQGLYGAGAGLTTMMGAGGLYPYAEYLRQPQCSPLAAAPYYAGVWGSRAAWSSRSGHSAASSRWRMMDVQSVPQQLQMMMQLERAAAASSRLYEPALMQQQQQLLGAQGLNPMAMMMPXXMAGHGWTLPEPAAKLPAQPLGGLRWPSP

SEQ ID NO: 17916 - DNA, 664 bp, Zea mays
  misc_feature: Ceres CLONE 1383385-F
  misc_feature: Translation starting site: 219
  misc_feature (347)..(347): n is a, c, t, g, unknown, or other
  misc_feature (412)..(412): n is a, c, t, g, unknown, or other
  misc_feature (462)..(462): n is a, c, t, g, unknown, or other
  misc_feature (503)..(503): n is a, c, t, g, unknown, or other
tccccgcggtggcggccgctctagaactagtggatcccccgggctgcaggaattcgcacgagaccattacctagaacatcctaatcgaaaaatttatttcctccgcttcagctcccattctccgccaaataaacccccgaaaagcaggagaggcgagacccggaagtggaaggctagggttagggtcccagctccccgttgcctgggcgagccgagtgatggccgcccctgccccctccggcgcagctagtgccgccgcctcaccgtccccgctgatgcagctgccgtcgccgttcgcggagctcgtcaggggccccctccggcctcgagaaggtcgtgcttcgcgncgctcgcaactgctggtgcgagatttatctttatggagggtcagtaacatcatggaagaatgacnatgggggaagacttgctttttctcagcagcaaggctatttttcaaacctncaaaagctattcgtggtggtataccaatctgcttttcccantttggatcacatggaaatcttgaaacacatggattcgctaggaaccggttttggactattgagcacatccacctctttaccattaaacctgctataaagcgtttgtgatctgatctgaagcttctgaggagatttaagatctggcccacagttttgatttc

SEQ ID NO: 17917 - DNA, 655 bp, Zea mays
  misc_feature: Ceres CLONE 1383387-F
  misc_feature: Translation starting site: 166
  misc_feature (272)..(272): n is a, c, t, g, unknown, or other
  misc_feature (306)..(306): n is a, c, t, g, unknown, or other
tccccgcggtggcggccgctctagaactagtggatcccccgggctgcaggaattcgcacgagaccattacctagaacatcctaaatcgaaaaaaaaaaaccctagtctcagagcagccgcatccacaacctgcctctctcgtcccctggcggcgtccgcggcaggatggcggaatctacggcgaggacggtgaaggatgtcaacccgcacgagttcgtcagggctactccgcccactcaagcgctccggaagatggagctccctgagtgggntgacattgtgagactgcgaggtcaaggagctccntcttatgatcctgactgtactacatcagggctgcatccattgcaagggaaatctacctaggcaaggcatcgggtgtggtggctttcaaagatctacggggccgccagaggatggctcccgcccacacacttctgcagagcagtggtgctgtgcacccacatcctgcagcagttgcagatatgggcatcatcgatgtcaatcccaagggtggacgcctcatcacaaccagggaaagcgtgatctggaccagtggctggaggggtccctgttgaagcggagcagggtcatcttgggttcaatgggggcattgtttaagggtaaaaaaactgccttctatttgctcttttgg

SEQ ID NO: 17918 - DNA, 680 bp, Zea mays
  misc_feature: Ceres CLONE 1383388-F
  misc_feature: Translation starting site: 168
  misc_feature: SWISSPROT Homolog: EC 6.3.2.19 Ubiquitin--protein ligase
ggagctccccgcggtggcggccgctctagaactagtggatcccccgggctgcaggaattcgcacgagaccattacctagaacatcctaatcgaaaataaataaagcagctcctccgggggcggcgaactactcctcgtcgccaaaaccctagccctgcttctttgccatggcgagcagcgctagccaggcgagcctcctgctccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgacctccccccagaactatcccagcagcccggcatcagtaagatttacttctgagatgtggcatcggaatgtttatcctgatggacgtgtttgcatttctattcttcatcacctggtgaagatcccaatggttatgagcttgcaagcggacgatggacaccagtgcacacgggtgaaagtatagttctgagcatcatttcgatgctctctagtccaaatgacgagtctccagcgaatatcgaagctggcaaggatgggagagaaagcgggatgagttcaagaaaaagggaagggaatgtgtccccaaatctaggaaatgctctgaaggaaa

SEQ ID NO: 17919 - DNA, 793 bp, Zea mays
  misc_feature: Ceres CLONE 1383394-F
  misc_feature: Encodes the peptide sequence at SEQ ID NO. 17920
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (25)..(25): n is a, c, t, g, unknown, or other
  misc_feature (26)..(26): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
nnnnnnnnccccnnnnnaaaccaanntccatgggggggcgcaatnntnnaaaagtggggctccccgcggtggcggccgctctagaatagtggatcccccgggctgcaggaattcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggttcatctaccgccgccggtgcatctgccacctccggttcacctgccacctccggggcatctcccaccgccggtccacctgccggccgccggtccacctgccaccggcggggccatggtgccgccgccgggttcatcctgccggccgccaccatgccactacccctaatcaaccggtcgccggccttcagcctcattccccagccacaccccgtgccccgggccaacagccggcattccaagccccggggccagctggcaaggaaacctgcggggggttggcagccacccccgatcctagggcgcaggggcgggcaaggtcccctggaggcgttcagtggcagcccccggaggggaaaccgcccctaactgggtcccccctcaagggggccggtccgttgggcggggaaggagaggggttgcgcacgccggccttccatggggagggggggaagacccccggaggacaaccgtgg

SEQ ID NO: 17920 - protein, 88 aa, Zea mays
  misc_feature: Ceres CLONE 1383394-F
MRVLLVALALLALAASATSTHTSGGCGCQPPPPVHLPPPVHLPPPVHLPPPGHLPPPVHLPAAGPPATGGAMVPPPGSSCRPPPCHYP

SEQ ID NO: 17921 - DNA, 666 bp, Zea mays
  misc_feature: Ceres CLONE 1383400-F
  misc_feature: Encodes the peptide sequence at SEQ ID NO. 17922
  misc_feature (358)..(358): n is a, c, t, g, unknown, or other
  misc_feature (389)..(389): n is a, c, t, g, unknown, or other
  misc_feature (414)..(414): n is a, c, t, g, unknown, or other
  misc_feature (437)..(437): n is a, c, t, g, unknown, or other
  misc_feature (440)..(440): n is a, c, t, g, unknown, or other
  misc_feature (456)..(456): n is a, c, t, g, unknown, or other
ggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgacggagggtgcagcggagggtccggccggccaggtgggcgagggcgccaggcgaagaggcgcccaagagagaaggcgcctaaggagaggagctttccgcggcgaagaggcggcggcgcaccttcctacgctganatgattgagaggcgtcgctgccctcaggagnagaagggtcaagctcgtgccatcancagtacgtcgaggggagcatggnggnagctcccaccactttncgcagcagctcactgtgcagctgaagaagctcgctgcccgccgggcagctgacgagggtgaaaaactcccttcaaggtggcgggccaccggaacccaaagcccaaagggccgccaaagccccaaagggccccccaggggccccgcccccaaaaacccaagacccctttcccggaaaaggggggaaaggggccaaaaacccacccctcgtt

SEQ ID NO: 17922 - protein, 57 aa, Zea mays
  misc_feature: Ceres CLONE 1383400-F
MSTEEAVVAEVPVTEGAAEGPAGQVGEGARRRGAQERRRLRRGAFRGEEAAAHLPTL

SEQ ID NO: 17923 - DNA, 665 bp, Zea mays
  misc_feature: Ceres CLONE 1383402-F
  misc_feature: Translation starting site: 196
  misc_feature: Pfam Name: Lactamase_B Pfam Description: Metallo-beta-lactamase superfamily
  misc_feature: SWISSPROT Homolog: EC 3.1.2.6 Hydroxyacylglutathione hydrolase
  misc_feature (386)..(386): n is a, c, t, g, unknown, or other
  misc_feature (394)..(394): n is a, c, t, g, unknown, or other
  misc_feature (401)..(401): n is a, c, t, g, unknown, or other
ggagctccccgcggtggcggccgctctagaactagtggatcccccgggctgcaggaattcgcacgagaccattacctagaacatcctaatcgaaaagaccttccagtcttctccgtaggggcttcgctccatagatttcgccgcaaggggcaacggcacacccaccaactgacctgacccacgagggatccgcagatgaagatcattccggtcccttgcctggatgacaactatgcctacttaatcgtggacgagagcaccaagaaagcagcggccgttgaccctgtggaaccggagaagttctcaaggcggccggcgaggtcggcgcctacgtcgactgcgttctcaccacccatcaccactgggatcatgctggtggcaatganaagatgangctgcangtgccagggataaaagtatttggaggatccctcggacatgtgaaaggctgcactgatcaggtggagaatgggaatgaagtgtcactggggaagacattgagatactatgcctacacacgcgtgccacactaaaggtcatatcagctactatgttactaggaaggaggggtgaagatccagcgggtcttcaccgggagataccttgttcattgctggggggggggaagttttttgaggggtctgcaaagcaaatggatcagtccc

SEQ ID NO: 17924 - DNA, 690 bp, Zea mays
  misc_feature: Ceres CLONE 1383404-F
  misc_feature: Encodes the peptide sequence at SEQ ID NO. 17925
tccccgcggtggcggccgctctagaactagtggatcccccgggctgcaggaattcgcacgagaccattacctagaacatcctaatcgaaaatcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcggcgcgggtttccgattcggttcatgggcggtttctgggtttctgccgcgcgacttggcttgcctgatggtggcctcatttcctatggagaaatgggagatcaaggccgtctcatcaatgaagctggttcaatcccagggattggtgatggaaacaatggttaccgaaactctatgaatattcagaaaaacataaaaggatatttccgtgggtggtttttgctggaattaatgcttggaggatcaggggggaacctaaagggatgggggaacatcctggaaggaaaggaaaatcccttattcaggggggggaaggctgtgccttggccaataaaaaagcttggtggaaaatggctaaagaaaa

SEQ ID NO: 17925 - protein, 173 aa, Zea mays
  misc_feature: Ceres CLONE 1383404-F
  misc_feature: SWISSPROT Homolog: EC 2.7.8.23 Carboxyvinyl-carboxyphosphonate phosphorylmutase
MAARCPYFAVEESSRGIRSGESPAAALRRILATPGAHQAPCCYDALGARLVERRGFPIRFMGGFWVSAARLGLPDGGLISYGEMGDQGRLINEAGSIPGIGDGNNGYRNSMNIQKNIKGYFRGWFLLELMLGGSGGNLKGWGNILEGKENPLFRGGKAVPWPIKKLGGKWLKK

SEQ ID NO: 17926 - DNA, 698 bp, Zea mays
  misc_feature: Ceres CLONE 1383405-F
  misc_feature: Encodes the peptide sequence at SEQ ID NO. 17927
  misc_feature (457)..(457): n is a, c, t, g, unknown, or other
  misc_feature (698)..(698): n is a, c, t, g, unknown, or other
tccccgcggtggcggccgctctagaactagtggatcccccgggctgcaggaattcgcacgagaccattacctagaacatcctaatcgaaaaccaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgtcaagaccctcactggaaagactatcaccctcgaggtgnagtcttctgacaccatcgacaacgtcaaggccaagatccaggacaaggagggcatccctccggaccagcagcggctcatttttgctggcaagcagctcgaggacgggcgcacgctggccgactacaccattagagggagagcaccctccacttggggttgcgtctcaggggcggcatgcaaatcttcctgaaaactctgactggcagactatccccccttgaggccgagtcttctgaaacn

SEQ ID NO: 17927 - protein, 156 aa, Zea mays
  misc_feature: Ceres CLONE 1383405-F
  misc_feature (6)..(74): Pfam Name: ubiquitin Pfam Description: Ubiquitin family
  misc_feature (82)..(152): Pfam Name: ubiquitin Pfam Description: Ubiquitin family
  misc_feature (94)..(94): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVXSSDTIDNVKAKIQDKEGIPPDQQRLIFAGKQLEDGRTLADYTIRGRAPSTWGCVSGAACKSS

SEQ ID NO: 17928 - DNA, 819 bp, Zea mays
  misc_feature: Ceres CLONE 1383412-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (52)..(52): n is a, c, t, g, unknown, or other
nnnnnnnnnnnnnnnnnnnnnggggggggggnnnnnataggtgtgggaaaantggagctccccgcgggggcggccgctctagaatagtggatcccccgggctgcaggaattcgcacgagaccattacctagaacatcctaatcaaaaatcaaccatattattgagaccaacaagcaacatagaaagtggaatccagtagcaacaatagagcaacaatggcgaccaagatattttccctccttatgctccttgctctttctacatgtgttgctaacgcgacatttttccctcaaggctcacaagctcctatagcttcccttcttcccccataccttccatcaattatagcttcaatatggtgaaaacccagctcttcaaccatatagggcttcaacaaggaatcgcagcaaagcaacataacctttatcggcccttggtggtttcaacaatcgccagcccctatctttgggggggagcctttggtaaccaaccatcaggggcaccaacaggtgggaggaaacctcggggctaccctctggatccaacccaaggtaggctcgtgggaaaaaccttttcctcccctagttcctcggggaaacaaaaaattttcctcccctttccaaccaaacgtggcctaaccctggaaccccggggtgggtttattttgcggggcaacaacctaataacccctttttagccgggggggagggtactgggcccaaactccccaaggaaaaaagaaaatttttctttccattttaaacccaaattgggcgcgcgaacgggaaacccccgggttggttttattttggcaaacaa

SEQ ID NO: 17929 - DNA, 738 bp, Zea mays
  misc_feature: Ceres CLONE 1383413-F
  misc_feature (338)..(338): n is a, c, t, g, unknown, or other
  misc_feature (339)..(339): n is a, c, t, g, unknown, or other
  misc_feature (401)..(401): n is a, c, t, g, unknown, or other
  misc_feature (416)..(416): n is a, c, t, g, unknown, or other
  misc_feature (425)..(425): n is a, c, t, g, unknown, or other
  misc_feature (430)..(430): n is a, c, t, g, unknown, or other
  misc_feature (431)..(431): n is a, c, t, g, unknown, or other
  misc_feature (438)..(438): n is a, c, t, g, unknown, or other
  misc_feature (442)..(442): n is a, c, t, g, unknown, or other
  misc_feature (443)..(443): n is a, c, t, g, unknown, or other
  misc_feature (448)..(448): n is a, c, t, g, unknown, or other
  misc_feature (450)..(450): n is a, c, t, g, unknown, or other
tccccgcggtggcggccgctctagaactagtggatcccccgggctgcaggaattcgcacgagaccattacctagaacatcctaatcgaaaaacggagcaaaacgaaacgcggcagccagcacaacccagcagagcgcgactcgactcgaatcgaatagtcccgtcctttcggttctacctttccctcccgcgccgccgcagccgcctccagggccgcggaaaccctagccacctcgtcagtgccgcgcgccgggtgtctcgccgccgcccgtcactgccgctgacaccgccggagcgatcggatctcgagaccgtcaggagacacgatggaggatggnngatctgaaagattccagccccgtgctcctggttgtgaagtcgagccacttaaaatcagtggnctgatgaaaatgtcnatgccgacnacgannaagatcntggnnagaanangaggaaaggaaaaacctagccagggggtgggaaaagaacgggacgaacctagggttagggtccgggtaaagggaaaacggaggttccacaggggcggggaaccaagaagcccttggagccccttcaaaaaaattccccaaaagggttgggggaaaaattgatttcggcccataaaacctttttgaaaaaaaagggggggaaaaaacctaaatctttttttccaagcccgagagggttttgaaaaaaccggggtttttaaaaaacgccccccccaaaaaaattcttcct

SEQ ID NO: 17930 - DNA, 676 bp, Zea mays
  misc_feature: Ceres CLONE 1383415-F
  misc_feature: Pfam Name: zf-A20 Pfam Description: A20-like zinc finger
  misc_feature (427)..(427): n is a, c, t, g, unknown, or other
  misc_feature (454)..(454): n is a, c, t, g, unknown, or other
tccccgcggtggcggccgctctagaactagtggatcccccgggctgcaggaattcgcacgagaccattacctagaacatcctaatcgaaaacccccatttcgaagcccaccgaattccctgcgattcctctcccctcgcctcctcgtctccccctaggggatcgtcggagaggaatcgcaaagagggccgtctcatccgagttaaggaagcatggagcacaaggaggctgggtgccaggcccccgaggggacccatcctcttgcatcaataactgtggcttctttcggagcgcggcgaccatgaacatgtgctccaagtgccacaaggagatgataacgaagcaggatcagggccagctgcctgcctcctctatcgacgcatcgtgaacggcagcgacgccgtcatggagccgggttgtgctgggancaacaccgtagtagctggtgcccaagntgagttgcaaacaatgaacgtgcagcagcccgctgatgttgccggaccccagcgagggggtgggggcaatctccaaaggggggaagggaagggccaaaccgggccaccccctgcagaaggagggttgaacttaccgggattccactgccgggggggggaactttggaatgggcacttccccggttacctccgaaaaggaagaattggaaggttcaactaccg

SEQ ID NO: 17931 - DNA, 699 bp, Zea mays
  misc_feature: Ceres CLONE 1383418-F
  misc_feature: Encodes the peptide sequence at SEQ ID NO. 17932
  misc_feature (263)..(263): n is a, c, t, g, unknown, or other
aaagctggagctccccgcggtggcggccgctctagaactagtggatcccccgggctgcaggaattcgcacgagaccattacctagaacatcctaatcgaaaagttatatctcctcaaggcacgttcaccacagtcctctctttccccggcaccaccaccacccaggctaaccggactggaccgagtgttgaacaacactgagggcgaggcagatagagcgacggcaggcatggtgagccgtggaaatttgcacctggggctgnaccccgggtctctgggcgcgccgtggggcgacccgttcggcggagaaatcccgccgcagctcctcggcgggctgggagaaaacctctcctcaacccgcggcaagggcgccaacgttgcgagggaggcggacaactaattcctgatgccccattttaaggttggggtttgcccgcccccgcctaaacaccaatgggagggagggccccaaaccccacccggggggaggcccgccagaggaagggacccgcgccccatggcccttcccgggggaattcaggcccggaatttccgggcgccccccgggggtaagtcccccccgggacattgcggggccccccgtactccttcgcgggaagggcacataaaagggtggggggtcccacctttacctgataacgcagcgcgccccaaagcaggaggggttgactttcggga

SEQ ID NO: 17932 - protein, 56 aa, Zea mays
  misc_feature: Ceres CLONE 1383418-F
  misc_feature (12)..(12): Xaa is any aa, unknown, or other
MVSRGNLHLGLXPGSLGAPWGDPFGGEIPPQLLGGLGENLSSTRGKGANVAREADN

SEQ ID NO: 17933 - DNA, 668 bp, Zea mays
  misc_feature: Ceres CLONE 1383419-F
  misc_feature: Translation starting site: 184
  misc_feature (181)..(181): n is a, c, t, g, unknown, or other
  misc_feature (319)..(319): n is a, c, t, g, unknown, or other
  misc_feature (406)..(406): n is a, c, t, g, unknown, or other
  misc_feature (483)..(483): n is a, c, t, g, unknown, or other
  misc_feature (504)..(504): n is a, c, t, g, unknown, or other
  misc_feature (547)..(547): n is a, c, t, g, unknown, or other
  misc_feature (592)..(592): n is a, c, t, g, unknown, or other
  misc_feature (626)..(626): n is a, c, t, g, unknown, or other
  misc_feature (668)..(668): n is a, c, t, g, unknown, or other
tccccgcggtggcggccgctctagaactagtggatcccccgggctgcaggaattcgcacgagaccattacctagaacatcctaatcgaaaaaccgcaaggatccaccacaacagcgaaggagaaagcagaccaacctagccacccagggagaaagaggccaaaagggaggggagagtgtcntcatggcttccattgtcgcttccaggagggccgttcctctagttcgcgctctggagaagctcatcgcagcgtcctccgctcccgggactggctccgccctcaggccggtggcagtcgccggcggcctccgcggctacnacaccggcgctccgctccgacgctacgagggggccgagtcggaagacgatagcgtccgcgagtacgatgggcggcacggcggccggnactacgctgtgcccagcctgttctcagatattttccgtgatccgcttagtgcgccgcacagcattggccggctgctngaccttgtggacgacttggcnggtggcggcgccaggtcgtgcggtgcgccgtggctggaacgcnaaggaggacgagggagcgctgcacctgaggggtgacatgccaggnctgggggaaggaccacgtcaaggggtgggccgancaaaccggcctggtgatcaagggcgaggggcaaaaggaagan

SEQ ID NO: 17934 - DNA, 694 bp, Zea mays
  misc_feature: Ceres CLONE 1383420-F
  misc_feature: Encodes the peptide sequence at SEQ ID NO. 17935
  misc_feature (351)..(351): n is a, c, t, g, unknown, or other
  misc_feature (384)..(384): n is a, c, t, g, unknown, or other
  misc_feature (406)..(406): n is a, c, t, g, unknown, or other
  misc_feature (438)..(438): n is a, c, t, g, unknown, or other
ggagctccccgcggtggcggccgctctagaactagtggatcccccgggctgcaggaattcgcacgagaccattacctagaacatcctaatcgaaaaaattcgtctcgttttctcccttcccctgcgggctggagagcggcggcgaacgagacaaggtcaccggtgacgctcctcacctactccctgccgcctttcgctttccggcccggcctgccgcaagctcgcgcgccgcctacatcgacccctccccgcgccgcaggccgcctcccacagacgcggggcagccacgtcgcccggctcggagggattcggttcggaccgtcgtgctcccctccgcactcttctattggnctgaagagcagcggagatccaccagcaattggnattgcttctccttttttctggnatatacttgggctcctcgggtgttggctaggncatccagctttccaaagtgtgatcggacaagtttatttttggttctgagatggctgatgaggactcatccgacttcaccttctggaggggtagttctgcagaaaatgacggccaaccagatctcctaaagccattcctatggcagtatgacgctcgaggatgtccgtggtaaaatgcaaatactccaaagaatatgggatgaaactgttgatcaaaaaaagaaaggctggaaacaatgcagtgtttcacaaagacg

SEQ ID NO: 17935 - protein, 161 aa, Zea mays
  misc_feature: Ceres CLONE 1383420-F
  misc_feature (136)..(136): Xaa is any aa, unknown, or other
GAPRGGGRSRTSGSPGLQEFARDHYLEHPNRKNSSRFLPSPAGWRAAANETRSPVTLLTYSLPPFAFRPGLPQARAPPTSTPPRAAGRLPQTRGSHVARLGGIRFGPSCSPPHSSIGLKSSGDPPAIGIASPFFWXILGLLGCWLGHPAFQSVIGQVYFWF

SEQ ID NO: 17936 - DNA, 733 bp, Zea mays
  misc_feature: Ceres CLONE 1383421-F
  misc_feature: Translation starting site: 299
  misc_feature: Pfam Name: ATP-synt_ab Pfam Description: ATP synthase alpha/beta family, nucleotide-binding domain
  misc_feature: Pfam Name: ATP-synt_ab_C Pfam Description: ATP synthase alpha/beta chain, C terminal domain
  misc_feature: SWISSPROT Homolog: EC 3.6.3.14 H(+)-transporting two-sector ATPase
  misc_feature (374)..(374): n is a, c, t, g, unknown, or other
  misc_feature (395)..(395): n is a, c, t, g, unknown, or other
  misc_feature (431)..(431): n is a, c, t, g, unknown, or other
  misc_feature (534)..(534): n is a, c, t, g, unknown, or other
  misc_feature (535)..(535): n is a, c, t, g, unknown, or other
  misc_feature (543)..(543): n is a, c, t, g, unknown, or other
  misc_feature (592)..(592): n is a, c, t, g, unknown, or other
  misc_feature (598)..(598): n is a, c, t, g, unknown, or other
  misc_feature (608)..(608): n is a, c, t, g, unknown, or other
  misc_feature (612)..(612): n is a, c, t, g, unknown, or other
  misc_feature (619)..(619): n is a, c, t, g, unknown, or other
  misc_feature (639)..(639): n is a, c, t, g, unknown, or other
  misc_feature (674)..(674): n is a, c, t, g, unknown, or other
ggagctccccgcggtggcggccgctctagaatagtggatcccccgggctgcaggaattcgcacgagaccattacctagaacatcctaatcgaaaatcggtgctcttcaagagcgaatcacaaccaccaagaaaggttccatcacctcagtgcaagccatctatgtccctgctgatgatttgacagatcctgctcctgccacaacctttgcccacttggatgccacaaccgtgctttccagacagatttccgagcttggtatctatcctgctgtggatcctctggattcaacatcccgtatgctctcacctcacattctgggtgaggagcactacaacacggctcgtggtgtgcagaaagtgctacagaattacnagaaaattgcagatattattngcatttttggaatggatgagctaagtgaagatgacnagctgactggtgcccgtgcccgtaagatcagagattcttgagtcagccattcccacgtgctgaaatcttcactggtgcccctggaaaaatacgtgaccttaanngaaacatncacagtttcccaggtctgctcgatggcaagtacgatgatcttcctgaancatcgntttacatggnttgntgcatcnacgaggtggttgctaaagcnaaaaaatctccaggagggcgcagcttaagggcttngatcatccccttttggatgctatacatctctcttcttcttttttgtgacataacgaaaa

SEQ ID NO: 17937 - DNA, 716 bp, Zea mays
  misc_feature: Ceres CLONE 1383424-F
  misc_feature: Encodes the peptide sequence at SEQ ID NO. 17938
  misc_feature (253)..(253): n is a, c, t, g, unknown, or other
  misc_feature (277)..(277): n is a, c, t, g, unknown, or other
  misc_feature (336)..(336): n is a, c, t, g, unknown, or other
  misc_feature (359)..(359): n is a, c, t, g, unknown, or other
  misc_feature (453)..(453): n is a, c, t, g, unknown, or other
  misc_feature (623)..(623): n is a, c, t, g, unknown, or other
tggagctccccgcggtggcggccgctctagaactagtggatcccccgggctgcaggaattcgcacgagaccattacctagaacatcctaatcgaaaagtccgatctctctcccgagtccactccaagccttttcgccttttcctccgccttctcgcgatggcgccgccgcgccgcgctctactcgtcctcgccgctctcctcctctcccctctccttggggccgcctccttccattccgacgagctcctcctncacgatgacgaagagttcgagggngtcgtcgcccgcccctccgccccctccccggcgggggccccggtggtctcctcctcccngcgcagatcagcggacgcgccgntgcccgggtcaggcgagtccaacgcagtggcagtcacgctcgagcacgaccttggcgacggcaagggcttcgtctcagctggaaccttctcggncccgctcaagaccttcgcccacggcacgcagaccctcactaaacttcgcttttacagggatgattttactgaggatgataaagcggcgttcaaaaaagtgcttcaggaaagatggcttttatacaattaagctgccatcttatgtggttggacactacaaagaacatcantggtggttcttcaatcagaggtagatgcattccaccgggaaagtttggatgaacacttggtatcccactggaagggggaaaatatctgggcga

SEQ ID NO: 17938 - protein, 141 aa, Zea mays
  misc_feature: Ceres CLONE 1383424-F
  misc_feature (60)..(60): Xaa is any aa, unknown, or other
  misc_feature (68)..(68): Xaa is any aa, unknown, or other
  misc_feature (99)..(99): Xaa is any aa, unknown, or other
MAPPRRALLVLAALLLSPLLGAASFHSDELLLHDDEEFEGVVARPSAPSPAGAPVVSSSXRRSADAPXPGSGESNAVAVTLEHDLGDGKGFVSAGTFSXPLKTFAHGTQTLTKLRFYRDDFTEDDKAAFKKVLQERWLLYN

SEQ ID NO: 17939 - DNA, 705 bp, Zea mays
  misc_feature: Ceres CLONE 1383425-F
  misc_feature: Encodes the peptide sequence at SEQ ID NO. 17940
  misc_feature (174)..(174): n is a, c, t, g, unknown, or other
  misc_feature (269)..(269): n is a, c, t, g, unknown, or other
  misc_feature (426)..(426): n is a, c, t, g, unknown, or other
  misc_feature (459)..(459): n is a, c, t, g, unknown, or other
acccgcggtggcggccgctctagaactagtggatcccccgggctgcaggaattcgcacgagaccattacctagaacatcctaatcgaaaaacacgaactcgagacctcgcccgcccaaatacaaaagcctcagatctcagtgaccagcgccgccgcttcgttcgtgtcgaatanagaagagaggaaatggcggcgagcgagggcgtgctcctggggatgggcaaccccctcctcgacatctccgccgttgtcgatgacgccttcctggncaagtatgacatcaagctgaacaatgccattctcgctgaggagaagcactcgcctatgtatgatgagttggctagcaaacagcatgttgaatatattgctgggagagccacccagaactctatcagggttgcccaatggatgcttcaaactcctggntgcaacagtacatgggatgcattgggaaggacnagtttggtgagagatgaagaaaatggctcagctgcaggagtactgctcatactatgaggatgagactgctcctactgccactgtgctgtatggggttgtgggggcaaaggtcattgattgcaaatctgccgggggaaactggtacaatctgagcatctcagaaaccaaagaactggcacttattgagaggcaaaatactctacgttgtggattttccccccggggcacttgatctttccgttagtg

SEQ ID NO: 17940 - protein, 109 aa, Zea mays
  misc_feature: Ceres CLONE 1383425-F
  misc_feature: SWISSPROT Homolog: EC 2.7.1.20 Adenosine kinase
  misc_feature (28)..(28): Xaa is any aa, unknown, or other
MAASEGVLLGMGNPLLDISAVVDDAFLXKYDIKLNNAILAEEKHSPMYDELASKQHVEYIAGRATQNSIRVAQWMLQTPGCNSTWDALGRTSLVRDEENGSAAGVLLIL

SEQ ID NO: 17941 - DNA, 715 bp, Zea mays
  misc_feature: Ceres CLONE 1383426-F
  misc_feature: Encodes the peptide sequence at SEQ ID NO. 17942
  misc_feature (344)..(344): n is a, c, t, g, unknown, or other
  misc_feature (543)..(543): n is a, c, t, g, unknown, or other
  misc_feature (624)..(624): n is a, c, t, g, unknown, or other
  misc_feature (667)..(667): n is a, c, t, g, unknown, or other
tccccgcggtggcggccgctctagaactagtggatcccccgggctgcaggaattcgcacgagaccattacctagaacatcctaatcgaaaaaaggaaggagaggggagcgagcgagcgagcaaccggcggcgacagccatggcggagcagcacaaggaggagtcgggcgtgacagtgctggacaagatctccgacaagctccacgggcgagggggcggctcgtcctcgtcgtcggactcggacgacgagcgctcgtcggcgacggccgccgtgaaggccaagatctaccgcatcttcgggcgcgagaagcccgtgcactccgtcctcggcggcggcaagccggncgatctgtttctatggaggaacaagaggatctctggtggggtgctcgcaggcgcaactgccttctggctgctgtttgaggtcatggattaccacctcctcaccctgctatgccactgcctcatcctcaccctggccatcctggtcctctggtccatggcacgactttcatcaacaagtctcctctaccatccccgaggntgagatccagatgacctggctgtgaatggtgcacgtcctgagaatgaaatcaacagggtttgctactttgagggagatggncaggccatgacctcagaaattctgattgtgatgaggactgggnatccttctggtcttggagctgtgcattctcactggctaaaaagtttta

SEQ ID NO: 17942 - protein, 135 aa, Zea mays
  misc_feature: Ceres CLONE 1383426-F
  misc_feature (69)..(69): Xaa is any aa, unknown, or other
MAEQHKEESGVTVLDKISDKLHGRGGGSSSSSDSDDERSSATAAVKAKIYRIFGREKPVHSVLGGGKPXDLFLWRNKRISGGVLAGATAFWLLFEVMDYHLLTLLCHCLILTLAILVLWSMARLSSTSLLYHPRG

SEQ ID NO: 17943 - DNA, 716 bp, Zea mays
  misc_feature: Ceres CLONE 1383427-F
  misc_feature: Encodes the peptide sequence at SEQ ID NO. 17944
  misc_feature (442)..(442): n is a, c, t, g, unknown, or other
  misc_feature (445)..(445): n is a, c, t, g, unknown, or other
  misc_feature (446)..(446): n is a, c, t, g, unknown, or other
  misc_feature (457)..(457): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (473)..(473): n is a, c, t, g, unknown, or other
  misc_feature (481)..(481): n is a, c, t, g, unknown, or other
  misc_feature (637)..(637): n is a, c, t, g, unknown, or other
  misc_feature (638)..(638): n is a, c, t, g, unknown, or other
  misc_feature (682)..(682): n is a, c, t, g, unknown, or other
ggagctccccgcggtggcggccgctctagaactagtggatcccccgggctgcaggaattcgcacgagaccattacctagaacatcctaatcgaaaagccggcgatcggcggagatccgctgttctgacatcgtctcccgctgctgacttgtgaacaaggcagcagcatggttcagtttggaaacatgtcatcaaagaagatagagttggatcacaaggacatggtccatgattctgctatcgactactatggcaagcgccttgccactgcctcctcagactctaccgtgaagatcatcaacattggcgcggcaaatgccccatcccaggtcctggcaacgcttagtggccactatggtcctgtgtggcgtgttgcttgggcccatcccaagtatggcgctatccttgcttcgtgcagttatgatggccgtgtcattatttgnaanngagatgcacgnagcattnnngtctcangtcatgtngtcagtgacaacaagtcatctgtcaactccattgcatgggctccgtatgaggttgggctttggctttgctgtgcatcttcaggtggaagatatccatcttgacatgcagcttaatgggggtttggatactgcaccattgagcgagcacatcctggnntgtggactgccatattctgggctcctgcacagctcgaagtgggnacaaggggagtggttacactgtcgccccagaggt

SEQ ID NO: 17944 - protein, 132 aa, Zea mays
  misc_feature: Ceres CLONE 1383427-F
  misc_feature (47)..(87): Pfam Name: WD40 Pfam Description: WD domain, G-beta repeat
  misc_feature: SWISSPROT Homolog: EC 2.3.1.48 Histone acetyltransferase
  misc_feature (86)..(86): Xaa is any aa, unknown, or other
  misc_feature (87)..(87): Xaa is any aa, unknown, or other
  misc_feature (88)..(88): Xaa is any aa, unknown, or other
  misc_feature (94)..(94): Xaa is any aa, unknown, or other
  misc_feature (97)..(97): Xaa is any aa, unknown, or other
MSSKKIELDHKDMVHDSAIDYYGKRLATASSDSTVKIINIGAANAPSQVLATLSGHYGPVWRVAWAHPKYGAILASCSYDGRVIIXXXDARSIXVSXHVVSDNKSSVNSIAWAPYEVGLWLCCASSGGRYPS

SEQ ID NO: 17945 - DNA, 696 bp, Zea mays
  misc_feature: Ceres CLONE 1383429-F
  misc_feature: Encodes the peptide sequence at SEQ ID NO. 17946
  misc_feature (393)..(393): n is a, c, t, g, unknown, or other
  misc_feature (429)..(429): n is a, c, t, g, unknown, or other
  misc_feature (484)..(484): n is a, c, t, g, unknown, or other
  misc_feature (515)..(515): n is a, c, t, g, unknown, or other
  misc_feature (531)..(531): n is a, c, t, g, unknown, or other
  misc_feature (554)..(554): n is a, c, t, g, unknown, or other
ggagctccccgcggtggcggccgctctagaactagtggatcccccgggctgcaggaattcgcacgagaccattacctagaacatcctaatcgaaaaacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaatttgcccattgcaacaacaatccnttggcacatctaacaatacaaaccatcgcaacgcancagcaacaacagttcctaccagcactgagccacctagccatggtgaaccctgtcngctacttgcaacagcagctgcttgcatccancccacttgctctagcnaacgtagttgcaaaccagcaacnaacacactgcaacagtttctgccagcgcttaatcaactagccatggtgaaccctgcccgctaccctacacagcaaacactgctttcatctagcccgctcgctgtgggcaatgcacctacatacctgcaaacagattggttgc

SEQ ID NO: 17946 - protein, 178 aa, Zea mays
  misc_feature: Ceres CLONE 1383429-F
  misc_feature (1)..(178): Pfam Name: Zein Pfam Description: Zein seed storage protein
  misc_feature (78)..(78): Xaa is any aa, unknown, or other
  misc_feature (90)..(90): Xaa is any aa, unknown, or other
  misc_feature (108)..(108): Xaa is any aa, unknown, or other
  misc_feature (118)..(118): Xaa is any aa, unknown, or other
  misc_feature (124)..(124): Xaa is any aa, unknown, or other
MATKILSLLALLALFASATNASIIPQCSLAPSSIIPQFLPPVTSMAFEHPAVQAYRLQQAIAASVLQQPICPLQQQSXGTSNNTNHRNAXATTVPTSTEPPSHGEPCXLLATAAACIXPTCSSXRSCKPATNTLQQFLPALNQLAMVNPARYPTQQTLLSSSPLAVGNAPTYLQTDWL

SEQ ID NO: 17947 - DNA, 715 bp, Zea mays
  misc_feature: Ceres CLONE 1383430-F
  misc_feature (185)..(185): n is a, c, t, g, unknown, or other
acccgcggtggcggccgctctagaactagtggatcccccgggctgcaggaattcgcacgagaccattacctagaacatcctaatcgaaaacttttgagaactccccttctccgccactaccgaagcccttgtacccctcaccgccgccgctgctgctagggagcttccatccgcgcgcgcctacnacgagagctagcagcggtagcggccgttatcttgtcgctccggctccgttcgtgtacccaagtcccagcctagatgccgcagatggaggggtccactgatcagatcgccgccggctggtttcgctaaggagccggcttccgagcgccccgtgggcttggcgaggaccggctcttccagtcgcctcaacgcgcaggcgccggagttcgtgccgcgggggccgccgccccggggccggggggttgtgctgcccctcccgcgcaggggatccggatgttcgccgggcctcccccggcgcggggggggggtttcttccccgggccgaaccccggccgttagaagactaatgccctattcgggaacgcaggggatttgctgccaaggaacaacaggcgcccgaaactggaaaacggaaaagcccccccccccccgcggagaaaaacgaaccccggggggggaatgggctccaaccaaagaggggggggcccaaaaaaccccaagggagggggaaaaacttattgttaggggcccc

SEQ ID NO: 17948 - DNA, 709 bp, Zea mays
  misc_feature: Ceres CLONE 1383434-F
  misc_feature: Encodes the peptide sequence at SEQ ID NO. 17949
  misc_feature (408)..(408): n is a, c, t, g, unknown, or other
  misc_feature (514)..(514): n is a, c, t, g, unknown, or other
  misc_feature (606)..(606): n is a, c, t, g, unknown, or other
  misc_feature (625)..(625): n is a, c, t, g, unknown, or other
aagctggagctccccgcggtggcggccgctctagaactagtggatcccccgggctgcaggaattcgcacgagaccattacctagaacatcctaatcgaaaaacacccgtcgtcgtccgcatcccccgcctgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcnagcggtgtgatcctcttcgaggagaccctgtaccagaagaccaaggatggcaagcctttttgttgatgtcctcaggggagggaggcgtcctccctggcatcaaggntgacaaggcaccattgggaggttgttggcactgataaggagaccaccacccaaggcatgacgaccttgggcagcgttgcgccagtactaccnagcaggtgcccgcttgcangggggcgcgctgtttctcaagatggccctatgagccatcacagcttgcatcactgaaaaacttcagggtctggctcgtatgcat

SEQ ID NO: 17949 - protein, 115 aa, Zea mays
  misc_feature: Ceres CLONE 1383434-F
  misc_feature: SWISSPROT Homolog: EC 4.1.2.13 Fructose-bisphosphate aldolase
  misc_feature (70)..(70): Xaa is any aa, unknown, or other
  misc_feature (105)..(105): Xaa is any aa, unknown, or other
MSAYCGKYKDELIKNAAYIGTPGKGILAADESTGTIGKRLSSINVENVEENRRALRELLFCCPGALQYIXRCDPLRGDPVPEDQGWQAFLLMSSGEGGVLPGIKXDKAPLGGCWH

SEQ ID NO: 17950 - DNA, 724 bp, Zea mays
  misc_feature: Ceres CLONE 1383437-F
  misc_feature: Encodes the peptide sequence at SEQ ID NO. 17951
  misc_feature (323)..(323): n is a, c, t, g, unknown, or other
  misc_feature (382)..(382): n is a, c, t, g, unknown, or other
  misc_feature (568)..(568): n is a, c, t, g, unknown, or other
tccccgcggtggcggccgctctagaactagtggatcccccgggctgcaggaattcgcacgagaccattacctagaacatcctaatcgaaaaaaaaatcgaacccaagtcgaaaccctaacctcggccttctcgatgtcggccgccacaaccgccccaacccctgcggtggccaccccgatggcgccgcctccgtcgtacccggcctcctccacgatctccgcctccgtggccgcgtcggtcgaggaagaggacgacctctatggccgcctcaagtcgctccagcgccacatggagttcgtcgagatccaggaggagtacgttnaagacgaacagaagaacctcaagcgcgaactcctccgtgcgcaggaggaggtcaagcgnatccagtccgtaccgctcgtcatcggccagtttatggagatggtcgacggcacaacggcatcgtggggtctactaccggcagcaactactatgtgcggatcctcagcaccatcaaccgcgagctgctcaagccgtcagcatctgtcgcgttgcatcgtcactccacgcttttagtcgacgtgctgncggcccgaggcgactcagattctcctttggttgggatccgcgaaaaagcccacgtcactacacggattttggaggatggcactccaaagcagaaatacggggggggcggttgagtacccttgacccatctgagtgacaaagaaaaattgtattacc

SEQ ID NO: 17951 - protein, 140 aa, Zea mays
  misc_feature: Ceres CLONE 1383437-F
  misc_feature (64)..(64): Xaa is any aa, unknown, or other
MSAATTAPTPAVATPMAPPPSYPASSTISASVAASVEEEDDLYGRLKSLQRHMEFVEIQEEYVXDEQKNLKRELLRAQEEVKRIQSVPLVIGQFMEMVDGTTASWGLLPAATTMCGSSAPSTASCSSRQHLSRCIVTPRF

SEQ ID NO: 17952 - DNA, 736 bp, Zea mays
  misc_feature: Ceres CLONE 1383440-F
  misc_feature (440)..(440): n is a, c, t, g, unknown, or other
aagctggagctccccgcggtggcggccgctctagaactagtggatcccccgggctgcaggaattcgcacgagaccattacctagaacatcctaatcgaaaatcgccatttcaccaccgcctccgcccccatcctctccccctcccgtcgcgccagtcaacagcctgtctgcctcttccctcgccacccatggccaccgtactaaaatacctcgtcaccccctgcccgtgacgctctctcctccgcttaaaaattaacttaactcacgtcctcatcttccatccaactctgttgtaaaagagacgttttaagaccctgtctgttgtatgcctcggggaccggattcctcctattccccgcctccccccgccgcagggcggtgaccgtgcaccgactgaacccccccccctgctccctgcccgccatcaccagcagtgcctnatcgccatgcacaaaccgctttttttaggttgttattaatgagcaaacgatggattgccacactcagacccttgcgcaggcgggtaggcacccgcagagcaccccaacacagactcctacatgtgctctgccagcgctatcttcccatcccctcggcaaattgatggacagactcacccccactcgaggaaaaaaaaaagggccgccttttcttgggcttaaaccctttttgtgtgtgtgtgagagggcccccccctccgccccccctattccggaaaagagagaggagggggggg

SEQ ID NO: 17953 - DNA, 715 bp, Zea mays
  misc_feature: Ceres CLONE 1383442-F
  misc_feature: Encodes the peptide sequence at SEQ ID NO. 17954
  misc_feature (361)..(361): n is a, c, t, g, unknown, or other
  misc_feature (380)..(380): n is a, c, t, g, unknown, or other
  misc_feature (434)..(434): n is a, c, t, g, unknown, or other
  misc_feature (447)..(447): n is a, c, t, g, unknown, or other
  misc_feature (453)..(453): n is a, c, t, g, unknown, or other
  misc_feature (473)..(473): n is a, c, t, g, unknown, or other
tccccgcggtggcggccgctctagaactagtggatcccccgggctgcaggaattcgcacgagaccattacctagaacatcctaatcgaaaaaagcacaagcacaaccaaaagcaaagaagagacgaagtcgatcgatcgatctcagcaactaagcaggtaggtaggcatggcggccgagaaggagggcgcggtggtgaccaagggccacgacgaggggatgaaggcggcggcggcgctgctggaggagttcgggctcccgccggggctgctgccgctggaggacgtgacggaggtggggttcgtgcgggccaccggctacttctggctcgcgcagcgcaagaaggtggagcaccggttccngcagatcggcaagcagggnagctacgacgtcgagatccgcgggctacgtccgggcccaggggcatcaggaggnctcagggggggtncagggncaaggagctcgtgctctggnccgcccgtccacggagatgggcccgtcgacgacgaccccgccaccggcaagatccactttcagagccctcgccggggtcaccaagaccttcccccggtgacgccttcggcggcgggcagtaaccaccacggggaccctcttaattatccctttaaaaatactcaaccccctttattttggggaaaattttgggattaataaaccccgggggaaaacttaaaaaaggggagggggggactggt

SEQ ID NO: 17954 - protein, 167 aa, Zea mays
  misc_feature: Ceres CLONE 1383442-F
  misc_feature (1)..(140): Pfam Name: DUF538 Pfam Description: Protein of unknown function, DUF538
  misc_feature (65)..(65): Xaa is any aa, unknown, or other
  misc_feature (94)..(94): Xaa is any aa, unknown, or other
  misc_feature (96)..(96): Xaa is any aa, unknown, or other
MAAEKEGAVVTKGHDEGMKAAAALLEEFGLPPGLLPLEDVTEVGFVRATGYFWLAQRKKVEHRFXQIGKQGSYDVEIRGLRPGPGASGGLRGGXGXRSSCSGPPVHGDGPVDDDPATGKIHFQSPRRGHQDLPPVTPSAAGSNHHGDPLNYPFKNTQPPLFWGKFWD

SEQ ID NO: 17955 - DNA, 738 bp, Zea mays
  misc_feature: Ceres CLONE 1383443-F
  misc_feature: Translation starting site: 145
  misc_feature (293)..(293): n is a, c, t, g, unknown, or other
  misc_feature (294)..(294): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (412)..(412): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (422)..(422): n is a, c, t, g, unknown, or other
  misc_feature (519)..(519): n is a, c, t, g, unknown, or other
aagctggagctccccgcggtggcggccgctctagaactagtggatcccccggggctgcaggaattcgcacgagaccattacctagaacatcctaatcgaaaacatttccaggatttactagctgggtttaccatagcccgtaggatgtcgagcgatctccactcggcatcggacgtgatcgccggtcgccgcctcctctccaggctgcagcacctgagcgccagcttcatgagcttctcggcctgcacctccggccagggcccggcggacgcgtccagcacgctgtgcacggnngtcatcttcacnnngctcgcgcgctgctccgcgacgttgagatccagcagccccgtgagcatctgcagaatcaccatggcgaacgcgtacacgtccgactccgttgtgagctccgcgngnnnnnncantttgaaagaacacggggtcatgtacccggcgtgcccatcgggttcgtgcggggggcgatggcctcctcctcaggggtttccgggcaccggccgggcnttccaaaaatttcccagcgggttcgggttgcggggccaaaaaggatgttggccactttccccccggggaaaaataggcgtggcgcccccctgggggggggagaccccccggcaaaaggggcttccccggaggatttgggggggtcctttcaaggagggggcttggggaaacgctccctttgggggggccctggggaggggcctcccccaccccgcgccc

SEQ ID NO: 17956 - DNA, 640 bp, Zea mays
  misc_feature: Ceres CLONE 1383444-F
  misc_feature: Encodes the peptide sequence at SEQ ID NO. 17957
  misc_feature (234)..(234): n is a, c, t, g, unknown, or other
  misc_feature (265)..(265): n is a, c, t, g, unknown, or other
  misc_feature (266)..(266): n is a, c, t, g, unknown, or other
  misc_feature (269)..(269): n is a, c, t, g, unknown, or other
  misc_feature (276)..(276): n is a, c, t, g, unknown, or other
  misc_feature (280)..(280): n is a, c, t, g, unknown, or other
  misc_feature (281)..(281): n is a, c, t, g, unknown, or other
  misc_feature (314)..(314): n is a, c, t, g, unknown, or other
  misc_feature (315)..(315): n is a, c, t, g, unknown, or other
  misc_feature (320)..(320): n is a, c, t, g, unknown, or other
  misc_feature (374)..(374): n is a, c, t, g, unknown, or other
  misc_feature (375)..(375): n is a, c, t, g, unknown, or other
  misc_feature (439)..(439): n is a, c, t, g, unknown, or other
aagctggagctccccgcggtggcggccgctctagaatagtggatcccccgggctgcaggaattcgcacgagaccattacctagaacatcctaatcgaaaatcaccaccactgggtcttcagaccattagctttatctactccagagcgcagaagaacccgatcgacaccatgagggtgttgctcgttgccctcgctctcctggctctcgctgcgagcgccactccacgcatacnagcggcggctggcgcttgcagcccacgccgnncgntcatctnacgnncgcgtgcatctgccacctccggtcacctggcannctcgntgatctccccacgcgttcactgccgcgcgggtcactgccaccgcgtcatgggcnngcgcgttattgcggcgcaacaggcatacctaatcacggccggctacttttcaagcaaacatgcntggaaggcgatcaaacctgcattgagaaactggggttgaaacccaatcgggccggggaattctgggattttggccccagggaccctcttttcccttaggagaattggggaaggttgtcccactctggggggggcccccccccaccggtttttttttttgcccccccctccgaaaaaaaacaaaagggaacctcgtgggttt

SEQ ID NO: 17957 - protein, 36 aa, Zea mays
  misc_feature: Ceres CLONE 1383444-F
  misc_feature (3)..(3): Xaa is any aa, unknown, or other
MGXRVIAAQQAYLITAGYFSSKHAWKAIKPALRNWG

SEQ ID NO: 17958 - DNA, 700 bp, Zea mays
  misc_feature: Ceres CLONE 1383447-F
  misc_feature (247)..(247): n is a, c, t, g, unknown, or other
  misc_feature (256)..(256): n is a, c, t, g, unknown, or other
  misc_feature (257)..(257): n is a, c, t, g, unknown, or other
  misc_feature (329)..(329): n is a, c, t, g, unknown, or other
tggagctccccgcggtggcggccgctctagaactagtggatcccccgggctgcaggaattcgcacgagaccattacctagaacatcctaatcgaaaaaacgacgcgattggcgattccatttctaccccgagacctccagccgtccgcccctgaaccctcagccttctccgtcccgcctcggcactcgacggccgccggcacacaccgcgcagtctcgagacaggtaacccgctcccctctccgctngactcctcnntccacaaggggccagcctcacccccaacgcccatctaagccaagtgcacggtgctgctagatcccgatctcngtctgccaaccgccgagggagggttgcgctcgccggatcccgcccgagtcacgtgcggctttgattcgctgcacctgtcgtgcaggaaccggaggaacgaggatggaggatgactcgccgctgacaaaacaatgaggggtgcgtgacagactccgcggggggacatctggggacaccgtctcccacctgaaacaaagtggcccggggggaaccccagctccggtccctgtccttatcggaaggtcaaaatggggggacctagggggcccccttcccccccatgggggggccctaaaatttgggaaaagaattcttgggaaaacccgggaaaaaagcggattttccaacggggggccctcggggggtttttt

SEQ ID NO: 17959 - DNA, 717 bp, Zea mays
  misc_feature: Ceres CLONE 1383452-F
  misc_feature (532)..(532): n is a, c, t, g, unknown, or other
ggagctccccgcggtggcggccgctctagaactagtggatcccccgggctgcaggaattcgcacgagaccattacctagaacatcctaatcgaaaacttccccatctccggataaaagataaggagtgtctctcctctctttcagctaagtccctgccccctctctttttcttacattcaggtcctcgcagccgcagctcctctcttttttcttgtttctttcgatctgcgagcagtccgtccaggtccagatccagtactcttctttccgtgaaggaactcttgcagccggcccctctggtttcctcgaattcttgttccccggtccctcctcctgtccccgcgtagatccgtccgtccgaggagcacaccgtccccacccccatgtttacccaccagttcctctgacggccgccgtgctccgatgaagctgagcgtgctccgtatccgccgctcccactccttctccgtcgccttcctctactggttctacgtcttctcatgaacgcatcgcccctctcccactgctgantcttcgctggctctctctctctctctcttagatagtctttttgatccatctctagggctcttgtttctccccacccaccccacaccaaaacaagtccccttgttcatccgacagaacagcatccatgtcgtcgtcacgccggtgctcgagcccgacagcaacgaacgacggacgagcgcagcgca

SEQ ID NO: 17960 - DNA, 722 bp, Zea mays
  misc_feature: Ceres CLONE 1383453-F
  misc_feature: Encodes the peptide sequence at SEQ ID NO. 17961
  misc_feature (356)..(356): n is a, c, t, g, unknown, or other
  misc_feature (620)..(620): n is a, c, t, g, unknown, or other
ccccgcggtggcggccgctctagaactagtggatcccccgggctgcaggaattcgcacgagaccattacctagaacatcctaatcgaaaaatctctgtcccaatcaaactgattgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggggagccagggcctgcgcagaacgtcgacnagtccaccagcctggcccggaaagtgttccggctctgtaagttcgtcaacgacctgcacgctttgatcagccctcctggcaaggggactccgctcccgctgatcctactcgggaagtccaagaacgcgatgctgtcgactttcctctttctgaaacagatcgtgtggggcggggaggacagggatatacaagaaacaggagcgggcggagtttctcggggaagatagcgttctactgcttccctcggctcaaacactgcacggncatcatcgagctagccgacttgcaacggctgtccacgtccatgaaaaacctggagaaagagctgacccaccagagctgtacaagaacgaccagtaccgctta

SEQ ID NO: 17961 - protein, 125 aa, Zea mays
  misc_feature: Ceres CLONE 1383453-F
  misc_feature (11)..(124): Pfam Name: PEX11 Pfam Description: Peroxisomal biogenesis factor 11 (PEX11)
  misc_feature (51)..(51): Xaa is any aa, unknown, or other
MASLDAVRGDLALLILYLNKAEARDKICRAIQYGSKFISNGEPGPAQNVDXSTSLARKVFRLCKFVNDLHALISPPGKGTPLPLILLGKSKNAMLSTFLFLKQIVWGGEDRDIQETGAGGVSRGR

SEQ ID NO: 17962 - DNA, 730 bp, Zea mays
  misc_feature: Ceres CLONE 1383455-F
  misc_feature: Encodes the peptide sequence at SEQ ID NO. 17963
  misc_feature (472)..(472): n is a, c, t, g, unknown, or other
  misc_feature (515)..(515): n is a, c, t, g, unknown, or other
  misc_feature (517)..(517): n is a, c, t, g, unknown, or other
  misc_feature (518)..(518): n is a, c, t, g, unknown, or other
  misc_feature (585)..(585): n is a, c, t, g, unknown, or other
  misc_feature (592)..(592): n is a, c, t, g, unknown, or other
  misc_feature (603)..(603): n is a, c, t, g, unknown, or other
  misc_feature (631)..(631): n is a, c, t, g, unknown, or other
  misc_feature (644)..(644): n is a, c, t, g, unknown, or other
  misc_feature (663)..(663): n is a, c, t, g, unknown, or other
  misc_feature (677)..(677): n is a, c, t, g, unknown, or other
  misc_feature (678)..(678): n is a, c, t, g, unknown, or other
  misc_feature (687)..(687): n is a, c, t, g, unknown, or other
  misc_feature (688)..(688): n is a, c, t, g, unknown, or other
tggagctccccgcggtggcggccgctctagaactagtggatcccccgggctgcaggaattcgcacgagaccattacctaagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagacaactaccccggcgtggnccgcaacgcgcgacgtctactttcctgtgtcgccatctggccngnngttgtggggcgcggctccaagctttggcggcgtgcaccacgtgcgcgcctggcgcacgacagctggncacaaanggcgcgtctcnctcatcgctggggcatcacgcgcttcgncctcgggtgcccnggaaagagatccaatcgcngaaacccgcgtggnnccctggccnnggctgaaagccttcgcatcatcctcgcttcacgaggttcttt

SEQ ID NO: 17963 - protein, 130 aa, Zea mays
  misc_feature: Ceres CLONE 1383455-F
  misc_feature (14)..(130): Pfam Name: AWPM-19 Pfam Description: AWPM-19-like family
  misc_feature (45)..(45): Xaa is any aa, unknown, or other
  misc_feature (59)..(59): Xaa is any aa, unknown, or other
  misc_feature (60)..(60): Xaa is any aa, unknown, or other
  misc_feature (85)..(85): Xaa is any aa, unknown, or other
  misc_feature (98)..(98): Xaa is any aa, unknown, or other
  misc_feature (102)..(102): Xaa is any aa, unknown, or other
  misc_feature (113)..(113): Xaa is any aa, unknown, or other
  misc_feature (117)..(117): Xaa is any aa, unknown, or other
MAGIGRNMVAPLLVLNLIMYIIVIGFASWNLNHFINGQTTTPAWXATRDVYFPVSPSGXXLWGAAPSFGGVHHVRAWRTTAGHKXRVSLIAGASRASXSGAXERDPIAETRVXPWPXLKAFASSSLHEVL

SEQ ID NO: 17964 - DNA, 727 bp, Zea mays
  misc_feature: Ceres CLONE 1383456-F
  misc_feature: Encodes the peptide sequence at SEQ ID NO. 17965
  misc_feature (394)..(394): n is a, c, t, g, unknown, or other
  misc_feature (652)..(652): n is a, c, t, g, unknown, or other
ggagctccccgcggtggcggccgctctagaactagtggatcccccgggctgcaggaattcgcacgagaccattacctagaacatcctaatcgaaaatcccacgagcgccccccctgccctgcccatttcgctctcctccctaggcaactaaacgccgcgctcccgcagacggtaccagccgccgcgatggggtcctcgtcctcgccaccgccaccaccgccgctgccactgcccatgattgggcgggccgggaacctcaccatcttcatcacgccgccatcccccgctagcacgccccggggcgctgggcgcacgccgccgctcgagtccccgcgctcggatatctccacacccatcccgcagagggcagccccgtcgcccctcctttctcccntctcgcggaacacgagagccgggccgtggcgcctgcggtggtgttcacccccgcccccgcgcctgcttctgtgaatgtcgcgctgccgccggtgcaggtgccgcccgcgcagtacgagagggcgtccgcggggggcaagcatgacgtatcggcgttcggcttcttctgggacgccgtcgcgcgcgtccaggaagcgcacgcgagcctcgacgagtaggggctacctgggttcggggtgatcagtccaaggacaggggncgctaacgactactacggaccataggcaaggtcagcagggcagggatcttcaaattcctcatcgcacttggctga

SEQ ID NO: 17965 - protein, 93 aa, Zea mays
  misc_feature: Ceres CLONE 1383456-F
  misc_feature (70)..(70): Xaa is any aa, unknown, or other
MGSSSSPPPPPPLPLPMIGRAGNLTIFITPPSPASTPRGAGRTPPLESPRSDISTPIPQRAAPSPLLSPXSRNTRAGPWRLRWCSPPPPRLLL

SEQ ID NO: 17966 - DNA, 768 bp, Zea mays
  misc_feature: Ceres CLONE 1383457-F
  misc_feature: Translation starting site: 209
  misc_feature (278)..(278): n is a, c, t, g, unknown, or other
  misc_feature (286)..(286): n is a, c, t, g, unknown, or other
  misc_feature (296)..(296): n is a, c, t, g, unknown, or other
  misc_feature (303)..(303): n is a, c, t, g, unknown, or other
  misc_feature (304)..(304): n is a, c, t, g, unknown, or other
  misc_feature (337)..(337): n is a, c, t, g, unknown, or other
  misc_feature (349)..(349): n is a, c, t, g, unknown, or other
  misc_feature (397)..(397): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (486)..(486): n is a, c, t, g, unknown, or other
  misc_feature (499)..(499): n is a, c, t, g, unknown, or other
  misc_feature (556)..(556): n is a, c, t, g, unknown, or other
  misc_feature (557)..(557): n is a, c, t, g, unknown, or other
  misc_feature (593)..(593): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (719)..(719): n is a, c, t, g, unknown, or other
  misc_feature (720)..(720): n is a, c, t, g, unknown, or other
  misc_feature (721)..(721): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (738)..(738): n is a, c, t, g, unknown, or other
  misc_feature (739)..(739): n is a, c, t, g, unknown, or other
  misc_feature (740)..(740): n is a, c, t, g, unknown, or other
  misc_feature (741)..(741): n is a, c, t, g, unknown, or other
  misc_feature (742)..(742): n is a, c, t, g, unknown, or other
  misc_feature (743)..(743): n is a, c, t, g, unknown, or other
  misc_feature (744)..(744): n is a, c, t, g, unknown, or other
  misc_feature (745)..(745): n is a, c, t, g, unknown, or other
  misc_feature (750)..(750): n is a, c, t, g, unknown, or other
  misc_feature (751)..(751): n is a, c, t, g, unknown, or other
  misc_feature (754)..(754): n is a, c, t, g, unknown, or other
  misc_feature (755)..(755): n is a, c, t, g, unknown, or other
  misc_feature (756)..(756): n is a, c, t, g, unknown, or other
  misc_feature (757)..(757): n is a, c, t, g, unknown, or other
  misc_feature (760)..(760): n is a, c, t, g, unknown, or other
  misc_feature (765)..(765): n is a, c, t, g, unknown, or other
ggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacnggccgggcgnaggacgnnagtgtcgaacgggaccgcaaggaggacctgcgntggtgcaagcangcgtgcgagtggcagtacgaaaaggacaccccgcggaagagggatgcnagagcgagtgcccgcgagcgcaccagcaagctgacgcgggcgaggacggcgacagcggcgtggacgcctacgtctcccgctccgnnnanggggcgagtgccngcgccagtgcctgcgccgcccacgagggccagccgtggaaaacccagagtgcatganngcgtgcccgccgcgcggacttggcgtcgacatgaancaaagagtaccgtcgccgcagcagagccccggcaggtgccccgggaagaagtgcgagcgccacacccgcggggaacttggtgggaaaagcacgtgctatgtgnnnannnnnnngnnnnnngggggnnnggggggnnnnnnnnnnnnnnnnnncgggnnccnnnncgnggggngag

SEQ ID NO: 17967 - DNA, 747 bp, Zea mays
  misc_feature: Ceres CLONE 1383462-F
  misc_feature: Encodes the peptide sequence at SEQ ID NO. 17968
  misc_feature (390)..(390): n is a, c, t, g, unknown, or other
  misc_feature (402)..(402): n is a, c, t, g, unknown, or other
  misc_feature (403)..(403): n is a, c, t, g, unknown, or other
  misc_feature (423)..(423): n is a, c, t, g, unknown, or other
  misc_feature (461)..(461): n is a, c, t, g, unknown, or other
  misc_feature (488)..(488): n is a, c, t, g, unknown, or other
  misc_feature (569)..(569): n is a, c, t, g, unknown, or other
  misc_feature (706)..(706): n is a, c, t, g, unknown, or other
  misc_feature (715)..(715): n is a, c, t, g, unknown, or other
  misc_feature (741)..(741): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagagggatgcnnagagcgagtgccgcgagcgncaccagcaagctgacgcgggcgaggacggcgacagcgncgtggacgcctacgtctcccgctcggnaagggggcgagtggccggcgccagtgcctgcgccgccacgaggggccagccgtgggaagacccaggatggcatggaggcgntgccgcccgcgcggactggccgtcgacatggaacaaagagtacggtcgcggcagcgagagcgcgggcagtgggcggggagaagtgcgagcgccaccaccgcggggactgggtggaagagcagcgctgctgatgatgnaaaaaaaancgggggggggggaaaaaaaaaggccncaaccc

SEQ ID NO: 17968 - protein, 178 aa, Zea mays
  misc_feature: Ceres CLONE 1383462-F
  misc_feature (64)..(64): Xaa is any aa, unknown, or other
  misc_feature (83)..(83): Xaa is any aa, unknown, or other
  misc_feature (92)..(92): Xaa is any aa, unknown, or other
  misc_feature (119)..(119): Xaa is any aa, unknown, or other
  misc_feature (165)..(165): Xaa is any aa, unknown, or other
  misc_feature (168)..(168): Xaa is any aa, unknown, or other
MGKGSVGASWWAFLLLAGVLLVVAATAGAEDGVVERDRKEDLRWCKQACEWQYGKDTPRKRDAXSECRERHQQADAGEDGDSXVDAYVSRSXRGRVAGASACAATRGQPWEDPGWHGGXAARADWPSTWNKEYGRGSESAGSGRGEVRAPPPRGLGGRAALLMMXKKXGGGEKKRPQP

SEQ ID NO: 17969 - DNA, 726 bp, Zea mays
  misc_feature: Ceres CLONE 1383466-F
  misc_feature: Encodes the peptide sequence at SEQ ID NO. 17970
  misc_feature (432)..(432): n is a, c, t, g, unknown, or other
tggagctccccgcggtggcggccgctctagaactagtggatcccccgggctgcaggaattcgcacgagaccattacccagaacatcctaatcgaaaaatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtaagcagagcaccaacgaatgcttgcaattaatatttgacaacttcttttcatatgcatgcgcgcgggcgtacgtacgtcattatgatgcgcccgcgccgctcgcatccgcatcgcaggtgggagaaccacgncgtggacgcgccgctgatggacgaggtcaagcgcttcgtctacggccactacgagggagcacctggaggccagttctacgcctccggcctcgccatggacctcaaggccgcaccaaaggggaactgatgaaagccctcccaccagggggacgggggatccacctatttattccaggacccccccaagaacaaaggtggcgaatttccaaaaatatccccgccccaacaaaaaaaccttggaccgttcactcccccaaagggtgcccccccgaggaggttggggaaaaggcttaa

SEQ ID NO: 17970 - protein, 50 aa, Zea mays
  misc_feature: Ceres CLONE 1383466-F
  misc_feature: SWISSPROT Homolog: EC 1.14.17.4 Aminocyclopropanecarboxylate oxidase
MTGPMEIPVIDLGGLNGGGEERSRTLAELHDACKDWGFFWVSRAPTNACN

SEQ ID NO: 17971 - DNA, 758 bp, Zea mays
  misc_feature: Ceres CLONE 1383473-F
  misc_feature: Encodes the peptide sequence at SEQ ID NO. 17972
  misc_feature (440)..(440): n is a, c, t, g, unknown, or other
aagctggagctccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctcagtacatcagcggtgtgatcctcttcgaggagaccctctaccagaagaccaggatggcanggcctttgtcgatgtcctcaagagggagcggtctccttggcatcaaggccgacaggggcaccattgagggtgttgggcccgacaaggaacccccacccagggccccatgacccccgggaaggcgtggcctaaaaaataccagggcggggccccccttttccaaagggggggttgttccaaaaatgggcccaaaagaccccccaaatttgccctttacccaaaagagccgggggtggggtctttacccccttttgggccccaaaaaaaaggttggggcccaattttgggacccccaaaaccttttgtgggggcgcccca

SEQ ID NO: 17972 - protein, 71 aa, Zea mays
  misc_feature: Ceres CLONE 1383473-F
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFCCPGALSTSAV

SEQ ID NO: 17973 - DNA, 711 bp, Zea mays
  misc_feature: Ceres CLONE 1383474-F
  misc_feature: Encodes the peptide sequence at SEQ ID NO. 17974
aaagctggagctccccgcggtggcggccgctctagaactagtggatcccccgggctgcaggaattctcacgataccattacctagaacatcctaatcgaaaaatgcacactcactcactccagtgcccactgcccactggccactggccgacgaggaagtttcacgatcccaacccgtataaatcgactccgcgaggggtagcgacgatcgatccccgtaattaacctgtcccagccgcaccgatccaccccccctcggtctcggtctccctccggccatggaggtgttctactacgtcgtgttcggcgcgctggccgtcgtcgtggtgtggctccagctcggcaagagcgtcaaggaccgcgtcgccaccacctccgcattcgactccttcaagaacaactacctgctcctctactccctcatgatgtccggcgactgtgtggaggggccctacgtctactacctctacagtcagtatggcttcgagaagggcgacatcgggcggctcttcatcgccggattcggatcctccatgcacttcggcaccatcgtcggctccctcgccgacgaacggggccagccgaggcgctgcgacacctattgcatcagctacatcctcagctgcatcactaagcactcccccgagtacgggggtctcatggacgggcggtatcgtcggggggatggccacttcggtgctcttctccgcc

SEQ ID NO: 17974 - protein, 144 aa, Zea mays
  misc_feature: Ceres CLONE 1383474-F
  misc_feature (4)..(144): Pfam Name: DUF791 Pfam Description: Protein of unknown function (DUF791)
MEVFYYVVFGALAVVVVWLQLGKSVKDRVATTSAFDSFKNNYLLLYSLMMSGDCVEGPYVYYLYSQYGFEKGDIGRLFIAGFGSSMHFGTIVGSLADERGQPRRCDTYCISYILSCITKHSPEYGGLMDGRYRRGDGHFGALLR

SEQ ID NO: 17975 - DNA, 693 bp, Zea mays
  misc_feature: Ceres CLONE 1383475-F
  misc_feature: Encodes the peptide sequence at SEQ ID NO. 17976
acccgcggtggcggccgctctagaactagtggatcccccgggctgcaggaattcgcacgagaccattacctagaacatcctaatcgaaaaatcttctagatatagtttctcttcttcttaaaacttcgtatagtccattttacggaaacggcagagtacacgcactgtgtcctagggcgagaaccccaatgaggatcttacccgagcctctaggttcggctccatgcctcattctcctcgaggcgtccgatctattatcagagactctatccctcgttcgtgtcggcaaatccggtggttacgccgagagcaaaatcaaaaatcgacatgcattgacaggactccgattgactgttgactgaaaggaggagacagggccttgtagctacaaaggctctgcaagcatcgatgaggaaaggaatgtccggtctgaaacgtcttcctcatgaccttatctctgacgacgtagccttaaaggcagcagcgttatgcccaggtttcacgggggcggcgggaggccccttgaccgggttccccaccgcccttgggaaagaaataagatcggggttcccataaccccaaccggggaaggaaatcacttggtgggccccccaaccaaaaagcccgggggggtataaccccgtgaacctctgggtgttcccacaaatttttttggggccacaaaaacaaaag

SEQ ID NO: 17976 - protein, 57 aa, Zea mays
  misc_feature: Ceres CLONE 1383475-F
MRILPEPLGSAPCLILLEASDLLSETLSLVRVGKSGGYAESKIKNRHALTGLRLTVD

SEQ ID NO: 17977 - DNA, 503 bp, Zea mays
  misc_feature: Ceres CLONE 1383481-F
  misc_feature: Encodes the peptide sequence at SEQ ID NO. 17978
  misc_feature (276)..(276): n is a, c, t, g, unknown, or other
  misc_feature (295)..(295): n is a, c, t, g, unknown, or other
  misc_feature (399)..(399): n is a, c, t, g, unknown, or other
  misc_feature (400)..(400): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (436)..(436): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
aaagtggagtccccgcggtggggcgctctagaactagtggatcccccgggctgcaggaattcgcacgagaccattacctagaacatcctaatcgaaaaatcttccaagtcaccaacgcatattgcaccaagaaatccatcgagaggccgtcgacaggcgaataatgggtctcgtctaggagagcaccgccgcctcatcctcgagccgcgtcctgtctcgtgctcgagctgcagcgcagcaccggacttctgcgtgcggggtgggcatcccgacaancggtcccgactggcggtgnacgggccacccgaactggggttcggccccgctccccgggccaatttaaaaggattttttccggaatttgggaaatcccgggatttgcggggacagggggtttannccgcgcctctgtgggggggcggggggggnnnaaaancccccgccgggnnnncccccggccccctttttggggggccccctaaaaaaacccggggttttccggg

SEQ ID NO: 17978 - protein, 53 aa, Zea mays
  misc_feature: Ceres CLONE 1383481-F
SGVPAVGRSRTSGSPGLQEFARDHYLEHPNRKIFQVTNAYCTKKSIERPSTGE

SEQ ID NO: 17979 - DNA, 795 bp, Zea mays
  misc_feature: Ceres CLONE 1383483-F
  misc_feature: Encodes the peptide sequence at SEQ ID NO. 17980
  misc_feature (30)..(30): n is a, c, t, g, unknown, or other
  misc_feature (31)..(31): n is a, c, t, g, unknown, or other
ttttcccccctcctcctctccccccctccnnacggttggagtagaggaacaagctggggctccccgcggtggcggccgctctagaactagtggatcccccggcctgcaggaattcgcacgagaccattacctagaacatcctaatcgaaaaacccgccgccgcctcttctacccgcaacaacggctgccccgagaccgagaacgcgtctcccggttccctttactgctcgcctcaggcccgcgtccctcgtcgcccgacggctgacggaggaggcgggggaggcgctgagcgcgttatccgccgcggagggcgacgacgaataccaagcgtagctccaggaggaagggtttccgagctgggcggtcgccggcgaggaggagtactacgaccacgaccccgaaatcgcagacattatgggggacctacttcgacgaccccaagaagggccaaacccgcatggaggataggataataaagaaacgccagtagatggcgcaaaccaagaccgggtcgccaaaccccatgaaggtcgccttccacagatttgacttctccaactccgatacatggggtcgaggtcatacaatgttcttgttgcccaacagcagggtaacgctagatcttccggattcacccggccccccccggcccctataggtttgggcccgcccctgggcgggcgcggccaactctcctattgaacattagggcatctttttgtcgccccacgcgggccccttttagaaaccggctaacaaaagggcggcgaaaccttcaacgggaaccggcttccc

SEQ ID NO: 17980 - protein, 55 aa, Zea mays
  misc_feature: Ceres CLONE 1383483-F
MAQTKTGSPNPMKVAFHRFDFSNSDTWGRGHTMFLLPNSRVTLDLPDSPGPPRPL

SEQ ID NO: 17981 - DNA, 746 bp, Zea mays
  misc_feature: Ceres CLONE 1383485-F
  misc_feature: Encodes the peptide sequence at SEQ ID NO. 17982
  misc_feature (412)..(412): n is a, c, t, g, unknown, or other
  misc_feature (540)..(540): n is a, c, t, g, unknown, or other
  misc_feature (576)..(576): n is a, c, t, g, unknown, or other
  misc_feature (597)..(597): n is a, c, t, g, unknown, or other
  misc_feature (637)..(637): n is a, c, t, g, unknown, or other
  misc_feature (746)..(746): n is a, c, t, g, unknown, or other
aagctggagctccccgcggtggcggccgctctagaactagtggatcccccgggctgcaggaattcgcacgagaccattacctagaacatcctaatcgaaaaacctggccgctccatctcgcgtccaacaatcaattcggcgtcgctctcgtctcatcagtcatcactccgcgactgcgagcgagcgagcgaggcccttccgcgccacgcgcaatggacgctgctctgctcgtgaccgtcctcgtccccgcggtggcggcgctcctcgtcctcggggccgcgtccgcctcgccgccgcgcgccttcttcgtgttcggggactccctcgtggacaacggcaacaacaactacctcatgaccacggcgcgggccgacgcgccgccctacgggatcgacttccccacgcacctgcncacggggcggttctccaacgggctcaacatccccgacatcatcagcgagcacctcggctcccagcccgcgctgccgtacctcagccccgacctccgcggcgaccagctgctcgtcggcgccaacttcngcgtccgccggcgtcggcatcctcaacgacaccggncatacagttcgtgaacatcantcgggatcgggcagcagctgcacaacttccaggcaccaanccagagggctgggccgcgttccgtcggcgacgacgcggcgaaggcaggtcgtgagcaatgcgctcgtcctcatcacgctcggcggcaacgacttcgtcaacaactactn

SEQ ID NO: 17982 - protein, 125 aa, Zea mays
  misc_feature: Ceres CLONE 1383485-F
  misc_feature: SWISSPROT Homolog: EC 3.2.1.51 Alpha-L-fucosidase
  misc_feature (67)..(67): Xaa is any aa, unknown, or other
  misc_feature (110)..(110): Xaa is any aa, unknown, or other
  misc_feature (122)..(122): Xaa is any aa, unknown, or other
MDAALLVTVLVPAVAALLVLGAASASPPRAFFVFGDSLVDNGNNNYLMTTARADAPPYGIDFPTHLXTGRFSNGLNIPDIISEHLGSQPALPYLSPDLRGDQLLVGANFXVRRRRHPQRHRXYSS

SEQ ID NO: 17983 - DNA, 688 bp, Zea mays
  misc_feature: Ceres CLONE 1383486-F
  misc_feature: Encodes the peptide sequence at SEQ ID NO. 17984
  misc_feature (402)..(402): n is a, c, t, g, unknown, or other
tccccgcggtggcggccgctctagaactagtggatcccccgggctgcaggaattcgcacgagaccattacctagaacatcctaatcgaaaagtaccatgttcaaaacgaacagtctgatctgaagccagcagacgtgaaaccgacggcacgtacgtacgtacgtgtgagggctgctcggcggccatgggagaatggtgcttcaagaaacgcgcagctctggtgattattgtggccattattagctcgctgcagctgctcctgataactgctcaagaagctggaggagaccacgaggtgtggtcgtcgtcatcctcgccggccggtggtcgtgtgtggcggcgccgtcgtcgtcccgacggcagcggatggggccggacggtcgctcctcccggggttcgggncaatgagggtttctcctgcatgcgaccacaacatggctccacccgtctgccacaggcgtgattccagcactaccatggatcctgatactgcgccctggaccgagctgggacgcacagccgtgaaccgctgtcctccgtctcggccgcgactggcgcgtcgagggacacgtcctcgactcccgcgagatgcgctgcgtcgccttctgaatacagatgaccgccggctcgggctgccgtaggggctccatccgctagtggctcagctccggccccgtccatttcctgc

SEQ ID NO: 17984 - protein, 92 aa, Zea mays
  misc_feature: Ceres CLONE 1383486-F
  misc_feature (73)..(73): Xaa is any aa, unknown, or other
MGEWCFKKRAALVIIVAIISSLQLLLITAQEAGGDHEVWSSSSSPAGGRVWRRRRRPDGSGWGRTVAPPGVRXNEGFSCMRPQHGSTRLPQA

SEQ ID NO: 17985 - DNA, 662 bp, Zea mays
  misc_feature: Ceres CLONE 1383490-F
  misc_feature: SWISSPROT Homolog: EC 3.4.21.92 Endopeptidase Clp
tccccgcggtggcggccgctctagaactagtggatcccccgggctgcaggaattcgcacgagaccattacctagaacatcctaatcgaaaaaaatttcatagtctttcgaagtcgatatttaatccccaaaatgaggaatgataaacctcaccgactgcgaaaactatcctccctcgtaagaaaagatgtctcctgcttgttctcaaacatcggctagtacactccatgcgtatatgcatatcctcctgagggagctcgacggactcttccgtcgagtcgcatcagattttcctccctttcgagcctcgtggatcaataaagatcaagaacttacttatgcgtctcaacaactgcaagatctcctctcccaaggctgtgtactccagcaagctcccgatctcggatacccatttccctataggagcctccgccaccggagaagactcacaagtcaattcttgttgctattttcctgaagatgctccgagataaggatcacctcatatggtgcgagagcgataccggagtatgagagaccagctcttccaatatatgactattctccgcgcagatgatgttgactgacgtctgatccacctcgtcgtacgtgagatactctacgttgacgatgatgcacctactagacatatcgtcatgcatg

SEQ ID NO: 17986 - DNA, 751 bp, Zea mays
  misc_feature: Ceres CLONE 1383494-F
  misc_feature: Encodes the peptide sequence at SEQ ID NO. 17987
  misc_feature (454)..(454): n is a, c, t, g, unknown, or other
  misc_feature (459)..(459): n is a, c, t, g, unknown, or other
tggagctccccgcggtggcggccgctctagaactagtggatcccccgggctgcaggaattcgcacgagaccattacctagaacatcctaatcgaaaaagattccgcattcctctctgtcacctccgctgcgccgccagcccgccatcacataacttcgccttctatcccttcgtaaacccttctctcttcttcccgcggcctgctcgttcgatctgtccagcagacttgaggttccgagcggccggaaaccagcggcaaacgtcggcatggcgctcgtattgcattctggggctggaaacaaaaatgccttcaaggcacttattgctgcagaatacagtggggtcaaggttgagttgaccaaggattttgagatgggtgtctccaacaaagacccctgagttctaaagatgaaaccccttgggaaaggtccctgctctgaagactcctgatggncctgnttttgagagaatgctattgcgcgctatggtgctcgccttgaaggatgacacccctcttttcgggtcctcccgtattgaacaagcccaccgttggacaaggggatggactttgcttgaaacgaaggtggaacccaaagggttgaagggaaccttggattccaaggtttgggaaaatccccttatggcccccaccacttggaggaaaaggttattgcttcattgaaaaaaaccccctgggggtctagaaaaacaaattttggcctgaaaacacaaaccttgggggagaattcgg

SEQ ID NO: 17987 - protein, 43 aa, Zea mays
  misc_feature: Ceres CLONE 1383494-F
MALVLHSGAGNKNAFKALIAAEYSGVKVELTKDFEMGVSNKDP

SEQ ID NO: 17988 - DNA, 739 bp, Zea mays
  misc_feature: Ceres CLONE 1383497-F
  misc_feature: Encodes the peptide sequence at SEQ ID NO. 17989
  misc_feature (323)..(323): n is a, c, t, g, unknown, or other
  misc_feature (426)..(426): n is a, c, t, g, unknown, or other
agagctggagctccccgcggtggcggccgctctagaactagtggatcccccgggctgcaggaattcgcacgagaccattacctagaacatcctaatcgaaaaaattagccagcccacctctgctctgcgggcgcttcagatggaagcactagccattggatccgcgcctcgccgtccgggcgcaaggtactcccaactccgccgccccggaaccctcgccgtcaccaccacagccacagttgcatgccgccccctcacggcgccctccatggacgccgccgttggccgcccgagccgcgcgcctatccgctgcaccagcgcgnagacggactcggtggatgaggtcgcgacgagctcgcacgccgcggagggccacgcggggggcaccacggagcaagagggcaacggaagcccctgggcccgcgntgccgggtactcccccggggtccccggggtcaagggaaaaggatccggggggggcccggacggggcccggggggcctaagggggccccgttccgttcccccccaaaaaagggggaaacaccccgggaaaatccccgaaaaaatctttggaaaaagggccccggggttttccaaaaaaagggaaaaggcccccgtaacatggtaaagagccccctttagggggtcccccccccaaggaattttttggggggggccaagaggccccaaaaaaaaaagggtttgtcgtctttttttggggggggaaaaaaatctcc

SEQ ID NO: 17989 - protein, 78 aa, Zea mays
  misc_feature: Ceres CLONE 1383497-F
  misc_feature (19)..(19): Xaa is any aa, unknown, or other
  misc_feature (53)..(53): Xaa is any aa, unknown, or other
MDAAVGRPSRAPIRCTSAXTDSVDEVATSSHAAEGHAGGTTEQEGNGSPWARXAGYSPGVPGVKGKGSGGGPDGARGA

SEQ ID NO: 17990 - DNA, 693 bp, Zea mays
  misc_feature: Ceres CLONE 1383498-F
  misc_feature: Encodes the peptide sequence at SEQ ID NO. 17991
  misc_feature (460)..(460): n is a, c, t, g, unknown, or other
  misc_feature (515)..(515): n is a, c, t, g, unknown, or other
  misc_feature (558)..(558): n is a, c, t, g, unknown, or other
  misc_feature (563)..(563): n is a, c, t, g, unknown, or other
  misc_feature (623)..(623): n is a, c, t, g, unknown, or other
  misc_feature (632)..(632): n is a, c, t, g, unknown, or other
  misc_feature (671)..(671): n is a, c, t, g, unknown, or other
aaactggagctccccgcggtggcggccgctctagaacaagtggatcccccgggcttgcaggaattcgcacgagaccatttacctaaaacatcctaatcgaaaaaggcgagctggggaagacgcaaggtactgcggctgcgcgcgaggggtcgtcggacgaccgacgaggacgagcggcataggcgcgtgcatggcgctcacgaactttcatcctcacggtgggtgggggtgggcgcggcggtgatgctgctgcggaaagacgtcaagcagtcggccaccgtcttccgccgcaacgtgcgccacatccgcaactggctcgaggaggagtccgccgccgccgccaaatctactgaacagtcttcagtgaaggagttggagtcccaagctgccaagaaagacgctgtgcccaaggacgacaaacattagatgatcttacaccctgtttcttgtaatgcgttgncaagtttgaggtccaggatttttgaattggcctttaaaaaaatgtatgtgttganggaccttttaagtctggttggaaattttactgaataatggagnactcnttaaagggttcaggttcttggaaaggggatcttatatctcaatgagaatttattgatggntggatatcntgcacatcaaaaaaaaaaaaaaaaaagttatcatacggncgaaccccctgacagggggggg

SEQ ID NO: 17991 - protein, 60 aa, Zea mays
  misc_feature: Ceres CLONE 1383498-F
MLLRKDVKQSATVFRRNVRHIRNWLEEESAAAAKSTEQSSVKELESQAAKKDAVPKDDKH

SEQ ID NO: 17992 - DNA, 752 bp, Zea mays
  misc_feature: Ceres CLONE 1383502-F
  misc_feature: Encodes the peptide sequence at SEQ ID NO. 17993
  misc_feature (529)..(529): n is a, c, t, g, unknown, or other
  misc_feature (549)..(549): n is a, c, t, g, unknown, or other
  misc_feature (649)..(649): n is a, c, t, g, unknown, or other
  misc_feature (669)..(669): n is a, c, t, g, unknown, or other
  misc_feature (670)..(670): n is a, c, t, g, unknown, or other
  misc_feature (722)..(722): n is a, c, t, g, unknown, or other
  misc_feature (730)..(730): n is a, c, t, g, unknown, or other
  misc_feature (744)..(744): n is a, c, t, g, unknown, or other
aagctggagctccccgcggtggcggccgctctagaactagtggatcccccgggctgcaggaattcgcacgagaccattacctaaaacatcctaatcgaaaagacctccccagtctaatccgattcaaaccgtccgccccccgtgtccgagcctagcaaggcgcaggccaacccccaatagccagctgttcgcagctccacgcgatggatgacaaagagactaccgcgaagaacctacatcacatctccacccccacccaccggcaaccccctcagccctccagcttctccaacgccctatcaggtgaacctgtgaagcctatgctcctgcgacaaggggccgtacagcgtctcaggcgctgacaggaggcgacactgatcccgatgagcgcgatgctgttggtgctgacaactctgtcgctgacggctccgacgatgctggctggccgggtccacccccctgttcctgatcttcagccccgggctggtccccgccgcgttgctcatcgggacggccgtcatgggtcccntcacgtggggcgcgctgggnggctccgggggcctgtccctcggtcacgtgcctcgccaaacgggcgggggcaggcgttccagcgcacccgggactaacgggggaggaggcgcaccgcagngaaaggggggaggcccgcgnncgccacgcggggccacaaagaccggcgcaggcagggcaggccatcccagggnagaggcgncaggagggcgcggnccgccggt

SEQ ID NO: 17993 - protein, 77 aa, Zea mays
  misc_feature: Ceres CLONE 1383502-F
  misc_feature (4)..(4): Xaa is any aa, unknown, or other
  misc_feature (44)..(44): Xaa is any aa, unknown, or other
  misc_feature (51)..(51): Xaa is any aa, unknown, or other
  misc_feature (68)..(68): Xaa is any aa, unknown, or other
  misc_feature (71)..(71): Xaa is any aa, unknown, or other
MGPXTWGALGGSGGLSLGHVPRQTGGGRRSSAPGTNGGGGAPQXKGGGPRXPRGATKTGAGRAGHPRXEAXGGRGPP

SEQ ID NO: 17994 - DNA, 749 bp, Zea mays
  misc_feature: Ceres CLONE 1383504-F
  misc_feature: Encodes the peptide sequence at SEQ ID NO. 17995
  misc_feature (405)..(405): n is a, c, t, g, unknown, or other
  misc_feature (410)..(410): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (614)..(614): n is a, c, t, g, unknown, or other
  misc_feature (616)..(616): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (636)..(636): n is a, c, t, g, unknown, or other
  misc_feature (640)..(640): n is a, c, t, g, unknown, or other
  misc_feature (642)..(642): n is a, c, t, g, unknown, or other
  misc_feature (643)..(643): n is a, c, t, g, unknown, or other
aaagctggagctccccgcggtggcggccgctctagaactagtggatcccccgggctgcaggaattcgcacgagaccattacctagaacatcctaatcgaaaatccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggncacgncgagttgaactaccccagctcctttatcagtagcagagcatgctactctatgtacttttggaacctaagctaatagacctgtcaggggtagatggctggatcttggcatttttgaagaataacattttacctcggtcaaggaggcaagataatttctgggttacctggccttaacttttatttttaaaannnnncnnnnnnnananaaaaaaaaaaaannnnnnanaaananncccccccaaaaaaaaaaaaaaaatttttcttcccccgcgccccccggagggggggggcgggaccccatttcccccaaaagggggcggattaccccccgccccccgg

SEQ ID NO: 17995 - protein, 69 aa, Zea mays; identical to SEQ ID NO: 8575
  misc_feature: Ceres CLONE 1383504-F
  misc_feature (2)..(69): Pfam Name: Ribosomal_L38e Pfam Description: Ribosomal L38e protein family

SEQ ID NO: 17996 - DNA, 685 bp, Zea mays
  misc_feature: Ceres CLONE 1383505-F
  misc_feature (437)..(437): n is a, c, t, g, unknown, or other
  misc_feature (549)..(549): n is a, c, t, g, unknown, or other
  misc_feature (550)..(550): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (569)..(569): n is a, c, t, g, unknown, or other
  misc_feature (576)..(576): n is a, c, t, g, unknown, or other
  misc_feature (577)..(577): n is a, c, t, g, unknown, or other
  misc_feature (584)..(584): n is a, c, t, g, unknown, or other
  misc_feature (586)..(586): n is a, c, t, g, unknown, or other
  misc_feature (587)..(587): n is a, c, t, g, unknown, or other
  misc_feature (589)..(589): n is a, c, t, g, unknown, or other
cgcggtggcggccgctctagaactagtggatcccccgggctgcaggaattcgcacgagaccattacctagaacatcctaatcgaaaaatccaggcagcacagctccctccccactcgaggctccgagctttattttttcttgttttgttttgttttcttggtaggagtaacaatagtttctggcagccttcttcctcctcgctctctacccgaggagagaggagaggagagaaatccggaggcaaagcttcagggtttgtataaagggattctagatctaatcgactaaccagagagaaaaaaaaacaaaaaataacgcgagaaagcatgagccacttcgccgccgccgccgtgaagagccccctcgccgtggccgcgcccgccgccggcgacgccaagagcccgctcttctgccccaagccgcggtgccccgcggngccccttgcggtgccaccagggcggcgacgccgggcatggatctgctcgacctcctcctgcaaagcacagttgtttagggtgatgaacagtgaccatgacccttatctgggnngnnnaaaaaaaaaaaaaanaaccccnnccctctngnngncctccatgtagggtccccctgtgcggccacataggattgttcttggagtggccgatacatctagcctgtcgatctcccctatttcctattcccttg

SEQ ID NO: 17997 - DNA, 664 bp, Zea mays
  misc_feature: Ceres CLONE 1383516-F
  misc_feature (234)..(234): n is a, c, t, g, unknown, or other
  misc_feature (361)..(361): n is a, c, t, g, unknown, or other
aagctggagctccccgcggtggcggccgctctagaactagtggatcccccgggctgcaggaattcgcacgagaccattacctagaacatcctaatcgaaaaacagacaacaacgagttaacgaaagccttttatccaagctcagggaagggaagctcacagtttcgttggatccaatcttttatccaagctcagcgatggcttctcgtcagcagcatcctactagctaccacgnccgcgagaccaagggcccgtgccgagagaaagacggtcaagtgatgcgggcgacgccaagagaaaagggaaggagggccaagaccaaggggtccggaaggcttccgaccgcggcatgggaaatgggncacgacggccctggaaggggaacaaagaaaaaagcgcgcggccgccccggaacccaaacaatggggaatgggccccaacacccgggaaggagggcccagggaaaagggggttacaggggccaggaagcgggcctcccgttgcccctttggcgccgccaaggaaaacttgggcctaacaaaggccgggggttttccggggaaacccccccccccccaagggggggcaaaaaaaaccgggggttaattttcggcaaaaaagcgcgaagggggccccggcaaaaaaaaggggcggcggccccccct

SEQ ID NO: 17998 - DNA, 723 bp, Zea mays
  misc_feature: Ceres CLONE 1383527-F
  misc_feature: Translation starting site: 205
  misc_feature: SWISSPROT Homolog: EC 5.5.1.4 Inositol-3-phosphate synthase
  misc_feature (580)..(580): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacagcggcgcccacgccacctacgggcagcagcagcagcagggaggaggcgggcgcccgatgggtgagcaggtgaagggcatgctccacgacaaggggccgacggcgtcgcaggcgctgacggtggcgacgctgttcccgctgggcgggctgctgctggtgtggtcggggctggcgctgacggctccgcgggtggggctggccgtgtccacgccggtgttcctgatcttcagccccgtgctggtccccgccgcgctgctcatcgggacggccgtctatgggtcccctcacgcagagcgcggtgggggcctagtacgaccgccccctcacccagtgcctccaccaacangaggagggagtcagtacagcgaacccagatatgacgcggggggagagcctcctacccatggggaagccagacgagcttgtgtttggaggatgggacaatcacggcatgaacctgggagatgccatgaccaggggcaaggtgct

SEQ ID NO: 17999 - DNA, 729 bp, Zea mays
  misc_feature: Ceres CLONE 1383528-R
  misc_feature (409)..(409): n is a, c, t, g, unknown, or other
tcgattgggtaccgggccccccctcgaggtcgacggtatcgataagctttttttttttttttttatgaaccaatgaataaataccatttatattcatgaatagatatcgtactagattaggattctaatgatgtccatcacatgaaacacaacatgccatctcaagtcagataacacctggactctgagaacagtctacctaacaaacggctgcctcaagcattcaaactttcttgactaccccgacaagcaaacatagactgatagaccctagcaaatgtcatgctcgccttccattacattatacgtgcaaacgctagcacgaacgtatcttcgattacttgatctccactgcagctgccagatgggcgagctttgctacttcggaactgcttccctgaaaacttcntgaaaacagaccctaagcttgatttcacccgcggaaaagggttgcgctaacaaggaatttcgggaccctgattacttttttccaaaatttctaaacccttgggggggttttaagggtttcgccccaaaggggaaccccctttgaaggggggcccggtttctcaaaaaaccaaaacccccccccagaaggggccccgtttcccaaaaaaatttgttttaagcggggtttcccaaaaaaaaaaaaaaaccccccccctcttttctaaaaggggtggcccgagggggccccccaaaaaaaaaaaaaaaaatttttttggggtg

SEQ ID NO: 18000 - DNA, 676 bp, Zea mays
  misc_feature: Ceres CLONE 1383528-F
aaagctggagctccccgcggtggcggccgctctataactagtggatcccccgggctgcaggaattcgcacgagaccattacctagaacatcctaatcgaaaaacgaagtctttctgaatcgcgagcggtgaaaccggtcgtctctactcctccacacattccttgttgtctggtagcagaaatgatcgaccgcacgatcaggttattatatctgtgcgaatgtgaactcccctcgccgagtcatatgctcctcgtcccctcaagaactgtaccatcacgcaccgcctttgattgagcaagtactgtgagagaggagatgagaggatgaaaggagttaagattacgctacttgatgactgtgtgattcacaggatccggcgtgcttgcacacgcacactgctaggaggagtcactgtcaggagcgactaccgtctttttacacatccgagtcaccgggatcttcgttcggtactaggcgtagaccaagatgatgacgaaaaaatgcccaggctcatcaaaaaggttccggaggatggcctaaccggtagggtgccaataaaaccagggggggagctcccgtaatttgcaaaaaaaaagtcatcgccccggccgagctaaaggccctaaacgggggaggccccctcaaaaaaaaaagaaaaaccccttccccgacccc

SEQ ID NO: 18001 - DNA, 658 bp, Zea mays
  misc_feature: Ceres CLONE 1383529-F
  misc_feature: Translation starting site: 204
  misc_feature (504)..(504): n is a, c, t, g, unknown, or other
  misc_feature (653)..(653): n is a, c, t, g, unknown, or other
tggcggccgctctagaactagtggatcccccgggctgcaggaattcgcacgagaccattacctagaacatcctaatcgaaaatttgcacttctcgccttctctaatctctttgcctctttggctccctccagcaccagtccaccatcactgctacccaacccttgcttccccaaaccctaggcaagggacacggtggccgacgatggaagtggacggaggaggcgctggtgcgctgcaccaccacacgcgctcacctcgtaggacgtcgtccgcgatttccgcgcgcgccgaaccggcatcggcaaggcgctcaccacggatagtggagaagatctatcagcagtgctatccagagaaagagaacttgtgccctttatggcttgccaaatgacacttgtaaggtcactcttcccgctgaggaagtacctcctgagcttccagaaccagcactggggataaactttgcctcgtgatggaatgtgcgacaaaagactgctatgctnctagttgcacatcatagtgacgcatgccctcctgcgtggtgcattcctaactttggaggctcggtaggggatttggacaaagatgccaagtagaaggctcttcatcatgatagcaacccctgcccactttttttaatgagtttttgggngacgg

SEQ ID NO: 18002 - DNA, 642 bp, Zea mays
  misc_feature: Ceres CLONE 1383534-F
  misc_feature (90)..(90): n is a, c, t, g, unknown, or other
  misc_feature (185)..(185): n is a, c, t, g, unknown, or other
  misc_feature (194)..(194): n is a, c, t, g, unknown, or other
  misc_feature (204)..(204): n is a, c, t, g, unknown, or other
tccccgcggtggcggccgctctagaactagtggatcccccgggctgcaggaattcgcacgagaccattacctagaacatcctaatcgaanactggtcctccattcaagctccactactccacacctagacttcccaatcctccattggggcaacctgtcacacagtacgccgtcgcctgtggttnggtttgtgnagtgagaganaaagagagagagagacttagactcggactcgaaaagaaagagatgatgtcaagggagcgcaagaggcggctgctcctcaggaaaagttgagaaaactcgggtccattaataattcccacggttttgggaaaacgcgcaaaaatctgggaacggcgggggtaaactcagggagtttaaacaaaaagggggggggggggaaaccaaaaaaatttgggggggccaaaaaaccccttttaaaaaaaaggggttttccttttcccccccgggccccgggggaaaccccaaagagggggagggggcgccccttttgtggaaaaaggttttccccaaaaaaaaaccccggggggtggctccccccgggggggggggccctccacaaaaagggggggaaaaagggtgccaaataaaaccccggttggggggggaaaatttttcccc

SEQ ID NO: 18003 - DNA, 669 bp, Zea mays
  misc_feature: Ceres CLONE 1383535-F
  misc_feature: Encodes the peptide sequence at SEQ ID NO. 18004
  misc_feature (520)..(520): n is a, c, t, g, unknown, or other
  misc_feature (549)..(549): n is a, c, t, g, unknown, or other
  misc_feature (602)..(602): n is a, c, t, g, unknown, or other
  misc_feature (664)..(664): n is a, c, t, g, unknown, or other
  misc_feature (669)..(669): n is a, c, t, g, unknown, or other
aagctggagctccccgcggtggcggccgctctagaactagtggatcccccgggctgcaggaattcgcacgagaccattacctagaacatcctaatcgaaaaaggattttgtttcgggtgaggtggggggcggcatggcgccacccgccgctcaggctcagctcctcctctccaaccacccctcgccgttgctgtcgccgccgcaacgtcgtcgcctcctcggtggaccgccgcctcgctcacacacctgcgccatccggcaccaccacggccacgacaagtgcgcctcctcctcctccactcgccttcgccacgccctccgcccgcccgccgccaccgccgtggccatcgcgcccggcgaccactggggaaactgggccttcctcctctccgccgccgcgttcggcacatgggcggaggagaacacgtcgtggggcgccgcgctcagcggcgcgctggttagcatcatggccggcctggctgccacggccgtcggcctcgtcacccccggggcgcccggncacgacgccgtcatggagtacctgctggncggccgccgtcccgctgctactcctcggcgcgacctccggccgcgtcgtccgnaaccaccggcgacctcctcaagcattcctgggcttcggatctggttgcaactgtatccgggncacgn

SEQ ID NO: 18004 - protein, 178 aa, Zea mays
  misc_feature: Ceres CLONE 1383535-F
  misc_feature (139)..(139): Xaa is any aa, unknown, or other
  misc_feature (157)..(157): Xaa is any aa, unknown, or other
MAPPAAQAQLLLSNHPSPLLSPPQRRRLLGGPPPRSHTCAIRHHHGHDKCASSSSTRLRHALRPPAATAVAIAPGDHWGNWAFLLSAAAFGTWAEENTSWGAALSGALVSIMAGLAATAVGLVTPGAPGHDAVMEYLLXGRRPAATPRRDLRPRRPXPPATSSSIPGLRIWLQLYPGH

SEQ ID NO: 18005 - DNA, 660 bp, Zea mays
  misc_feature: Ceres CLONE 1383540-F
  misc_feature: Encodes the peptide sequence at SEQ ID NO. 18006
  misc_feature (638)..(638): n is a, c, t, g, unknown, or other
  misc_feature (644)..(644): n is a, c, t, g, unknown, or other
ggagctccccgcggtggcggccgctctagaactagtggatcccccgggctgcaggaattcgcacgagaccattacctagaacatcctaatcgaaaactctccagtctccagcctccatcagtccaggtcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcggttgctgaggtgctccggccttctcctgccctccgcgtatcggaggatggaaagaagattggtagagctagtgaactcttgaagccagatgagatcatagaacaagtagactctagggactattgctgtatctccgctgccttgcaatgaaggccaaggaagacgtccaatcttttttcacaaattatgcaaaggtaaataagcgtgagacttccacgcaatattgccacaaaaacacttnctgtgnactgcttttttggttt

SEQ ID NO: 18006 - protein, 130 aa, Zea mays
  misc_feature: Ceres CLONE 1383540-F
  misc_feature (17)..(89): Pfam Name: La Pfam Description: La domain
MAAPAAAPLDEGKAKKVLRQVEFYFSDSNLPRDKFLRETVEQSDDGLVSLPLICSFSRMKSHLGLDADVKPETVPEETVLAVAEVLRPSPALRVSEDGKKIGRASELLKPDEIIEQVDSRDYCCISAALQ

SEQ ID NO: 18007 - DNA, 743 bp, Zea mays
  misc_feature: Ceres CLONE 1383541-F
  misc_feature: Encodes the peptide sequence at SEQ ID NO. 18008
  misc_feature (367)..(367): n is a, c, t, g, unknown, or other
  misc_feature (573)..(573): n is a, c, t, g, unknown, or other
  misc_feature (577)..(577): n is a, c, t, g, unknown, or other
aagctggagctccccgcggtggcggccgctctagaactagtggatcccccgggctgcaggaattcgcacgagaccattacctagaacatcctaatcgaaaaattccgtcgtcgtcgtcagcagcttctgcttgctctggggggaaggagagagagagagcgagagagagatctagtagagaggctagctaggtggtcctcgaacgaagatgttggcggtgttcagcgggcaggtggtggaggtgccggcggagctggtggcggcgggcagccggacgccgtcgcccaagacgaaggcgtcgcagctggtggggcgcttcctggccgcctccgagccggccgtgtccgtgcagctcggcgaccacggncacctcgcctactccccacacaaccaggcgctcctccgcccccagtcgttcgcggccaaggacgagggtgtctgcctggtcgagggggtgctggacaccctgggtcgtctgagccagcagcacgggctgtcaagcaagggcgcccaacgagtgctcctcgtcatcgaggcctaacagacgctgggggaccgggggccctacccggncagnttcatgctcgcccaggttacggggtcctacgccttcgccttcttgaaaagtccaccaatcccctggtaagcggatcccgcccccgaggggcggggggcgccctttgggggaaacccgcccagggtggggggccctttccccaagaataaaatggttagaggttttg

SEQ ID NO: 18008 - protein, 110 aa, Zea mays
  misc_feature: Ceres CLONE 1383541-F
MLAVFSGQVVEVPAELVAAGSRTPSPKTKASQLVGRFLAASEPAVSVQLGDHGHLAYSPHNQALLRPQSFAAKDEGVCLVEGVLDTLGRLSQQHGLSSKGAQRVLLVIEA

SEQ ID NO: 18009 - DNA, 689 bp, Zea mays
  misc_feature: Ceres CLONE 1383543-F
  misc_feature (621)..(621): n is a, c, t, g, unknown, or other
  misc_feature (663)..(663): n is a, c, t, g, unknown, or other
  misc_feature (664)..(664): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
aaagctggagctccccgcggtggcggccgctctagaacaagtggatcccccgggctgcaggaattcgcacgagaccatttacctagaaacatcctaatcgaaaagaagccagagaaaaggttactccgcagaaagcaaaaccctagcccactccggcgcgccaccggccgatggtttcgatgagcaccacgccgaagccgcttgactccgccgtcgtcagcgcagccgttgacggcggggatgagggtggtggtggaggcggtggcgggaagaagcaggcgcacggggcggtgatggcgccgccaccgtggggtgggtcccggccgcggcgcccgcggccgaggaggaggttcggaaggtcaggaagccgtacaccatcaccaagtcgcgggagagctggacggagccggagcacgacaagttcctcgaggccctgcagctttttgatcgtgattggaagaaaattgaagcatatgttggctcaaagactgttatacagataaggagcgatgcacagaagaccttcctgaaggttcagaaggaatggtacgggcgagcatctgcccccacccaggccaaaacgaaaggcagctcatccatatccacagaaaggcatctaanaatgtttctcaagctattttatcacaaaacacctaccaaagnngggnnnncaagggtctgtcatgcct

SEQ ID NO: 18010 - DNA, 701 bp, Zea mays
  misc_feature: Ceres CLONE 1383546-F
  misc_feature: Translation starting site: 181
  misc_feature: SWISSPROT Homolog: EC 3.5.3.9 Allantoate deiminase
  misc_feature (537)..(537): n is a, c, t, g, unknown, or other
  misc_feature (545)..(545): n is a, c, t, g, unknown, or other
  misc_feature (547)..(547): n is a, c, t, g, unknown, or other
aaagctggagctccccgcggtggcggccgctctagaactagtggatcccccgggctgcaggaattcgcacgagaccattacctagaacatcctaatcgaaaaacaacccctgtgggaggagccagagccagagccagccagccagacacacaacctcggtcggcgcggcggctcaacccaatggctccttcctccctccgcccgccgcgccaccacccgtctcccctcgtcgtcctcgccatcgccgtcctcctcgtcttgcgcaccgccgatgggctgccggaggcgggaggaggaggaggaggcggcggtctgtaccgggagattctcagggacgagaccgtgcagaggctcaaggagctgggcaagatatctgatggggatggctaccttgaaaggacgtttctgagtccggcctctatcagagccactggtgtcatcgtcagctggatgaaagacgctgggcttacgacgtgggtcgatcagatggggaatattcatggtcgatatgagccggcaaatctaccagagatgccntggtgatngnatctcatatggacactggtcgtgatgctgggatgtacgatggagccttgggtattatttcagcaatctcagcactgaaggttttgaaagttaacggggaacctccagaggttaccgaagacagggggaggccatttgcatccaggaaggaggaa

SEQ ID NO: 18011 - DNA, 670 bp, Zea mays
  misc_feature: Ceres CLONE 1383551-F
  misc_feature: Translation starting site: 107
  misc_feature (589)..(589): n is a, c, t, g, unknown, or other
  misc_feature (595)..(595): n is a, c, t, g, unknown, or other
  misc_feature (626)..(626): n is a, c, t, g, unknown, or other
  misc_feature (665)..(665): n is a, c, t, g, unknown, or other
tgaagctccccgcggtggcggccgctctagaactagtggatcccccgggctgcaggaattcgcacgagaccatttcctagaacatcctaaatcgaaaaaaaaaaagatggcccctaaattagtctttgttcttcctgttgtgctcctcgccttggcgctgcaggcgatcctccggccaccgccgccaaagctctgtggctccccaggtggccctcctctgacatctcccaggatcaagctcagggacggaaggtacctttgcgtacaaagaggatggagtacagagagacaaggccaggtacaagatcatcacagtgcacgcatttgatagcaccaaggactttcccctcgcctgtttctaaggagctcgtggaaggactgggaatttacctccttgcttatgacagagcttgatattggggaaagtgaccccaatcccaaccggcattgtcaagagcgaggcgctagatttcgaggagctttgccgaccagcttggctttggccacaagttctattgtgctaggggcctcaatgggaggatacttcggtttggggatgcctccagtatatacctcacaggcttgcagnagctgnccgctggttgtgcaatttatcaactactggntggccttcgttcccagttgatttatccaagcaggcttcnacaag

SEQ ID NO: 18012 - DNA, 817 bp, Zea mays
  misc_feature: Ceres CLONE 1383554-R
gggtaccgggccccccctcgaggtcgacggtatcgataagcttttttttttttttttttagaaacgcgtaactggatgctgatgagctatcaaaaatgcactctttaaatacaggaaagatgtcccagggaaaactgaaggactaatgtcaaaatcccacggaattgatgcaatggtacaggcaccattggcgattatactaaaatctgggaggactagaggaaacatacagcaatacggccgtggaaaatgcccttgctctaatagtagttttggttgccccgtccacggccgccacccattcgtacacggcctctaacatagcccctgccgccagggccacctgcgcctctgccaccacggtcatatccaggaccaccatagccccaattgcctcgtcctcggccgccaccgcctctgttccggatgtagttccagcctccattttcatatcctccatatccaccttggttgtaaccataaccgccatagccaccttggtcgtggccatatcctccctggtgttccatatccaccttgatgtccatatccaccgtggagatcatacccaccataacctacttggttgttatcatattcatatccaccatagcctccgccgtacccacccctagtaccccagccacttcctcggcacctgcttctgcctcggccgcgtccatatgaatctgtttgaacttgatgttgtcttggctggtactgttgatattgctgacgttgcaaatatctttgtggcttaagatcccaatgtggaggagcttgatacccaggtgaattcttggtatgctcccttagg

SEQ ID NO: 18013 - DNA, 736 bp, Zea mays
  misc_feature: Ceres CLONE 1383554-F
  misc_feature: Translation starting site: 169
aaagctggagctccccgcggtggcggccgctctagaactagtggatcccccgggctgcaggaattcgcacgagaccattacctagaacatcctaatcgaaaaaaccaccaccactggacatcagcctacgaattagctcatcgactccagattgcagaactctacaccatgaacgagctgatcgttgcccttgctctcctggggctcgctgccagcgccttctctagaacaacaggagggtgtgcatggcagacaccacccgtttgtctaccgcctccgttctatatgccaactccgatctatctgccgccgcagcagcagacgcagccatgccaataccccactcatccaccgcatgtaatcccgagccacaatctcggatcctgccgcaactacatcgcctacagcacgtccctgggccagtagcaacaagttcctgagataccagtgcaggccatgggagacgccctacggatcgccacagtgactgctgctgccacagcaaagctgccacctgatctggctcgtgaagccgctgcaccgtctaccagcatcatagatggatggtcatgcagtccttgctgcactagcaccctcagggcagactcgcggtgctgatggagtaccatgtactcgtcacctgacggcgatgtgaagactgcacctggaataaacatcccctagcccttgaactcagctgccgggtagcctactactgagaaaatatgcactgcag

SEQ ID NO: 18014 - DNA, 668 bp, Zea mays
  misc_feature: Ceres CLONE 1383555-F
  misc_feature: Encodes the peptide sequence at SEQ ID NO. 18015
  misc_feature (242)..(242): n is a, c, t, g, unknown, or other
  misc_feature (323)..(323): n is a, c, t, g, unknown, or other
  misc_feature (324)..(324): n is a, c, t, g, unknown, or other
cgctctagaactagtggatcccccgggctgcaggaattcgcacgagaccattacctagaacatcctaatcgaaaactgcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttncgaagacgaatgcattttttggtggacgagcaggacaatgttgttggccatgagtcaaagtacaactgccatttgatggannagattgattctgagaatctgctacataggggcattcagtgtggtcctttttcaactcaaaaataatggagctggcactttccaggcaaaaggtcccgccgaccaaggtgtaccttttcccttttaaatttggaacaaatacctggtggcagccaccctctgggacccgggaggctgggcttattccgggaaaactaccttgggggggggaaatggggcccccgagggagcttacggggaggagcttgggaatccccaggagaaaaaggcccccagggtgaccaattcaccccctttggggccgaaggggttttaaaggcccttttggggggggaaagggggggg

SEQ ID NO: 18015 - protein, 68 aa, Zea mays
  misc_feature: Ceres CLONE 1383555-F
  misc_feature: SWISSPROT Homolog: EC 5.3.3.2 Isopentenyl-diphosphate Delta-isomerase
  misc_feature (20)..(20): Xaa is any aa, unknown, or other
  misc_feature (47)..(47): Xaa is any aa, unknown, or other
  misc_feature (48)..(48): Xaa is any aa, unknown, or other
MAAAVVDDAGMDAVQKRLMXRRRMHFLVDEQDNVVGHESKYNCHLMXXIDSENLLHRGIQCGPFSTQK

SEQ ID NO: 18016 - DNA, 705 bp, Zea mays
  misc_feature: Ceres CLONE 1383556-F
  misc_feature: Translation starting site: 216
  misc_feature (379)..(379): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (570)..(570): n is a, c, t, g, unknown, or other
  misc_feature (578)..(578): n is a, c, t, g, unknown, or other
  misc_feature (643)..(643): n is a, c, t, g, unknown, or other
cgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatctaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcantgatgtgggtgctgtacgggctgccgctggtgcacccgcacagcatgcgtggtggtgaccatcaacggcaccggcatgctcatccagctgacctacgtggcgctcttctctctgtccccccggggggcgtgcctgccccccaaaggcccgtgctcctgtttcccccggcgaggggnnncctttcgtcgtcngcttgggnaccggggctggctgctcacccctggcgcacacgcaccggagccgcaggtcccaatgctcgggcgnaaaatcgggtttcccgtacttccttcgggaacccgggaaatggtaacgctgcgccccgctct

SEQ ID NO: 18017 - DNA, 654 bp, Zea mays
  misc_feature: Ceres CLONE 1383560-F
  misc_feature: Encodes the peptide sequence at SEQ ID NO. 18018
tccccgcggtggcggccgctctagaactagtggatcccccgggctgcaggaattcgcacgagaccattacctagaacatcctaatccaaaagcaccaccaccgtcactcaacacagcacaggcagctcgagagagagagagagagaaagatgtcgtggttcgggcaccaccaccacaaccagccggctcccccggcgtcgggccccaaccaggtgttcaagatcttctgccgcgccaacgagaactactgcctggccgtccgcgacggcgccgtcgtgctggccccggtcaaccccaaggacgaccaccagcactggtacaaggacatgcgcttcagcacccgggtcaaggacgaggaaggcatgccggcgttcgcgctcgtcaacaaggccacggggctcgcaatcaagcactccctcggccagtcccacccggtcaagctcgcgcctttcagcccggaccaggaggacgcgtcggtgctgtggacggagagcaaggacgtgggcaagggcttccgctgcatccgcatggtcaacaacacccgcctcaacttcgacgccttccacggcgacaggaccacggcgggcgtgcacgccgggcaccgccgtcgtggctcctggggagtggtgcaagggcgagaaccagagctggaaa

SEQ ID NO: 18018 - protein, 168 aa, Zea mays
  misc_feature: Ceres CLONE 1383560-F
MSWFGHHHHNQPAPPASGPNQVFKIFCRANENYCLAVRDGAVVLAPVNPKDDHQHWYKDMRFSTRVKDEEGMPAFALVNKATGLAIKHSLGQSHPVKLAPFSPDQEDASVLWTESKDVGKGFRCIRMVNNTRLNFDAFHGDRTTAGVHAGHRRRGSWGVVQGREPELE

SEQ ID NO: 18019 - DNA, 670 bp, Zea mays
  misc_feature: Ceres CLONE 1383561-F
  misc_feature: Encodes the peptide sequence at SEQ ID NO. 18020
  misc_feature (533)..(533): n is a, c, t, g, unknown, or other
ccccgcggtggcggccgctctagaactagtggatcccccgggctgcaggaattcgcacgagaccattacctagaacatcctaatcgaaaaagttaagattcactctatcgaccatcatcgcactgtgcaagcacgagaggtccatacagaggattcctaagccgtcagagtgttatgacaagatggtagttcaatggtgtatgtacctgctagagggagtgcgccgtattccgcaagcctgcgtagacgtacgaccacaagtgctgctgctgctggaggaggcgccaccagatcgatgctcctattctacactgatgaggctgccggccgctaaatgtcaccaaacactgttctgatcctgagaattgggctcgtagcctacattgctgctgctccatgtattgcggaagctgtgaccgcacctgccaactaggattgcattgccatatccctcaaagctgactccaccaagagaggattcctgtagaacaatttacatgtatagctagtgactatcatgactctgttggacnaagtttatttatactgctatgaaatggctgctgaggctattcataattgacctgccgagatttcgattgaagtcatctgctttctaatatctgaaatttgctagacatatcgttgaatggctggggaggtttcagtg

SEQ ID NO: 18020 - protein, 46 aa, Zea mays
  misc_feature: Ceres CLONE 1383561-F
MVYVPARGSAPYSASLRRRTTTSAAAAGGGATRSMLLFYTDEAAGR

SEQ ID NO: 18021 - DNA, 619 bp, Zea mays
  misc_feature: Ceres CLONE 1383562-F
  misc_feature (226)..(226): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (329)..(329): n is a, c, t, g, unknown, or other
  misc_feature (389)..(389): n is a, c, t, g, unknown, or other
  misc_feature (390)..(390): n is a, c, t, g, unknown, or other
aagctggagctcaccgcggtggctgccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatgggcggacgtggaccgcagngggaattttacgggggggcccacgccacctacgggcaacaccagcaaccaggaaggagggggnnnaacccaatgggggaaaagggaaaggggaggggtccccnaaaagggggcaaggggggcccaggccttaagggggggaacgctttttccccttggggggnnttttttttggggtttttggggggttgggcccttaaagccccccggggggggggagagaccagggccccccccccagtttcttagatttttaaaccccggggggctccccccccccgggggtggttttcttaggggcgcccctttttggggtcctccccccacccggggggccggtggggtcctccccggggggtttttcccccccccaaaaaagggtgccaaaaaaaaa

SEQ ID NO: 18022 - DNA, 654 bp, Zea mays
  misc_feature: Ceres CLONE 1383563-F
  misc_feature: Translation starting site: 109
ggagctccccgcggtggcggccgctctagaactagtggatcccccgggctgcaggaattcgcacgagaccattacctagaacatcctaatcgaaaaagaaccatattgatggagaccaacggcaacatacgaacgtgtaatcctcagccaccacacagcatcaatgtgaaacaaaatatattccctccatatgctccttggtctttccgcatgagttgctaacgcggcaattttgcctcactagtaagaatctcctataacttcgcttcttccgccttaccctccgtcaatgatgacttcgatatgggaaaagccaagtcttcaatcctataggctcctacgggcaatcgcagctagccacatacctttatcgctcgtgatgatgcaagggtcggcagtcctatcttcgtcgcatacgttgctaccaagcgtcctgacacagccgatgaagaaactcgcgccacctgtgatcagccacgtagctgtgccaactgtttctcgctactcagggccacaactatttcgttccatctccccacctgtgcacactgagacctgctgcttgtccgctacaacaacgatgaccaagtcgtcaggtcgctactgccatatgacaccaaccaccacttcttgcagttgaccgaatggccggaa

SEQ ID NO: 18023 - DNA, 665 bp, Zea mays
  misc_feature: Ceres CLONE 1383564-F
  misc_feature: Translation starting site: 157
  misc_feature (536)..(536): n is a, c, t, g, unknown, or other
  misc_feature (549)..(549): n is a, c, t, g, unknown, or other
tccccgcggtggcggccgctctagaactagtggatcccccgggctgcaggaattcgcacgagaccattacctagaacatcctaatcgaaaaaaccatattattgagaccaacaagcaacatagaaagtggaatccagtagcaacaatagagcaacaatggcgaccaagatattttccctccttatgctccttgctctttctgcatgtgttgctaacgcgacaattttccctcaatgctcacaagctcctatagcttcccttcttcccccataccttccatcaatgatagcttcagtatgtgaaaacccagctcttcaaccctataggctccaacaagcaatcgcagcaagcaacatacctttatcacccttgtttcaacaatcgccagccctatcctttggtgcagtcattggtacaaaccatcagggcacagcagctgcagcaactcgtgctacctgtgatcaaccaagtagctctggcaaacctttctccctactctcagcaacaacaatttcttccattcaaccaactgtctnacattgaaccgtngctgcttatttgcagcaacaactattaccattcagccagctagctactgcctactctcagcaacaacaacttctttcatttaaccaattggccgcactggaacccgctgcttattt

SEQ ID NO: 18024 - DNA, 667 bp, Zea mays
  misc_feature: Ceres CLONE 1383567-F
  misc_feature: Encodes the peptide sequence at SEQ ID NO. 18025
  misc_feature (502)..(502): n is a, c, t, g, unknown, or other
  misc_feature (603)..(603): n is a, c, t, g, unknown, or other
  misc_feature (663)..(663): n is a, c, t, g, unknown, or other
  misc_feature (664)..(664): n is a, c, t, g, unknown, or other
tggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctngcctgccgtgttatagccagattaaagaaggaaagagatgacgctagagcacttttggctcaagctgagagacagaattcctgcgtcagttgcaggagctngctcctgcagctgttgtttccaatggaaaaagagtaattgaagatgaattggccgaacgnnaaa

SEQ ID NO: 18025 - protein, 77 aa, Zea mays
  misc_feature: Ceres CLONE 1383567-F
  misc_feature (18)..(76): Pfam Name: Prp19 Pfam Description: Prp19/Pso4-like
  misc_feature (65)..(65): Xaa is any aa, unknown, or other
MDDIVPVKTNTIVKPRPLQAASIPGLLGIFQNEWDALMLSNFALEQQLHTARQELSHALYQHDAXLPCYSQIKEGKR

SEQ ID NO: 18026 - DNA, 682 bp, Zea mays
  misc_feature: Ceres CLONE 1383569-F
  misc_feature: Encodes the peptide sequence at SEQ ID NO. 18027
aaactggagctccccgcggtggcggccgctctagaactagtggatcccccgggctgcaggaattcgcacgagaccattacctagaacatcctaatcgaaaaagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgtttcgttggtttgttcccgttgctttcacggagggatcgtggccgttagttaaaagtcgacgagatctcacagactattgattcggaaaa

SEQ ID NO: 18027 - protein, 144 aa, Zea mays
  misc_feature: Ceres CLONE 1383569-F
  misc_feature (58)..(143): Pfam Name: PAP_fibrillin Pfam Description: PAP_fibrillin
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSFRWFVPVAFTEGSWPLVKSRRDLTDY

SEQ ID NO: 18028 - DNA, 663 bp, Zea mays
  misc_feature: Ceres CLONE 1383575-F
  misc_feature: Translation starting site: 466
caccgcggtggcggccgctctagaactagtggatcccccgggctgcaggaattcgcacgagaccattacctagaaatcctaatcgaaaaataccccacaggattcggggtatttcaaaactaccaagataatccgccttgaatatccaaagaacacgaatgcctatgagatcacaccccctctttgcctccttcgcgcttctaggcaccctcatgaacgccgttgtcataccacaatgatcacttgcctccacgattgttacaccagagtgtgctcgcacgaggtatcccgacgggctttcaacacgtatgtgggaagggccgcccgctcctccaacaggttgcggtgagcgcgttacaacactgaagtgcccaactgtgacgacgatgcttgacacacctaagaatacgatgctacacaactgaacagtcacaatagtgcctacaaagactgatccacatagacatgaagaaccctgccgcatacttggaagagaaactgcgtgaatccaagccacttgatctgcggaacgcaaatgagaatcagcagcaccaacagctactacaggtatctgccaacgctcagtaaactattcatgggagaccctgccgcctacgtacagcaacaactactgcttacatctatcccgatcgctgtggagcg

SEQ ID NO: 18029 - DNA, 680 bp, Zea mays
  misc_feature: Ceres CLONE 1383576-F
  misc_feature: Translation starting site: 197
  misc_feature (319)..(319): n is a, c, t, g, unknown, or other
  misc_feature (464)..(464): n is a, c, t, g, unknown, or other
  misc_feature (562)..(562): n is a, c, t, g, unknown, or other
  misc_feature (597)..(597): n is a, c, t, g, unknown, or other
  misc_feature (613)..(613): n is a, c, t, g, unknown, or other
  misc_feature (625)..(625): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
tccccgcggtggcggccgctctagaactagtggatcccccgggctgcaggaattcgcacgagaccattacctagaacatcctaatcgaaaaacttcattccggtttccggatagcttacctcccatcgacggtcggtgagccgttggtgagtggcgagacagcgggtgcgctgggcaagaacaggcgacgaagaagatgagcacgctggacacgcggacgctcaaggacgagctgacgagcatggacaggaagtgcctcgtggacctcggccacccgctgctcaaccgcgtcgccgacagcttcatccgcgccgctggnggtcggggcggccagggccgtctccagggaggcctacgtcgtcaccgtcgaagggctttcaggagactcgtccgggctagacgccgacggcggcaagcggagccatttctccagcatcagagggtgacgacccggccagaggcgnctccgacgcagtgggtaaaaacggccggcaagaggctttcccccgggggggggttggacagcccggagtctactccagggctcacgtacgcggctgcnggagggccaggggatgcaaccgactggaagacggngggcccctcgaggggncctttcttttgngnnnnncggcgttggcctcttccggggggggaccccgggcggccacttccgacaa

SEQ ID NO: 18030 - DNA, 650 bp, Zea mays
  misc_feature: Ceres CLONE 1383577-F
  misc_feature: Translation starting site: 186
  misc_feature (384)..(384): n is a, c, t, g, unknown, or other
  misc_feature (400)..(400): n is a, c, t, g, unknown, or other
  misc_feature (401)..(401): n is a, c, t, g, unknown, or other
  misc_feature (412)..(412): n is a, c, t, g, unknown, or other
  misc_feature (596)..(596): n is a, c, t, g, unknown, or other
ggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatgncttgccctcaaggaannaggaaggggtncgagctcggtggccattcagcaagtacgtcgagggggaagcatgggcggcaagctccccaccaacttccgcaagcagctcactgtgcagctgaagaagctcgctgccgccggcaagctgacgaagggtgaagaactccttcaagctgccggccaccgacgccaagcccaaggccgccaagcccnaggcacccaaggccgcgcccagccagcccctcgcccaaaagcgaaggccagacc

SEQ ID NO: 18031 - DNA, 650 bp, Zea mays
  misc_feature: Ceres CLONE 1383579-F
  misc_feature: Encodes the peptide sequence at SEQ ID NO. 18032
ggagctccccgcggtggcggccgctctagaactagtggatcccccgggctgcaggaattcgcacgagaccattacctagaacatcctaatcgaaaatgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggttacggtggtggccgtggaggcggcggctacggcggtggcgggcgccgtgatggcggcggcggctacggcggtggcggcggctacagtggtggcggcgcggctacgggtggtggtggcggcgactacggtggtggcaaccgtggcggcggctacggcaactccga

SEQ ID NO: 18032 - protein, 113 aa, Zea mays
  misc_feature: Ceres CLONE 1383579-F
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGGLRWWPWRRRLRRWRAP

SEQ ID NO: 18033 - DNA, 671 bp, Zea mays
  misc_feature: Ceres CLONE 1383582-F
  misc_feature: Translation starting site: 221
  misc_feature (175)..(175): n is a, c, t, g, unknown, or other
  misc_feature (176)..(176): n is a, c, t, g, unknown, or other
  misc_feature (184)..(184): n is a, c, t, g, unknown, or other
  misc_feature (191)..(191): n is a, c, t, g, unknown, or other
  misc_feature (351)..(351): n is a, c, t, g, unknown, or other
  misc_feature (368)..(368): n is a, c, t, g, unknown, or other
  misc_feature (439)..(439): n is a, c, t, g, unknown, or other
ggagctccccgcggtggcggccgctctagaactagtggatcccccgggctgcaggaattcgcacgagaccattacctagaacatcctaatcgaaaaatcaacgacagccccagacaacactcaccgatagcaagtagcgccgccgacgtttcgagagcagagtatccaagctagnnccaagcgncgcaccntcggtgacctagctagttcaggcgacgatatggcgtcaggtcaggaaagcaggaaggagctggaccgcaaggcccgcgagggcgagaccgtcgtccccggcgggaccggcggcaagagcgtcgaggcccaggagcacctcgccgaagggcgcagccgcgnaggccagactcgcaggnagcagctggggcagcagggtaacaagcgagatggggaaagaaggcggtctgagcacacgggacgagttggncggcgagcgcgccgccaggaagggcgtcagcatcgacgaagtcaagttcaccaagaagccttatggggggcggggtaaccaagggttccaaacttggcggcgaaaggaccctgggccggaattaggggtaaccccacctttggggggcgcgggagggaaaaaaggggcctacccctgggggttggggggcttcaaatcccccccccctggggggttttttgggggggactta

SEQ ID NO: 18034 - DNA, 658 bp, Zea mays
  misc_feature: Ceres CLONE 1383585-F
  misc_feature: Translation starting site: 215
  misc_feature: Pfam Name: Na_Ca_ex Pfam Description: Sodium/calcium exchanger protein
cagctggagctccccgcggtggcggccgctctagaactagtggatcccccgggctgcaggaattcgcacgagaccattacctagaacatcctaatcgaaaaacaccaggaccaggaccaggtccagcggcagccccagcgcagccatcggccccccgcttccttactggggcggcgccgctgttggcgcagaggagcagaggtggcgcatcggtatggactccgccgccgctgccctcctcgactccgcctccgcgtccgcctcttccgccaacgccgcaggaaaggagatgcccaccgcccgccacctcgcccaccgcaccgcccacaagatgtcctcctcctcgctccgcaagaagtccgacctcgcgctcctccgcaaggtcccctgcgccccgcatcgacgcctcctcgacaacctgcaggaggttatgctcgacacgcagctcgccctcctcttccccgcgttctactcgcgatcgccgcgcgaatcttccacttcggccaggaatgggtctttgtgcttagcttgatcggtctcgttcctcttgctgagcgacttagctttctgactgagcaggttgcgtttacatagggactactggggggggactgttgaatgcaacatttggaaacgtaacagaggtcatcatggcgat

SEQ ID NO: 18035 - DNA, 681 bp, Zea mays
  misc_feature: Ceres CLONE 1383586-F
  misc_feature (326)..(326): n is a, c, t, g, unknown, or other
  misc_feature (336)..(336): n is a, c, t, g, unknown, or other
  misc_feature (340)..(340): n is a, c, t, g, unknown, or other
  misc_feature (392)..(392): n is a, c, t, g, unknown, or other
  misc_feature (432)..(432): n is a, c, t, g, unknown, or other
  misc_feature (435)..(435): n is a, c, t, g, unknown, or other
  misc_feature (491)..(491): n is a, c, t, g, unknown, or other
  misc_feature (565)..(565): n is a, c, t, g, unknown, or other
  misc_feature (630)..(630): n is a, c, t, g, unknown, or other
  misc_feature (681)..(681): n is a, c, t, g, unknown, or other
aagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccagctaccacgggatgctactactagctgcaggcagggncgagaatggncagnctttcatgtgctcgcggcggacggtgttgtcccgttccggcgctctgcccgncaaggctgttgctggtgcgcagctgctgcttccctacggnggntcccagtccgaacggagaggtgcaggtgcttgcctgccgccagaatctcccacgcntgccggaggggtaaggatctcggtcggcagggcccggggcgttcgcatcttcaggtcggtcggcctccacaagnagcccgaacggggggccttgtaacttggccagggcccgtccaccctcggggtcgggggttccaanccggccgccctggagcgccgcggggccgaaccgttcaagttttcgcttgan

SEQ ID NO: 18036 - DNA, 658 bp, Zea mays
  misc_feature: Ceres CLONE 1383593-F
  misc_feature: Encodes the peptide sequence at SEQ ID NO. 18037
  misc_feature (360)..(360): n is a, c, t, g, unknown, or other
  misc_feature (623)..(623): n is a, c, t, g, unknown, or other
aagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcggcaccgcgcagggcggcaactctaccagacacagagatgacctggggcgatggccgcggcaaggtagtggacggcggncgcgggctggacctgacgctggaccgcacgtccgggtcggggtccaggccaagagcgagtaactgggtcggcagatcgacatgcagatcaagctggtgcagggcactccgtggaacggtcaccacctctacctgtcgtccagggggacgcgcacgacaagatccacttcgaggtcctgggcacgtgaggggggagccctaaccctggaaaccaacgggttccggggggacagggccaggggaacaacaattcccccctgggtnaaacctaccagggtttccacctaacccatccgggg

SEQ ID NO: 18037 - protein, 111 aa, Zea mays
  misc_feature: Ceres CLONE 1383593-F
MRSFAPVFLSAVVAWLELAAPRRAATLPDTEMTWGDGRGKVVDGGRGLDLTLDRTSGSGSRPRASNWVGRSTCRSSWCRALRGTVTTSTCRPGGRARQDPLRGPGHVRGEP

SEQ ID NO: 18038 - DNA, 748 bp, Zea mays
  misc_feature: Ceres CLONE 1383596-F
  misc_feature: Encodes the peptide sequence at SEQ ID NO. 18039
  misc_feature (360)..(360): n is a, c, t, g, unknown, or other
  misc_feature (427)..(427): n is a, c, t, g, unknown, or other
  misc_feature (428)..(428): n is a, c, t, g, unknown, or other
  misc_feature (431)..(431): n is a, c, t, g, unknown, or other
  misc_feature (498)..(498): n is a, c, t, g, unknown, or other
  misc_feature (608)..(608): n is a, c, t, g, unknown, or other
tggagctccccgcggtggcggccgctctagaactagtggatcccccgggctgcaggaattcgcacgagaccattacctagaacatcctaatcgaaaaatctacctcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccggnctgatcctggccggcaccgtgatcgcgctcacggtggccacccccgtgctggtgatcttcagcgggnnttngggggggggggggcccccccatcgcggttgggctccatggggggggcggggttcgtcaccctccggngggcctcgggcgtcgctgcgggctgtccgtgttccttcctgggatgtaccaggtacctgacggggcaagcacccggccgggcgcccgaccagctggaccacgccaaggcngagggctgggcgtcccagggcccgcgacatcaagggatgcagcacaggcacgcatcggacagggggggaggggggtcttggagaggaagaaccacactcgagggggaccggggggcgcgtccttccttgaacccctgccg

SEQ ID NO: 18039 - protein, 123 aa, Zea mays
  misc_feature: Ceres CLONE 1383596-F
  misc_feature (36)..(124): Pfam Name: Oleosin Pfam Description: Oleosin
  misc_feature (81)..(81): Xaa is any aa, unknown, or other
  misc_feature (82)..(82): Xaa is any aa, unknown, or other
MADHHRGATGGGGGYGDLQRGGGMHGEAQQQQKQGAMMTALKAATAATFGGSMLVLSGLILAGTVIALTVATPVLVIFSGXXGGGGPPHRGWAPWGGRGSSPSGGPRASLRAVRVPSWDVPGT

SEQ ID NO: 18040 - DNA, 761 bp, Zea mays
  misc_feature: Ceres CLONE 1383597-F
  misc_feature: Encodes the peptide sequence at SEQ ID NO. 18041
  misc_feature (491)..(491): n is a, c, t, g, unknown, or other
  misc_feature (492)..(492): n is a, c, t, g, unknown, or other
  misc_feature (665)..(665): n is a, c, t, g, unknown, or other
  misc_feature (670)..(670): n is a, c, t, g, unknown, or other
  misc_feature (671)..(671): n is a, c, t, g, unknown, or other
tggagctccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcacgcggccgggacggtgggcttcttctggctggtgaaccacggagtgccggaggagctgatgggcgcatgctccgcgnngtgcgccagtcacaaggcccccgtggggggaggaaaaagcaggccttctatcctcgagggacctcgctcgcaacctgcggcttcgcctccaacttcgaccctcttcagggctgctggcggccgactggcggaacgccctttttttggtgcgaggtggctccgaacccgccccncccgnngggaaggagctgccggagccactcaggaacgttggatgctggagaacaagcgcggcgggagaaaaaatgtggggggggcggttccggttt

SEQ ID NO: 18041 - protein, 206 aa, Zea mays
  misc_feature: Ceres CLONE 1383597-F
  misc_feature: SWISSPROT Homolog: EC 1.14.11.20 Desacetoxyvindoline 4-hydroxylase
  misc_feature (117)..(117): Xaa is any aa, unknown, or other
  misc_feature (175)..(175): Xaa is any aa, unknown, or other
  misc_feature (177)..(177): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRHAAGTVGFFWLVNHGVPEELMGACSAXCASHKAPVGGGKSRPSILEGPRSQPAASPPTSTLFRAAGGRLAERPFFGARWLRTRPXRXEGAAGATQERWMLENKRGGRKNVGGAVPV

SEQ ID NO: 18042 - DNA, 688 bp, Zea mays
  misc_feature: Ceres CLONE 1383598-F
  misc_feature: Translation starting site: 416
  misc_feature: Pfam Name: Flavoprotein Pfam Description: Flavoprotein
  misc_feature (595)..(595): n is a, c, t, g, unknown, or other
  misc_feature (649)..(649): n is a, c, t, g, unknown, or other
tggagctccccgcggtggcggccgctctagaactagtggatcccccgggctgcaggaattcgcacgagaccattacctagaacatcctaatcaaaaaagccctggcaaagcgcttgccgctgctcccctcttccgtttccagcgccgccgccctccttcctgttcctgttctccagcaccgccgttgaacctcctcccctctccctcgtgcttccctctctcatcctctctgccgcttccccgctctccccaaactactctgtgccccgtcagatcgacctggactttggcggcagctacttcttctcgacgggcggcacggcagcaagccagcaaggagaacgcggcggcacgggcctgctgctacttctgcttcctctcccacgcttgctgttgagcagttcaagcagagctgatggctacatcagagccagtacaagagagtttggtggtgcactactcacaacctagtaggccccgggtcctcgttgctgcttcaggaagtgtagccgctataatattgagagcctttgccgtagcttctctgagtgatcggatgtccgagctgtgcccacacgtcatccttggacttcgntgatgatcatctctacaaggggcatccttctttaccctgatgatgatgatgggncacctggaaaaaaatagagatggagtcttaacatcgggg

SEQ ID NO: 18043 - DNA, 852 bp, Zea mays
  misc_feature: Ceres CLONE 1383599-F
  misc_feature (12)..(12): n is a, c, t, g, unknown, or other
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
ggggcccccccnnacnnnnnnntccgaggcccctncctccttnnnnnnntcaaagctggagctccaccgcggtggcggccgctctagaactagtggatcccccgggctgcaggaattcgcacgagaccattacctagaacatcctaatcgaaaaacgcagcagcgacgcgacgcccccgccccgcgtcttctactcttcttcatcttcactgctcaccaacccatccatcccccagtcctcctcactgctcacccgtctcccatccccacaccaccaccaccaccatcttccggtcttcccctccccacacccggcgggatccccaccatccccgccccccgatgggagctgttcgcgcgcgccaagggggtggcggctcaagaggcaccacggaaaggtccctggtccccggatgagggacgacgcggcacgtggacgccatgagcgggaacgggatccccccgcccaacgccccggtggggcccctgggaagccggccgccgtaaaaaccccgggggggccatcccgccctggggggaacccggctaacgggtccccttaaccttccaccggccctcccgggggggagcccgggttccctggttggggggaaagacaccgcgccccgggaaggggtggaccctcaaaacggggcgcccccgccccctaaccccccgccccccgtccataacggcgggcccggggggaactggtggaaggcacggggggggggtaaatggtctttctcggggcgaccggtccttcccgaaacacaagggaggaggaccccacttttcctttccgggggcccagcagtggggcgggctcccccccgcccctgggaaggaaaa

SEQ ID NO: 18044 - DNA, 838 bp, Zea mays
  misc_feature: Ceres CLONE 1383604-F
  misc_feature: Encodes the peptide sequence at SEQ ID NO. 18045
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (45)..(45): n is a, c, t, g, unknown, or other
  misc_feature (46)..(46): n is a, c, t, g, unknown, or other
  misc_feature (53)..(53): n is a, c, t, g, unknown, or other
  misc_feature (54)..(54): n is a, c, t, g, unknown, or other
  misc_feature (64)..(64): n is a, c, t, g, unknown, or other
gggggggggggnnnnncnnncnnnccccccacccgggggggaaannaataatnnaaaagctggngctccaccgcggtggcggccgctctagaactagtggatcccccgggctgcaggaattcgcacgagaccattacctagaacatcctaatcgaaaaagttgccatctcgcaaagtcgcaataacttgtcttctcgaatcggctgcaaccccaccccagaccccaccgccgccgccgctagggttttgggggtggaggatcgccgatgtcgacggctcccaggcgtcccttccgaggccgcggcgccatgccctcgggcaccggctacgtccgccgcggccccgcccaggctccgccgacgccgcaagcccctgggcaagccccgtcttcaccaccggcgaaccagctttccgccccccaaaacacacggttcacacttctcacaggcccggcggtcatttgccggtcccggcaccggtccctccaaaaaaggccccttccacgggaaccctcgggcccggaaccccggggttccgcccgaaaggggccctccggtcgggaagaaaaaggaaaccggggcacccggggccctcgcgggcaccccggccccggcaaaaagaaaaaaggggtgttgaccccttttttggaaaagcccagaaaaaacaaacaggggggatcctttccccgcaaaagggcgcaaaaaaattggataattggtttccaagggggcacccccattggaaaaatggggcgggggggggaaaaaggggggggggccgcggaatttggggaggggacctcgaactcccctcccggggtgttcaagagggaggaaag

SEQ ID NO: 18045 - protein, 30 aa, Zea mays
  misc_feature: Ceres CLONE 1383604-F
MGRGGEKGGGAAEFGEGTSNSPPGVFKREE

SEQ ID NO: 18046 - DNA, 605 bp, Zea mays
  misc_feature: Ceres CLONE 1383606-R
  misc_feature (605)..(605): n is a, c, t, g, unknown, or other
caattgggtaccgggccccccctcgaggtcgacggtatcgataagcttttttttttttttttttagaaatgtactttcttatttctgggaagccacaaacatcagataaaaaactttattattgaactataactcataagaaatctaaaagagggcaccaccaatgatgggttgttggtagaacactgctgggtttgtcaaaacaagttggttgaatggaaccaattgttgcccttgtaatatggtgccagacttaggcccaacgtgctggtacaacggcaacaactgtggttgtatcaagaaggtaccagggctcacaccacctagctggctgaatagcactagttgttgctgctgtaaataatcacgagagttcaatgctgctagctggttgaatggaacaaattgctgggggtaggcaccaggtagctggctgaatggcagttgttgttgttgcaaataagaaccatagttcaatgaacctacttagttgaatggaacaaactgctgttgctgacagtaagcaacaaggtttgctagcacaagttgctgtaattgttgagccctgatgtcttgtgccccttaatgcaccaaacgtaactgtn

SEQ ID NO: 18047 - DNA, 655 bp, Zea mays
  misc_feature: Ceres CLONE 1383606-F
  misc_feature (492)..(492): n is a, c, t, g, unknown, or other
tggagctccccgcggtggcggccgctctagaactagtggatcccccgggctgcaggaattcgcacgagaccattacctagaacatcctaatcgaaaagaggaggagagatcgcacgcgccctctgccgcttgctcgatcgtcgcgcttgcgaccaggcaccaacacacgcatcccaatgtcccgaggcgtttaggccaagcatgagaggtctgcggagtttcccgcaatgctcgcaagctcctatagcttcccttcttcccccgtacctctcacagcggtgtcttcggatgtgaaaacccattcttcaccctacagatccaacaggaatcgcagctggcatcttacctttatcacccttgttccttcaaaaacatcagccctatacaacggttactttggtgctttattggccaaacctcagggcacaaaactacacaactggggtagaaacttggtgcctctctcagcaaaggagtttcttcactcaacanctaaggtcattgactctgcttctaatttgaaaaaaaaaaattaacattcagccagttactgggtggccaccccccagattttcttcccttcaaccaattagaagaattggactcctcctgctaatttaacgggagcaacaactactaaccatttaagccaggt

SEQ ID NO: 18048 - DNA, 720 bp, Zea mays
  misc_feature: Ceres CLONE 1383612-F
  misc_feature: Encodes the peptide sequence at SEQ ID NO. 18049
  misc_feature (44)..(44): n is a, c, t, g, unknown, or other
  misc_feature (48)..(48): n is a, c, t, g, unknown, or other
  misc_feature (49)..(49): n is a, c, t, g, unknown, or other
tttttttccctccccccctccccccctccccttcccccactttngggnnttgttcaaagctggagctccccgcggtggcggccgctctagaactagtggatcccccgggctgcaggaattcgcacgagaccattacctagaacatcctaatcgaaaacttcctcgtcgcccttttccttccgcaacacacacacaccggcacgatcgagtgcacgaccgcgggcgcagcagccaccgatccggcggcatctccgccctgctcgcgcccgcgcccgccggagaagaagagccttccatgagattgttgatgtcgcgccggcgcggcgccggcggcgggctgtgcatcaggaagaaggcccgcggattcatgtgcgggtgcggcggcaccaaggccatctccatctccgacggctccgacaagtcaccaacggccacgccgcagaccgccgcgtccaccactccccttaccgggatgtcggtcaccaccaccaccaccaccacgaccaagccgacgagaggaggaggaggaggagggtacaggccggcggcggcaccgtcaaacacggagggtccctccctgttctcgtcctcgtccttggacgcggacaccacccgacgacggcccccagcaggatggagagcacgccccagccggccgggggctcctggggccagcctcggcgaggtggaagcgaagcggtccgctttcctggcactccc

SEQ ID NO: 18049 - protein, 141 aa, Zea mays
  misc_feature: Ceres CLONE 1383612-F
MRLLMSRRRGAGGGLCIRKKARGFMCGCGGTKAISISDGSDKSPTATPQTAASTTPLTGMSVTTTTTTTTKPTRGGGGGGYRPAAAPSNTEGPSLFSSSSLDADTTRRRPPAGWRARPSRPGAPGASLGEVEAKRSAFLAL

SEQ ID NO: 18050 - DNA, 668 bp, Zea mays
  misc_feature: Ceres CLONE 1383613-F
  misc_feature: Translation starting site: 223
  misc_feature: SWISSPROT Homolog: EC 2.4.1.207 Xyloglucan:xyloglucosyl transferase
  misc_feature (341)..(341): n is a, c, t, g, unknown, or other
  misc_feature (360)..(360): n is a, c, t, g, unknown, or other
  misc_feature (450)..(450): n is a, c, t, g, unknown, or other
  misc_feature (458)..(458): n is a, c, t, g, unknown, or other
  misc_feature (477)..(477): n is a, c, t, g, unknown, or other
ctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcgncaaggtagtggacggcggncgcgccctggacctgacgctggaccgcacgtccggctccgggttccagtccaagagcgagtacctgttcggcaagatcgacatgcagatncagctggntgccaggcaactccgtggnacggtcaccaccttctacctgtcgtcccagggcgacgcgcacgacgagatcgacttcgagttcctgggcaacgtgagcgggagccctacacgctgcacaccaacgtggtcacgcgcggacagggccagcgggagcagcagttccggctctgggtcgacccctacactggcttccacactactgcatgctgg

SEQ ID NO: 18051 - DNA, 624 bp, Zea mays
  misc_feature: Ceres CLONE 1383617-F
  misc_feature (203)..(203): n is a, c, t, g, unknown, or other
  misc_feature (297)..(297): n is a, c, t, g, unknown, or other
  misc_feature (504)..(504): n is a, c, t, g, unknown, or other
  misc_feature (505)..(505): n is a, c, t, g, unknown, or other
  misc_feature (522)..(522): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcgngacgacgacacatggggaaggtagtgtgggtgcatcatggtgggcgttcctcctgctcgccggcgtgctgctggtcgtagcagccacggccggngcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccgggaggggcgagtgccgnncgcagtgcctgcgccgncacgaggggcagccgtgggagacccaggagtgcatgaggcgntgcccgccgccgcgaactggccgtcaaatggagcaagagtacgtcgcggaacgagagccg

SEQ ID NO: 18052 - DNA, 679 bp, Zea mays
  misc_feature: Ceres CLONE 1383618-F
  misc_feature (309)..(309): n is a, c, t, g, unknown, or other
  misc_feature (317)..(317): n is a, c, t, g, unknown, or other
  misc_feature (381)..(381): n is a, c, t, g, unknown, or other
tggagctccccgcggtggcggccgctctagaactagtggatcccccgggctgcaggaattcgcacgagaccattacctagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaanttcttcanccctacaggatcccacaggcaatcgcagctggcatcttacctttatcacccttggtgcctccgnacatcatcaggccctattacaaacagtttacttttggtggatttaattgggacaaaacatcaggggaccacaaactacaaaaaattttgggttaacaaaacctttggtgccttaattctccagaaaaaagggagtttgttttccattttaaaccaaaataaagggtccatttgaaaccccgggtttcttttatttggagaaaaaaaaaaaatataactttttggcccggttaacgtgggttcctaaccccccaaaaattttttcttctcttttcccccaaaataaggaggtttttgat

SEQ ID NO: 18053 - DNA, 744 bp, Zea mays
  misc_feature: Ceres CLONE 1383619-F
  misc_feature: Translation starting site: 185
  misc_feature (425)..(425): n is a, c, t, g, unknown, or other
  misc_feature (724)..(724): n is a, c, t, g, unknown, or other
aagctggagctccccgcggtggcggccgctctagaactagtggatcccccgggctgcaggaattcgcacgagaccattacctagaacatcctaatcgaaaactcactcgtagctcaagcatcagcggcaggagctctgggcagcgtgcgcacgtggggtacctagctcgctctgctagcctaccatggctgatcaccaccggggcgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcgggntttgggggggcgggccgccatcgcgctggcctccatgggggggacgggttcgtcacctccgggggcctcggcgtcgctgcggctgtccgtgttcctcctgggatgtacaagtacctgacgggcaagcacccgccgggcgccgaccagctggaccacgccaagggcgaggctggcgtccaaggcccgcgacatcaaggatgcagcacagcaccgcatcgacagggggcagggggtcttgagagaagaacacactcgagcggaccgcgcgcgcgtcctccttgaccactgccggcgcggcnatatggccccttagaggcgg

SEQ ID NO: 18054 - DNA, 671 bp, Zea mays
  misc_feature: Ceres CLONE 1383624-F
  misc_feature: Encodes the peptide sequence at SEQ ID NO. 18055
  misc_feature (536)..(536): n is a, c, t, g, unknown, or other
  misc_feature (593)..(593): n is a, c, t, g, unknown, or other
  misc_feature (642)..(642): n is a, c, t, g, unknown, or other
tggagctccccgcggtggcggccgctctagaactagtggatcccccgggctgcaggaattcgcacgagaccattacctagaacatcctaatcgaaaactcacctgcagtcccgctccccaccccgccaccaccgacgctgggatgaaggccgtgccagccgacagcgccgcgcccccggtgccgatgccgatgccgatgccggcgaccaagatcaccattcccgtttccgcggtgggcggcacggaggcggcgctcctcgggaaggggcggtacaaggtctggggccttgggccgccatcgcgctcctcgcgctctgggtcatggtcgccgcctccgtctcactccgctggtcctcctcgggtgacctcgcctccgtctacggggacctggacgtcccgctcgccgacgacctcgattcccttgagatggaggagagggagaaaatagtgggacgaatggtggacatgtacacacggaccagtgatgaggtacggcttccacggttctggcaggaggcgttttgagctgcatacgnagaacttgctggtgatgatgtgcaggtccgtgatgcagctatctctgagattgcccngatgtcagccccacaacttgagctcgagcagacattgaatgagaatgangaggagatgccgcgagcaacagtggtgga

SEQ ID NO: 18055 - protein, 67 aa, Zea mays
  misc_feature: Ceres CLONE 1383624-F
MVAASVSLRWSSSGDLASVYGDLDVPLADDLDSLEMEEREKIVGRMVDMYTRTSDEVRLPRFWQEAF

SEQ ID NO: 18056 - DNA, 689 bp, Zea mays
  misc_feature: Ceres CLONE 1383627-F
  misc_feature: Encodes the peptide sequence at SEQ ID NO. 18057
  misc_feature (364)..(364): n is a, c, t, g, unknown, or other
  misc_feature (369)..(369): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaactctctgttgcatttcccgtcctgtccttccacccggcggcttaaaccctagttctcactcccatcgccgcttcagctccgccgctgcagatggagttctggggtctcgaggtcaagcctggttccactgttaagtgtgagcctggatatggctttgtgctgcacctttcccaggctgctcttggggatcgaagagagtgatatggcttgatgatgtcaaaattgatgatcagaaacttgccattgggaacccctctctggntgacnagaaacccacccatacaattttgatctgaatttcgataaagagttggagctgccggacacatcaaaaactacccagcgtttttctcactggctaccaggggtgagccagcattcgaggaagatgaaatggattctgattctgaagatgaagaccaggagctgaatggtccaagtagccagggaaaatgccaaagctgatgggaaggacccgaaaagtcaagaaaagggcagtggctgcaccttcaaaatcaagtcccggaattcaagaagaggcaggatgccnaccattcttatggaggacgagactgatggatctgatg

SEQ ID NO: 18057 - protein, 36 aa, Zea mays
  misc_feature: Ceres CLONE 1383627-F
MEFWGLEVKPGSTVKCEPGYGFVLHLSQAALGDRRE

SEQ ID NO: 18058 - DNA, 687 bp, Zea mays
  misc_feature: Ceres CLONE 1383629-F
  misc_feature: Encodes the peptide sequence at SEQ ID NO. 18059
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (687)..(687): n is a, c, t, g, unknown, or other
cgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggggactctattctgtgtccctctgcggtgggcggcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18059 - protein, 61 aa, Zea mays
  misc_feature: Ceres CLONE 1383629-F
MAGIGRNMVAPLLVLNLIMYIIVIGFASWNLNHFINGQTNYPGVAGNGDSILCPSAVGGRG

SEQ ID NO: 18060 - DNA, 809 bp, Zea mays
  misc_feature: Ceres CLONE 1383630-F
  misc_feature: Encodes the peptide sequence at SEQ ID NO. 18061
  misc_feature (13)..(13): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
tttttttttccantttcccccccccccccccccccattgttgggncnngggacaaagctggggctccaccgcggtggcggccgctctagaactagtggatcccccgggctgcaggaattcgcacgagaccattacctagaacatcctaatcgaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctcttcaccagcggtgtctttcggtatgtgaaaacccaattcttcacccctacagggtcccaacagggaatcgcagggtgggatctttaccttttatcaccccttggttccgtcccaacaaatcactcagcccctatttaacaacagggaacccttttggggggattttattggggcaccaaagaagttcagggggcaccaacaaactaactagcgatccttggggcgtaaggaaaaaccttggcttgccctaactcccccagcaagcaagcagggtttcctttcccatttcaaacccgaaattaaggggtccatttggaacctcctggctttccttatatttgggccaacaaccaaacaggcttaaccgttttcggggcgcgggttacgccgtggggtggccctacgcccccaggggaaatttttctttctccgtttccaacccgtgcgctaaggcgaggcgtttgggacacgcccccg

SEQ ID NO: 18061 - protein, 85 aa, Zea mays
  misc_feature: Ceres CLONE 1383630-F
MAAKIFCLLMLLGLSASAATATIFPQCSQAPIASLLPPYLFTSGVFRYVKTQFFTPTGSQQGIAGWDLYLLSPLGSVPTNHSAPI

SEQ ID NO: 18062 - DNA, 690 bp, Zea mays
  misc_feature: Ceres CLONE 1383634-F
  misc_feature: Encodes the peptide sequence at SEQ ID NO. 18063
  misc_feature (320)..(320): n is a, c, t, g, unknown, or other
  misc_feature (325)..(325): n is a, c, t, g, unknown, or other
aagctggagctccccgcggtggcggccgctctagaactagtggatcccccgggctgcaggaattcgcacgagaccattacctagaacatcctaatcgaaaatcatgcagcagcgaacaacacaaattaagtagtggagtgtcagaacttgggaggcacaaattaagtacaaagcagtctaattaatgacgggcccgatggggagattccggtgatcgatctcggcggcctcaacggcggcggcgaggagaggtcgcggacctttggcggagctccacgacgcctgcaaggactggggcttcttctgggtggagaacacgncgtgnacgcgccgctgatggacgaggtcaagcgctttcgtctacgggcactacgaggaagcaccctgggaggccaggttctacgccctccggcctcggcatggacctcgaggccgccaccaaagtggacactgatgagaagcccctccgacgaggtgaactgggagttccactacttcattcagcacccacccaaggaccaacgtcgccgactttccagagatcccgcccgccacaccaaaagacgctggacgcgtacctcccgcatatgtggtccctcgcggaacgtctgggccagtggatggaccttcacctggggcctcccggggcccaagtcgccgccaccttcgggcggcggtcgtggggaccaa

SEQ ID NO: 18063 - protein, 90 aa, Zea mays
  misc_feature: Ceres CLONE 1383634-F
MDLEAATKVDTDEKPLRRGELGVPLLHSAPTQGPTSPTFQRSRPPHQKTLDAYLPHMWSLAERLGQWMDLHLGPPGAQVAATFGRRSWGP

SEQ ID NO: 18064 - DNA, 645 bp, Zea mays
  misc_feature: Ceres CLONE 1383637-F
  misc_feature: Encodes the peptide sequence at SEQ ID NO. 18065
  misc_feature (358)..(358): n is a, c, t, g, unknown, or other
  misc_feature (372)..(372): n is a, c, t, g, unknown, or other
aagctggagctccccgcggtggcggccgctctagaactagtggatcccccgggctgcaggaattcgcacgagaccattacctagaacatcctaatcgaaaaccccccccatctctcctcccctccccatctcgctcttgcggagatcgaagagaagctgaggcctagcgccgcacccgccgccgcatcagccatcagccatggcgatggccgctcgcctcgtctcgcgctcccgtcagctacattcggatcaagcagcttttgcgaatggaggtgccactcaagttcgctcctttgcccaggatgcagctccagctgaccgtcctcctggtggtggggatgatctccctgagggcatnatcttttgagtaangaagaaggttggagacaggctctccgtcgtcccttaaaaagggaaaaagatcccctattggatccagaatgacccccagggggaagtttcccccaaaatggcccccatcccctggaaaaacccgggaggggggaaaaaagggggggaaccccccttttccggggccccccccagggagataaaaaaaatatcccccctgtggggggaccctctccccccaggggggggcccctccgcgtgaggggggggggggggtttatgtgggaaaacccc

SEQ ID NO: 18065 - protein, 55 aa, Zea mays
  misc_feature: Ceres CLONE 1383637-F
  misc_feature (53)..(53): Xaa is any aa, unknown, or other
MAMAARLVSRSRQLHSDQAAFANGGATQVRSFAQDAAPADRPPGGGDDLPEGXIF

SEQ ID NO: 18066 - DNA, 736 bp, Zea mays
  misc_feature: Ceres CLONE 1383640-F
  misc_feature: Translation starting site: 209
  misc_feature: SWISSPROT Homolog: EC 3.5.2.3 Dihydroorotase
  misc_feature (174)..(174): n is a, c, t, g, unknown, or other
  misc_feature (495)..(495): n is a, c, t, g, unknown, or other
  misc_feature (512)..(512): n is a, c, t, g, unknown, or other
tggagctccccgcggtggcggccgctctagaactagtggatcccccgggctgcaggaattcgcacgagaccattacctagaacatcctaatcgaaaaactcctcatcgccacaagtgaagtcaccgacgcacgcacggctgcagcgcgctcctactctcccgcgaccgccaccnggggaggggcaatagaatatagcgaggacagccaatgcaggccgccgtcaacaccaccactgtcggcgctcacccgcacccaacaaagtcctcgttcctccgtccatcccctccttgccgcgtctacttccacgcttctccacgcccgaaccatagggcgatcgccatggccagcaagtcgcagctgcaggagcaactgatcatcactcgccccaacgactggcacctcccatctcgcgaaggcggtgtcctcgaggctgtagtgcacacagcgcgaggcattttgggagggcatcatcatgcccaacctgaagccggcgntgaccacaacgggcggnccatggagtcagggaggagatatggaggcgctgcccgccagaagtaccttccagccctcaggacctaaaactcccagacaaccaagcccaaaggaaaccagctcccagaaaaaagggaaaaaaccttggcggggagttggaaccccctgggaagaacccccattcccaagaggggccccgaaaaatatgggagaggttgccccccccccaaaaaagacaaaaaa

SEQ ID NO: 18067 - DNA, 699 bp, Zea mays
  misc_feature: Ceres CLONE 1383643-F
aaagctggagctccccgcggtggcggccgctctagaactagtggatcccccgggctgcaggaattcgcacgagaccattacctagaacatcctaatcgaaaaatcgcttgtttggtgctgccttttcctttccgcctcgtcaaaaccgcagagcgcgagatcgagttgggggagaccaatccgttataagtccttcgcttaatcgagtctcgtgctactgcctcctgtgtatataaaggcggcaatcgcgacgcccggcgaggcgtccgttctcattctcaattgcaggagcgcggtatcccaaggccgggatcggcggcctctcagatctcaacgggtcgcgggaggaagagaccgtatggggggttgactgatgctccgggggaataagtttcccgggacgcaccagcaaggggagggtgggcaccaagacggtgtacccaatggaccaaatctccagcgaggggggccggcttccaccgttcctgcttcgagtgccaaacctgcaaggcctaccctctcactgagcaaaaataactcggttggaaggagggcctacttgcaagacccatttccaggcggaggtcaagggactccggaagttacaacaagaacttcccaataacggccccctggaaagattactctcgggaaaagcgggcccctggtgctgaccttaacacccaaccggaggtggcg

SEQ ID NO: 18068 - DNA, 740 bp, Zea mays
  misc_feature: Ceres CLONE 1383646-F
  misc_feature: Encodes the peptide sequence at SEQ ID NO. 18069
  misc_feature (567)..(567): n is a, c, t, g, unknown, or other
tccccgcggtggcggccgctctagaactagtggatcccccgggctgcaggaattcgcacgagaccattacctagaacatcctaatcgaaaaacaggctcatctcgctttggatcgattggtttcgtaactggtcgagggactgagggtctcggagtggattgatttgggattctgttcgaagatttgcggaggaagacaatggcgaccgcgtggaaggtgatcaagtgcaaggctgcggtggcatgggaggccgacaagccactgtcaatcgaggaggtggaggtagcgcctccgcaggccatggaggtgcgagtcaagatcctcttcacctcgctctgccacaccgacgtctacttctggaaggccaaggggcagactcccgtgttccctcggatctttggccacgaggctggaggtatcatagagagtgttggagagggtgtgactgacttatctccggtcgtacatgtccttcctgtgctcactgaggagtgcaaggagtgtgcccactgcaagtcgacatagagcaacatgtgtgatctgctctagatctacaccagacgcgntgtgatgattgccgatgccaagtcgaggttttcaatacatgcgtagcctatctagcactttggtgccacttcctccttcggagagtactcggtcgtgaaatggtgcgttgtgttcctatatcaaccctcaggctcaccttgatcagagttgcgtacttagctgtgggatttct

SEQ ID NO: 18069 - protein, 108 aa, Zea mays
  misc_feature: Ceres CLONE 1383646-F
  misc_feature (34)..(94): Pfam Name: ADH_N Pfam Description: Alcohol dehydrogenase GroES-like domain
  misc_feature: SWISSPROT Homolog: EC 1.1.1.1 Alcohol dehydrogenase
MATAWKVIKCKAAVAWEADKPLSIEEVEVAPPQAMEVRVKILFTSLCHTDVYFWKAKGQTPVFPRIFGHEAGGIIESVGEGVTDLSPVVHVLPVLTEECKECAHCKST

SEQ ID NO: 18070 - DNA, 677 bp, Zea mays
  misc_feature: Ceres CLONE 1383647-F
  misc_feature: Encodes the peptide sequence at SEQ ID NO. 18071
gctctagaactagtggatcccccgggctgcaggaattcgcacgagaccattacctagaacatcctaatcgaaaaatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtaccaagcgaagaacatgcagatgcaggtcggaggaggcgcggccgacagcccgggcgctgcggcggcggcgggcgcggaggcgccgcgccccaatccgctacgagtctcaaaaaccgccgggactggcacacgttccgggcagtacctgcgcaaccaccggcccccccttgaacttgcggcgggtgcagaggcgccgacggggtccgaagttttcttccctacctcccaccagtttccggaaaggaccaagggcccacgcgcccggggtgcccctttctttcggccccccggttgaccgcccgccccccgggcccgtggcccgcgtgggggaagggtcctggcggaaagccttggacaggcgttccttgggcggggccggggcggggaccacttataagagggaggccgtgggg

SEQ ID NO: 18071 - protein, 91 aa, Zea mays
  misc_feature: Ceres CLONE 1383647-F
MQVGGGAADSPGAAAAAGAEAPRPNPLRVSKTAGTGTRSGQYLRNHRPPLELAAGAEAPTGSEVFFPTSHQFPERTKGPRARGAPFFRPPG

SEQ ID NO: 18072 - DNA, 626 bp, Zea mays
  misc_feature: Ceres CLONE 1383652-F
  misc_feature (322)..(322): n is a, c, t, g, unknown, or other
  misc_feature (323)..(323): n is a, c, t, g, unknown, or other
  misc_feature (349)..(349): n is a, c, t, g, unknown, or other
  misc_feature (350)..(350): n is a, c, t, g, unknown, or other
  misc_feature (384)..(384): n is a, c, t, g, unknown, or other
  misc_feature (385)..(385): n is a, c, t, g, unknown, or other
  misc_feature (393)..(393): n is a, c, t, g, unknown, or other
  misc_feature (404)..(404): n is a, c, t, g, unknown, or other
  misc_feature (407)..(407): n is a, c, t, g, unknown, or other
  misc_feature (481)..(481): n is a, c, t, g, unknown, or other
  misc_feature (501)..(501): n is a, c, t, g, unknown, or other
tggagctccccgcggtggcggccgctctagaactagtggatcccccgggctgcaggaattcgcacgagaccattacctagaacatcctaatcgaaaaattatcaagaaaccatgagttctaggttagctgaaatctcccttattgtaatctgttcatctcctggcgtgagtctgtggcgctagtgtgatgccttctcctagctcatggcttccggttcgcaatccctaatcctgatctcacttaagcgctcgtgagctctctccagtggctaagattgcagatttgagtatagtccagaaaacggtggtggtccgccatggnnagtgagtcccgagcaagggctgatgnncgggaaggatctattcggtatgccaaagagccgnnccgcgcgnttccgggccgncgncgtccgccgcatgcaaaggtgcgcatggcgtacacctcggacggaccgctgtgtccctccgatgaaatctcggncgcgacggcgtcttaacagncgcagggtggagcccacggcgctagcatgtccgggggggacaatcattggaagcaatggcgcgccacttgcgccgagatgggggaagcccgtgccaagaagaaacccgccgaccaaggagtatgc

SEQ ID NO: 18073 - DNA, 706 bp, Zea mays
  misc_feature: Ceres CLONE 1383656-F
  misc_feature: Encodes the peptide sequence at SEQ ID NO. 18074
aaagctggagctccccgcggtggcggccgctctagaactagtggatcccccgggctgcaggaattcgcacgagaccatacctagaacatcctaatcggaactccaaagtttcgtccaccatttcgctcccgcaagcaccgatttgtttactgctctctccgacgcgcggcggcggagctccctacgacgactgaaccatgtgcggcggcgcgatccttgccaccttcgcgagcgggccgcgccggctcacagagcgggacatctggcagcagaaaagaactcagagggcggcggcggcggagcgctcttcgcggcggaggacgatgagacttcgaggccgactttgagggcttcgaggcccactccagggattcgattgggagctcagggaggggactgacgacaacgtcttccagaataagcccttcactgccaggagggcttttccccggggatgggcttaagcccccaggcctaaggggtggaacaaggggccccccaaagggaaaaaaaaaagaaactattccgggggtatcccccccgggggccttgggggaaaaggggggcttgcttgaaaaccaaaaaacccctcccaaaggggggggcccggggtttgggcttgggaaacttttccaaaaaacccccgggaggaaaccttgcaaaaaacttttatataatgccccaaaaaccgggccagggatttccg

SEQ ID NO: 18074 - protein, 49 aa, Zea mays
  misc_feature: Ceres CLONE 1383656-F
MCGGAILATFASGPRRLTERDIWQQKRTQRAAAAERSSRRRTMRLRGRL

SEQ ID NO: 18075 - DNA, 797 bp, Zea mays
  misc_feature: Ceres CLONE 1383657-F
  misc_feature (1)..(1): n is a, c, t, g, unknown, or other
  misc_feature (13)..(13): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (244)..(244): n is a, c, t, g, unknown, or other
  misc_feature (253)..(253): n is a, c, t, g, unknown, or other
ncccccccccccnccccncnntttttttttggnnntttttnnnntttcatagctggagctccaccgcggtggcggccgctctagaactagtggatcccccgggctgcaggaattcgcacgagaccattacctagaacatcctaatcgaaaaaaaaaaaattaaccatattattgagaccaacaagcaacatagaaagtggaatccagtagcaacaacagagcaacaatggcgaccaagatattnttccctccnttatgctccttgctctttctgcatgtgttgctaacgcgacaattttccctcaatgctcacaagctcctatagcttcccttcttcccccataccttccatcaatgatagcttcagtatgtgaaaaccccagctctttcaggccctatagggtcccaacaagcaattcgcaagcaaagcaacataacctttatccaccctttggttgttttcaacaatcccccacgccctatccttggggggccagtcatttgggaacaaaaccatccaggggcacaggcagcctgcaagcaaactcggggctaacctggggatcaacccaaggtaagttctggggaaaaccttttcctcccttacttcccaaggaacaaaaaattttctttccattttaaaccaaactggtctaacccctgaaacccctggctgggttaaatttggcagcaaacaaactaatttaacccatttcagcccagggttagcgtaactgggccttaactctcaagaaaacacaacaaactttctttcccattttaacccaaattggggg

SEQ ID NO: 18076 - DNA, 681 bp, Zea mays
  misc_feature: Ceres CLONE 1383658-F
  misc_feature: Encodes the peptide sequence at SEQ ID NO. 18077
  misc_feature (303)..(303): n is a, c, t, g, unknown, or other
  misc_feature (324)..(324): n is a, c, t, g, unknown, or other
  misc_feature (546)..(546): n is a, c, t, g, unknown, or other
  misc_feature (554)..(554): n is a, c, t, g, unknown, or other
aaagctggagctccccgcggtggcggccgctctagaactagtggatcccccgggctgcaggaattcgcacgagaccattacctagaacatcctaatcgaaaactccgcgcactccacccaactcgccgccgccgctgccaacgccgcctgctgccgcagccgccatgggggcgtacaagtatgtgtcggaactatggaggaggaagcagtcggacgtgatgcgcttcgtgcagcgcgtgcgctgctgggagtacaggcagcagccgtccatcgtccgcctcaccaggcccacccgccccgacnaggcccgtcgtctcggctacnaggccaagcagggatatgttgtctaccgtgtccgtgtgaagcgtggtggcaggaagaggcctgtgcccaagggtattgtctatggcaagcccaagcaccagggtatcacccaactcaagttccagaggaacaagaggtctgtcgctgaggagagagctggacgtaagcttggtggactgagggttcttaactcctactgggtgaatgaggatagtacctacnagtatttngagatcatccttgtggacgttgcccacaaagccatcaaaactgacccgaggatcaactggctatgcaaccctgtgcacaagcacccgcgagctccgtggcctccactcggcagggcaagagttccgg

SEQ ID NO: 18077 - protein, 172 aa, Zea mays
  misc_feature: Ceres CLONE 1383658-F
  misc_feature (2)..(164): Pfam Name: Ribosomal_L15e Pfam Description: Ribosomal L15
  misc_feature (47)..(47): Xaa is any aa, unknown, or other
  misc_feature (54)..(54): Xaa is any aa, unknown, or other
  misc_feature (128)..(128): Xaa is any aa, unknown, or other
  misc_feature (130)..(130): Xaa is any aa, unknown, or other
MGAYKYVSELWRRKQSDVMRFVQRVRCWEYRQQPSIVRLTRPTRPDXARRLGYXAKQGYVVYRVRVKRGGRKRPVPKGIVYGKPKHQGITQLKFQRNKRSVAEERAGRKLGGLRVLNSYWVNEDSTYXYXEIILVDVAHKAIKTDPRINWLCNPVHKHPRAPWPPLGRARVP

SEQ ID NO: 18078 - DNA, 710 bp, Zea mays
  misc_feature: Ceres CLONE 1383662-F
  misc_feature: Encodes the peptide sequence at SEQ ID NO. 18079
  misc_feature (592)..(592): n is a, c, t, g, unknown, or other
ggagctccccgcggtggcggccgctctagaactagtggatcccccgggctgcaggaattcgcacgagaccattacctagaacatcctaatcgaaaactttcctttccctacggcggcggcgctggagcagctaagcagcagcaagatgttcgacggcttcaatctccgcttccgccgccagagcgccacccttggctgcgccatgactttctccatctacctgcccccgtccccggtgtccaaccttcccgtgttgtactggctctcgggtctcacctgcaccgaggataatttcatcataaagtccggcgcccagcacgccgccgctgcccacggcatcgccctcgtggcacctgacacctccccacttatcttctgcatgatggattcatttgatggaactattttaggcctctgattgcggaatacagatcgatttgcttgtcacaggataaagcagatccacgatgagtagaagcgtgggcatccaaatgaataaccaggggagagcaggctagggaaatttgctaggctggagcagtcacagagctagggactacagtcataggtcctgctagccagggtggaccanccataaaacccctaacagtcaagggaaattttgctagggggaggaaatttggggcaccctggcctggacccctggggtgggtgaaaaaacaatttacggggagggtcgggggacccca

SEQ ID NO: 18079 - protein, 90 aa, Zea mays
  misc_feature: Ceres CLONE 1383662-F
  misc_feature: SWISSPROT Homolog: EC 3.1.2.12 S-formylglutathione hydrolase
MFDGFNLRFRRQSATLGCAMTFSIYLPPSPVSNLPVLYWLSGLTCTEDNFIIKSGAQHAAAAHGIALVAPDTSPLIFCMMDSFDGTILGL

SEQ ID NO: 18080 - DNA, 626 bp, Zea mays
  misc_feature: Ceres CLONE 1383668-F
  misc_feature: Encodes the peptide sequence at SEQ ID NO. 18081
tggagctccccgcggtggcggccgctctagaactagtggatcccccgggctgcaggaattcgcacgagaccattacctagaacatcctaatcgaaaagaaaagctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggca

SEQ ID NO: 18081 - protein, 142 aa, Zea mays
  misc_feature: Ceres CLONE 1383668-F
  misc_feature (10)..(81): Pfam Name: RRM_1 Pfam Description: RNA recognition motif. (a.k.a. RRM, RBD, or RNP domain)
  misc_feature (48)..(142): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGGYGGGRGGGGYGGGGRRDGGGGYGGGGGYGGGGGGYGGGGGGYGGG

SEQ ID NO: 18082 - DNA, 607 bp, Zea mays
  misc_feature: Ceres CLONE 1383671-F
  misc_feature (204)..(204): n is a, c, t, g, unknown, or other
  misc_feature (219)..(219): n is a, c, t, g, unknown, or other
  misc_feature (234)..(234): n is a, c, t, g, unknown, or other
  misc_feature (263)..(263): n is a, c, t, g, unknown, or other
  misc_feature (307)..(307): n is a, c, t, g, unknown, or other
  misc_feature (343)..(343): n is a, c, t, g, unknown, or other
ggagctccccgcggtggcggccgctctagaactagtggatcccccgggctgcaggaattcgcacgagaccattacctagaacatcctaatcgaaaagctccgggctccgctgctaggctagggtttggactttggattggagccgcaccgccgcaccggcaccgcagtcgccgcagtgccgcacagccaccactcccatcttgntcttgcggctagtcngcctcggaacctcgncatcgaccccttgccgcttgccgagacgncgagtaagcgtcgaacgtcgtcgctgtcgtcaccgaagtccaanggcccaacagccgggtttcaagcttcagacatctgnggccgcccctcctccgccagacacccagtggccaaagcccaaaaaccccagtccccaaagcccacaaggtatcaaggtgcaaggaatgactcttctgttgatgcgtcccaagagatgagcttcatggccaacaagctgtacaaacttaaagaaaaagggggcattcacgaaaccggatgagatctatttttaaatggtccaccgtaagactggtggtggaaattctaaaaactaaagcctgaaaataataaagatactggagaa

SEQ ID NO: 18083 - DNA, 617 bp, Zea mays
  misc_feature: Ceres CLONE 1383675-F
  misc_feature: Encodes the peptide sequence at SEQ ID NO. 18084
  misc_feature (401)..(401): n is a, c, t, g, unknown, or other
tccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaagaatggcaagcctttcatgtgctcgggcggacggtgttgtccgttccggcgctctgcccgccaagctggtgctgtgcngcagctgctgcttcccctacgcggctcccagtcgcgaccgagaggtgcaagtgcttggctggccgcagcatctccaccgcttgccgaggcgtcaggatctccgtcgccagcgcccgcgccgtcgcatcctcagctcgtcggcctccaccagcagccgcgacagcgcgggcttgtagctgtccagcgccgcgtccacctcggcgtccgcggctccta

SEQ ID NO: 18084 - protein, 94 aa, Zea mays
  misc_feature: Ceres CLONE 1383675-F
  misc_feature (37)..(37): Xaa is any aa, unknown, or other
MLLTSCRQGRRMASLSCARADGVVRSGALPAKLVLCXSCCFPYAAPSRDREVQVLGWPQHLHRLPRRQDLRRQRPRRRILSSSASTSSRDSAGL

SEQ ID NO: 18085 - DNA, 608 bp, Zea mays
  misc_feature: Ceres CLONE 1383677-F
  misc_feature: Encodes the peptide sequence at SEQ ID NO. 18086
  misc_feature (211)..(211): n is a, c, t, g, unknown, or other
  misc_feature (214)..(214): n is a, c, t, g, unknown, or other
  misc_feature (217)..(217): n is a, c, t, g, unknown, or other
  misc_feature (220)..(220): n is a, c, t, g, unknown, or other
  misc_feature (426)..(426): n is a, c, t, g, unknown, or other
  misc_feature (444)..(444): n is a, c, t, g, unknown, or other
tccccgcggtggcggccgctctagaactagtggatcccccgggctgcaggaattcgcacgagaccattacctagaacatcctaatcgaaaaacactgaactgaacacgcgcgcgcgcacgccatccgcctcccgtagcgtgcggcgtgccgtcaatccaaaccaccaaaagcaatgccgccgccgtccgcaaacggggccaccggcgccgncgncgncgngagggacgacatgtccccggcggaagccaggctggcgatgatggagcttgcgaacatggtgtccgtgccgatggcgcttgcggccgtgattcggcttggcgtgcccgccgcggtgtgtggccggcggcgcccacacggccatggtaaggggcggacttcttccggcgggccacccggaacgttcgttcctggagacgctgctccgnctgctgcgtccccgcggngttttctctcagattcaccgagtcacgcccaccacgcggcggcggctattcgctccaacccccggtgggcgcaccttggttggcccgggggcccccttcggggggggtcctataacgaactattaggggtggagaacacaagaaacgcttgttggtggggggcg

SEQ ID NO: 18086 - protein, 145 aa, Zea mays
  misc_feature: Ceres CLONE 1383677-F
  misc_feature (13)..(13): Xaa is any aa, unknown, or other
  misc_feature (14)..(14): Xaa is any aa, unknown, or other
  misc_feature (15)..(15): Xaa is any aa, unknown, or other
  misc_feature (16)..(16): Xaa is any aa, unknown, or other
  misc_feature (85)..(85): Xaa is any aa, unknown, or other
  misc_feature (91)..(91): Xaa is any aa, unknown, or other
MPPPSANGATGAXXXXRDDMSPAEARLAMMELANMVSVPMALAAVIRLGVPAAVCGRRRPHGHGKGRTSSGGPPGTFVPGDAAPXAASPRXFLSDSPSHAHHAAAAIRSNPRWAHLGWPGGPLRGGSYNELLGVENTRNACWWGA

SEQ ID NO: 18087 - DNA, 621 bp, Zea mays
  misc_feature: Ceres CLONE 1383680-F
  misc_feature: Encodes the peptide sequence at SEQ ID NO. 18088
tggagctccccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcaggagcgggggcagcacgcccgtgggcggcaagccgccacgccaccacctcacgtccatccgccactgcgccagcagtgcccgcatcgccgctgcctccgccgaattcgtaagcaagctcgctgccacccaagccatctatccctaacacgaatttgatgtctgcccttctgttctcctgcaggggctggagtcggggacgctcagcttgatttcacctaccgcagacatccgtccgggcttcttgcctgtgttcaggtcggg

SEQ ID NO: 18088 - protein, 66 aa, Zea mays; identical to SEQ ID NO: 17379
  misc_feature: Ceres CLONE 1383680-F

SEQ ID NO: 18089 - DNA, 631 bp, Zea mays
  misc_feature: Ceres CLONE 1383696-F
  misc_feature: Translation starting site: 166
  misc_feature (540)..(540): n is a, c, t, g, unknown, or other
tggagctccccgcggtggcggccgctctagaactagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcacaagctcctatagcttcccttcttcccccatacttccatcaatgatagcttcagtatgtgaaaacccagctcctcagccctattggcttcacacagcaatcgcagcaagcaacatacctttatcaccctctggtggttccaccaatcgcagccctatctttggtggaagtcattgggtacaaaccatcagggcacagcagctgcagcaactcgtgctaacctggtgatcaaccaagtagctctggcaaacctttctccctactctcagcaacaacaatttcttccattcanccaactgtctacactgaaccctgctgcttatttgcagcaacaactattaccattcagccagctagctactgcctactctcagcaacaacaa

SEQ ID NO: 18090 - DNA, 628 bp, Zea mays
  misc_feature: Ceres CLONE 1383698-F
  misc_feature: Encodes the peptide sequence at SEQ ID NO. 18091
ggagctccccgcggtggcggccgctctagaactagtggatcccccgggctgcaggaattcgcacgagaccattacctagaacatcctaatcgaaaagtattttggttcctcactgccgcgccgccaccccctacaggtaaggaagaggagggcaggatgtcgcaccgtaagttcgagcacccgaggcacggctccctcggtttccttcccaggaagcgctcctcccgtcaccgcggcaaggtggagtcattccctagggatgaccccaagaagccttgccatctcactgccttccttggctacaaggctggcatgactcacattgaccgtgaggttgagaagccaggatccaaactccataagaaggaaacttgtgaggctgttaccatcattgaaacccctcctcttgtcattgatgggctcgtggcatatgtgaagactcctcgtggcctccgcacactcaactctgtttggtgccaacatcttagtgaagaagtgaggagaaggttctaccagaactggtgcaagagcaagaagaaggctctcacaaagtatgctctcaaatatgaacatgatgctggcaagaaggaaattcagctgcagcttgacaagatgaagaaatatgctt

SEQ ID NO: 18091 - protein, 157 aa, Zea mays
  misc_feature: Ceres CLONE 1383698-F
  misc_feature (50)..(157): Pfam Name: Ribosomal_L3 Pfam Description: Ribosomal protein L3
MSHRKFEHPRHGSLGFLPRKRSSRHRGKVESFPRDDPKKPCHLTAFLGYKAGMTHIDREVEKPGSKLHKKETCEAVTIIETPPLVIDGLVAYVKTPRGLRTLNSVWCQHLSEEVRRRFYQNWCKSKKKALTKYALKYEHDAGKKEIQLQLDKMKKYA

SEQ ID NO: 18092 - DNA, 657 bp, Zea mays
  misc_feature: Ceres CLONE 1383700-F
  misc_feature: Encodes the peptide sequence at SEQ ID NO. 18093
  misc_feature (571)..(571): n is a, c, t, g, unknown, or other
  misc_feature (572)..(572): n is a, c, t, g, unknown, or other
  misc_feature (615)..(615): n is a, c, t, g, unknown, or other
  misc_feature (642)..(642): n is a, c, t, g, unknown, or other
  misc_feature (650)..(650): n is a, c, t, g, unknown, or other
  misc_feature (653)..(653): n is a, c, t, g, unknown, or other
  misc_feature (654)..(654): n is a, c, t, g, unknown, or other
tccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggnncttgtagctgtccagcgcccgtccaaactcgggcgtccgcggnttcctagccgggccgccctggagccgncgccgcgncgnnacc

SEQ ID NO: 18093 - protein, 109 aa, Zea mays
  misc_feature: Ceres CLONE 1383700-F
  misc_feature (94)..(94): Xaa is any aa, unknown, or other
  misc_feature (108)..(108): Xaa is any aa, unknown, or other
MLLTSCRQGRGMASLSCARADGVVRSGALPAKLLLCASCCFPTAAPVADGEVQVLACRQHLHRLPRRQDLRRQRPRRRHPQLVGLHQQPRQRGXCSCPAPVQTRASAXS

SEQ ID NO: 18094 - DNA, 646 bp, Zea mays
  misc_feature: Ceres CLONE 1383707-F
  misc_feature: Encodes the peptide sequence at SEQ ID NO. 18095
  misc_feature (408)..(408): n is a, c, t, g, unknown, or other
  misc_feature (480)..(480): n is a, c, t, g, unknown, or other
  misc_feature (488)..(488): n is a, c, t, g, unknown, or other
tccccgcggtggcggccgctctagaactagtggatcccccgggctgcaggaattcgcacgagaccattacctagaacatcctaatcgaaaaacatcccaattggaagggcagctaataaggtaaggggcgacgaaaatggctccaacgaccgccaccaaggacgacagtggctacggcgacgagcgccggcgcgagctgcaggcgttcgacgacacgaagctgggggtgaaaggtctggtggactccggcgtcaagtccatcccgtccatcttccaccacccgccggaagccctgagcgacataatttctccggcgcctctgccgccgtcgccgccctccggcgccgccatcccggtggtggacctctcggtgacgcggcgcgaggacctagtcgagcaggtgaggcnacgcggccgggacggtgggcttcttctggctggtgaaccacggagtgccggaggagctgatgggcggatgcntccgcggngtggcgtacaagaacccccccggggggggggggggaaaaaaaaaccccccctttatagtggggggcatctcgctggaacgcgggcgttttcgcctccaacttcgaccttcttcaggggtggtggcggccgactggcgcgaacgctttttttgggggag

SEQ ID NO: 18095 - protein, 170 aa, Zea mays
  misc_feature: Ceres CLONE 1383707-F
  misc_feature: SWISSPROT Homolog: EC 1.14.11.20 Desacetoxyvindoline 4-hydroxylase
  misc_feature (91)..(91): Xaa is any aa, unknown, or other
  misc_feature (115)..(115): Xaa is any aa, unknown, or other
  misc_feature (118)..(118): Xaa is any aa, unknown, or other
MAPTTATKDDSGYGDERRRELQAFDDTKLGVKGLVDSGVKSIPSIFHHPPEALSDIISPAPLPPSPPSGAAIPVVDLSVTRREDLVEQVRXRGRDGGLLLAGEPRSAGGADGRMXPRXGVQEPPRGGGGKKKPPLYSGGHLAGTRAFSPPTSTFFRGGGGRLARTLFLGE

SEQ ID NO: 18096 - DNA, 665 bp, Zea mays
  misc_feature: Ceres CLONE 1383720-F
  misc_feature: Encodes the peptide sequence at SEQ ID NO. 18097
  misc_feature (555)..(555): n is a, c, t, g, unknown, or other
  misc_feature (556)..(556): n is a, c, t, g, unknown, or other
  misc_feature (606)..(606): n is a, c, t, g, unknown, or other
  misc_feature (624)..(624): n is a, c, t, g, unknown, or other
tggagctccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttaacgtgtggagtgatgcagaggatctcaatctttatggagaatgggactttgaggtgatatgactggtttcctgagnncctggggtgttaatgctatgtgattatcatggctacgtggatcatatcanaatgatgactctataaanctactgccggtcctcgggatctaaaaattctggtgcgacac

SEQ ID NO: 18097 - protein, 114 aa, Zea mays
  misc_feature: Ceres CLONE 1383720-F
  misc_feature (19)..(115): Pfam Name: AIG2 Pfam Description: AIG2-like family
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTRTRVEISLADSSENMLADT

SEQ ID NO: 18098 - DNA, 646 bp, Zea mays
  misc_feature: Ceres CLONE 1383723-F
  misc_feature: Encodes the peptide sequence at SEQ ID NO. 18099
  misc_feature (640)..(640): n is a, c, t, g, unknown, or other
acaagctggagctccccgcggtggcggccgctctagaactagtggatcccccgggctgcaggaattcgcacgagaccattacctagaacatcctaatcgaaaaacctagaacatcttaatcgaaaattatattcttctgcctgcccttccgttcaatttcaatttcactttccttctctcctctcctcctgctgctactaggttcgggccgtccgtccttgctcttgatctgcattatttaattcggaccattcccccgccgtcctcccgcccgcctgccggagatggagatggagaacgggcacgccaagtaccgggtggccgtcattggcagcggcaactggggcagcgtcgcctcccgcctcatcgcctccaacaccgccaagctgccctccttctatgatgaagtaaggatgtgggtgtttgaggaaatactgcctacaggcaggaagctatctgagtccattaacgaacagaatgagaactgcaaatacttgccaggtataaagcttggaacgaatgttattgccgaccctgacttggagagcgcagtcaaagacgcgaatatgctggtttttgtgacgccccatcaatttgtggagggtatatgtaagaagcttgtagggaagctaacaccagnagctga

SEQ ID NO: 18099 - protein, 120 aa, Zea mays
  misc_feature: Ceres CLONE 1383723-F
  misc_feature (10)..(120): Pfam Name: NAD_Gly3P_dh_N Pfam Description: NAD-dependent glycerol-3-phosphate dehydrogenase N-terminus
  misc_feature: SWISSPROT Homolog: EC 1.1.1.8 Glycerol-3-phosphate dehydrogenase (NAD(+))
  misc_feature (119)..(119): Xaa is any aa, unknown, or other
MEMENGHAKYRVAVIGSGNWGSVASRLIASNTAKLPSFYDEVRMWVFEEILPTGRKLSESINEQNENCKYLPGIKLGTNVIADPDLESAVKDANMLVFVTPHQFVEGICKKLVGKLTPXA

SEQ ID NO: 18100 - DNA, 650 bp, Zea mays
  misc_feature: Ceres CLONE 1383725-F
ggagctccccgcggtggcggccgctctagaactagtggatcccccgggctgcaggaattcgcacgagaccattacctagaacatcctaatcgaaaaaatccgtgttccgtgtccgcgtccagagtgtccgttactccgctccccctcattcctcggttcctcacctagaggcagcgtgcgctcgctacacttacatgatgtcttcctaggtggcagtgtcgtctacaacaccggctactccaactgagggtacggtgatagcgatccacaacctggaggagtgtagcatccagatcaaggaggacaacgaagcctagaacctggtggtgattgacttcactgctctatgcctgtactccgtgccacgccatggatcctatttttgctgatatggcctagaagacccaaatgctgatttcctgatattgctgtggatgaaatgaagaccattgctgagcaattcagagaagaggacatgccaacattcctgatcatgtagttaggacgacgtccaggatcgtttctatggcgcatcaaaggaatacctagcaaggaagcttgaactactcatggtctctgacattaatgatgccgaaatggaacattctgctagataagaggacgcctccgctcacctctgagataactaa

SEQ ID NO: 18101 - DNA, 649 bp, Zea mays
  misc_feature: Ceres CLONE 1383726-F
  misc_feature: Encodes the peptide sequence at SEQ ID NO. 18102
  misc_feature (519)..(519): n is a, c, t, g, unknown, or other
  misc_feature (540)..(540): n is a, c, t, g, unknown, or other
  misc_feature (591)..(591): n is a, c, t, g, unknown, or other
tccccgcggtggcggccgctctagaactagtggatcccccgggctgcaggaattcgcacgagaccattacctagaacatcctaatcgaaaagagcgagctttccttcggaactctctcgtgctcacctcatccgtccgacagatccacacgaatcctctgattcagagcagggtgttggcattgatcagacgcctgccatggcggatcagttcgaggattcggcgaacaatgtgatcattgaggaggtgaacaagggcctgaacccaggaatggtggttctgcttgtggttgcaagcttcctgctgatcttctttgtggggaactatgcgctgtatgtgtatgcgcagaagacgctcccgccaaagaagaagaagccggtgtcgaagaagaagctgaagaaggaaaagctgaagcagggggtctctgcgccgggagagtaaacggccatgctgccgatcctcccgtccagagctcctattcacatgattattagagaaaaaaattatatatatataccnagatggagcccgtagtgttgnaagtaactttggttctgtagatgctctggtctttaatggggtacatctgtnattggagacttttgagaccttgtttcagcaactgatgaatcttagcctgagccgagct

SEQ ID NO: 18102 - protein, 80 aa, Zea mays
  misc_feature: Ceres CLONE 1383726-F
  misc_feature (10)..(80): Pfam Name: S1FA Pfam Description: DNA binding protein S1FA
MADQFEDSANNVIIEEVNKGLNPGMVVLLVVASFLLIFFVGNYALYVYAQKTLPPKKKKPVSKKKLKKEKLKQGVSAPGE

SEQ ID NO: 18103 - DNA, 619 bp, Zea mays
  misc_feature: Ceres CLONE 1383742-F
cgcggtggcggccgctctagaactagtggatcccccgggctgcaggaattcgcacgagaccattacctagaacatcctaatcgaaaaatccgattcactccaatacagattcatcgccttaaacccctctttaaatccattaactacgatctacccttcaattcgagtttctcatctgcaaggcggtctatctgcgattagccttcctccaataaaattcatcttcccagttcgttaaaacaacaaagtaaatttatttaccgacaaatggctgatttcaaagttcttctttctgatttgaagtcaatcgcggttgggaacttatatgctcttactagatgcaaagttgctttgttgatgacatagaagaaaagaagggagggagcagaaggagagtattgttaatggtatcagagagactgtcaaaaatataactctgtccatgtttctcttttgaaaacatgaaaaatatcaaattcaaggagtttagacaacagtttagacacaacgaaaggttcttcctcggctagaacaaattgatgcagtttgctcttggtccttctgcttgggatgaaatccatcctgccatctttaaagcttccaagattcttcatggtga

SEQ ID NO: 18104 - DNA, 625 bp, Zea mays
  misc_feature: Ceres CLONE 1383745-F
  misc_feature: Encodes the peptide sequence at SEQ ID NO. 18105
  misc_feature (586)..(586): n is a, c, t, g, unknown, or other
cgcggtggcggccgctctagaactagtggatcccccgggctgcaggaattcgcacgagaccattacctagaacatcctaatcgaaaagttcactagcttcggagtttctttcgaataattaaaacgaaaacaatggcgacggttcagttcttcaaccaattcccctgcacaacccgagtccaaagcccaccaaaccctaaacccctctccaagccaacgactctggtgcctatgagcacgctcactcgccgtccgttgttctcccccggcgaattcgccgtttcccgtgcggatttcagagtcagagtcatcgatgcagaagacgagttggatccggagacgagtgagggaggatctgctctattgatggcggaggaagcaatcgaatccgtggaagagacggaggttctcaagagatcgctggtggattcgttgtacggcacagaccgagggttgagcgcatcgagcgagacgagagccgagatcggagatctaatcacacagctcgagtccaagaaccctacaccagctcccaccgatgctctcttccttctcaacggcaaatggatcctcgcgtacacatcgnttcgttggtttgttcccgttgctttcacgagggatcgtg

SEQ ID NO: 18105 - protein, 131 aa, Zea mays
  misc_feature: Ceres CLONE 1383745-F
  misc_feature (58)..(131): Pfam Name: PAP_fibrillin Pfam Description: PAP_fibrillin
  misc_feature (119)..(119): Xaa is any aa, unknown, or other
MSTLTRRPLFSPGEFAVSRADFRVRVIDAEDELDPETSEGGSALLMAEEAIESVEETEVLKRSLVDSLYGTDRGLSASSETRAEIGDLITQLESKNPTPAPTDALFLLNGKWILAYTSXRWFVPVAFTRDR

SEQ ID NO: 18106 - DNA, 651 bp, Zea mays
  misc_feature: Ceres CLONE 1383753-F
  misc_feature: Encodes the peptide sequence at SEQ ID NO. 18107
  misc_feature (531)..(531): n is a, c, t, g, unknown, or other
  misc_feature (543)..(543): n is a, c, t, g, unknown, or other
  misc_feature (544)..(544): n is a, c, t, g, unknown, or other
tccccgcggtggcggccgctctagaactagtggatcccccgggctgcaggaattcgcacgagaccattacctagaacatcctaatcgaaaaaatcacgaatcaccaacaccctctcctccaccttccatcccgatcaccgccgccaccgctttcgttccacgtcccgatggcaccggtagatctaacccccaggcagccccggaaggcgtatggcggcgacgccggcgcctactacgagtggagcccagccgacctgcccatgctcggcgtcgcctccatcggcgcagccaagctctccctcgccgccggtgggctctcgctccccagctactccgactcttccaaggttgcgtacgttcttgaaggcactggcacctgcggcatcgtcctgccggaggcgaccaaggagaaggtgctggccgtgaaggagggcgacgccctcgcgctccccttcggtgtggtcacgtggtggcacaacggtcccgccgcgccgacccagctcacggtcctcttcctcggcgacacctccnagggccaagggnncgtggcagttcaccaactttcagctgacgggcgcgagcggcatcttcacgggcttctcccaccgagttcgtgtcgcgcgcgtgggacctgaccgaggcgacgccgcg

SEQ ID NO: 18107 - protein, 155 aa, Zea mays
  misc_feature: Ceres CLONE 1383753-F
  misc_feature (6)..(138): Pfam Name: Cupin_1 Pfam Description: Cupin
  misc_feature (122)..(122): Xaa is any aa, unknown, or other
  misc_feature (126)..(126): Xaa is any aa, unknown, or other
MAPVDLTPRQPRKAYGGDAGAYYEWSPADLPMLGVASIGAAKLSLAAGGLSLPSYSDSSKVAYVLEGTGTCGIVLPEATKEKVLAVKEGDALALPFGVVTWWHNGPAAPTQLTVLFLGDTSXGQGXVAVHQLSADGRERHLHGLLPPSSCRARGT

SEQ ID NO: 18108 - DNA, 641 bp, Zea mays
  misc_feature: Ceres CLONE 1383763-F
  misc_feature: Encodes the peptide sequence at SEQ ID NO. 18109
ccccgcggtggcggccgctctagaactagtggatcccccgggctgcaggaattcgcacgagaccattacctagaacatcctaatcgaaaactttttgctcggctgacaccaggtagccgcccctcctctatccaccccttcacttgcttggtcttccactcacccctctctcgttattcacccggtctcctctcctgcaaagaggtacgtaactgcactttcctgctcagtcttttgatcggtttcagtgatgcactgatgctgtagagtttcgtttctgttagtactctaatcaacggacaacggtttctgttagtattcttgggttcatggctgtctgcagattgtcgcccttgctctgcctgctctattcggcctcagttcattctgtcgtaaacctcacctcgtaactgaaataagccatatgcgccgcgcgtcgaagcttagtgtctgatcgatacgctatccctacaattttctgagctgttgaactcctgcgcccgtctcctcgtcgaggacaggaagatgagctcgctacacgccacacgagcggagcttggcctggttgtcctgtacctgaacaaagccgaggcccgggacaagatctgcagggcgatccagaacggctccaagttcgtaag

SEQ ID NO: 18109 - protein, 38 aa, Zea mays
  misc_feature: Ceres CLONE 1383763-F
MSSLHATRAELGLVVLYLNKAEARDKICRAIQNGSKFV

SEQ ID NO: 18110 - DNA, 662 bp, Zea mays
  misc_feature: Ceres CLONE 1383767-F
  misc_feature: Encodes the peptide sequence at SEQ ID NO. 18111
  misc_feature (428)..(428): n is a, c, t, g, unknown, or other
  misc_feature (527)..(527): n is a, c, t, g, unknown, or other
tggagttcaccgcggtggcggccgctctagaactagtggatcccccgggctgcaggaattcgcacgagaccattacctagaacatcctaatcgaaaaattttttcgactttcgagcgcagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctactgcaggtgctccacctgctgagaaaccacctgctgcaaagcctgatggcaccagtcagattgctgctggggttaccagccaaaccaataactaccnacagggccgacggtcagaacaccggaaactttccttacggaccgtccttcgaccaaggtccacgctgcttcctggcggtggctcttccctgggataccntgtttggtggcaactgatgccgctcaccaagctatcaccccccactgtcgccgcatgctttttctgatcgtgaaacagccgttgtcatttcatgtgtaccaaacctccgggtccggcgtggggccgtaagtgcgc

SEQ ID NO: 18111 - protein, 124 aa, Zea mays
  misc_feature: Ceres CLONE 1383767-F
  misc_feature (70)..(70): Xaa is any aa, unknown, or other
  misc_feature (103)..(103): Xaa is any aa, unknown, or other
MSRGGSAGGGQSSLGYLFGSGEPPKPAVAPAVSAPPATAGAPPAEKPPAAKPDGTSQIAAGVTSQTNNYXQGRRSEHRKLSLRTVLRPRSTLLPGGGSSLGYXVWWQLMPLTKLSPPTVAACFF

SEQ ID NO: 18112 - DNA, 646 bp, Zea mays
  misc_feature: Ceres CLONE 1383784-F
  misc_feature: Translation starting site: 229
  misc_feature: Pfam Name: DUF841 Pfam Description: Eukaryotic protein of unknown function (DUF841)
  misc_feature (603)..(603): n is a, c, t, g, unknown, or other
  misc_feature (646)..(646): n is a, c, t, g, unknown, or other
aaagctggagctccccgcggtggcggccgctctagaactagtggatcccccgggctgcaggaattcgcacgagaccattacctagaacatccaatcgaaaagttgcgtagccaaatcgagatctccgtctcccccgtgacgaatcccacgcccacctctccccgacccggctgggcgcagcaacagcgcatcgcaccgggaggcgggagccgaagaaccaaacaggagatggcgtcggcgctgtcctccctgcgctacggagacagcctctcggtggtgggcatctccgccgcgacgggcgtgctctgcgaggccatctcctggcttctcatctaccgcaccgccacctacgactccctccgcgcctccatcgaacgccactcacgcaagctggacgccatgaagtccggctccaactcctccggcgctgcctcctcctccgcgcaggccgcgttcgtcgcgggctaagaagatggaccgcgtcgagaccagcctcaaggacgccgcgcgggagctctcgcttgccaagctcaagtcgggcgccgtcgtcgccgccgtgctctttcgtcgtcttcggcctgctcaactcgctcttcgaggggncgcaccgtcggcaagctgccctttcgcgcccatccccgctcgn

SEQ ID NO: 18113 - DNA, 620 bp, Zea mays
  misc_feature: Ceres CLONE 1383791-F
  misc_feature: Encodes the peptide sequence at SEQ ID NO. 18114
aaagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgtcaattttcagagagcgaaggcgatcggcgttcggatcggcgcagcgcggtgaagaggagatgcatgccgtggtgatggatggcctgatccgcgctgcggatgtcgtgccgtacgagaagaggtaagcgctgagggcggaagctgctctaggaggcggccaaggacgtgaggatcaatcgaagaacgatgaggagagggagtatcacagcgacatgaggaacctggaggatctgctttctaatctgaacccctcgtgggaggagttcgtgccgcagtcccgccgtcgcgtggacggaggcgctccccgactttcggccgacgagaccgtgttcgtgtcgtcggcgatcgactaataagcgcgccaccaccagttcccgacgacgcatcttctgcatcagcagtagccgatgcacgtgatgcagtatgatgtatgcagtt

SEQ ID NO: 18114 - protein, 46 aa, Zea mays
  misc_feature: Ceres CLONE 1383791-F
MRNLEDLLSNLNPSWEEFVPQSRRRVDGGAPRLSADETVFVSSAID

SEQ ID NO: 18115 - DNA, 657 bp, Zea mays
  misc_feature: Ceres CLONE 1383802-F
aaagctggagctccccgcggtggcggccgctctagaactagtggatcccccgggctgcaggaattcgcacgagaccattacctagaacatcctaatcgaaaaatcgtacatattattgagacccactaacaacatacaactacaatagtgtaccaacaatggcagccaaaatattttgcctccttatgctccttggtctttctggaagtgctggtacgcggagcattttcccggaatgatctgaagctcctatagcttcccttcttcccccgtacctctcaccaacgtgggtcttcggtatgagaaaacccaattcttcaaccctacaggatccagacaggcaatcacagctggcatcttacctttatcacccttgttcctccaacaatcatcaggcctattacatcagatacctttggcgcatatattgtgacaaaacatcaggggacaacaactactacaacttgtgctagcaaaccttgctgcactactctcagcaacagtattctcttccattcaaccaactagctgcattgagctctgcttcttatttgcaacaacaaacactaccaatcagccagctacctgctgcctaccctcaggaaatttcttccattcaactaactgacagcattgaacgtctcctgcttatctaca

SEQ ID NO: 18116 - DNA, 683 bp, Zea mays
  misc_feature: Ceres CLONE 1383805-F
  misc_feature: Encodes the peptide sequence at SEQ ID NO. 18117
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (424)..(424): n is a, c, t, g, unknown, or other
  misc_feature (425)..(425): n is a, c, t, g, unknown, or other
  misc_feature (430)..(430): n is a, c, t, g, unknown, or other
  misc_feature (462)..(462): n is a, c, t, g, unknown, or other
  misc_feature (489)..(489): n is a, c, t, g, unknown, or other
  misc_feature (510)..(510): n is a, c, t, g, unknown, or other
  misc_feature (513)..(513): n is a, c, t, g, unknown, or other
  misc_feature (516)..(516): n is a, c, t, g, unknown, or other
  misc_feature (517)..(517): n is a, c, t, g, unknown, or other
  misc_feature (622)..(622): n is a, c, t, g, unknown, or other
  misc_feature (627)..(627): n is a, c, t, g, unknown, or other
  misc_feature (628)..(628): n is a, c, t, g, unknown, or other
aagctggagctccccgcggtggcggccgctctagaactagtggatcccccgggctgcaggaattcgcacgagaccattacctagaacatcctaatcgaaaaacactgcatcacaacacacgccagccagccatcgtcacactggtgagctctgcactctgcttagctccgagcttcagtgccttcgttgtttgctccacagtccacacacacacacgtccagctagctgcactgcaccaatggccgccgtcgaggtccaggtcccgactgccgctcccgtcgaggaggctgcccagctggccgccgcctccgccgtcgagaccccgaacgaggagaccgctgctccggcggtggagaccgaagtcgtcgtcgctaaggagccggagccggtggaggccgagactgagactgagaccannngagnncgagncgttgctgagccgacccgagcagagcccaagnaagcagagcccggagccgccgcgccgncagcagagacggaggtcaggnaancannaagacgagccgccgcgccggcagaaaagacgaaagctgctgctgccccgggtcgaagctgcttgacccggaaataaccccccaaaacaaaaaagtggcgcctggnagggnntttaacgaggaaagaaggaggaaggcaaccccctggtttttggtgccaatcccgg

SEQ ID NO: 18117 - protein, 117 aa, Zea mays
  misc_feature: Ceres CLONE 1383805-F
  misc_feature (60)..(60): Xaa is any aa, unknown, or other
  misc_feature (61)..(61): Xaa is any aa, unknown, or other
  misc_feature (62)..(62): Xaa is any aa, unknown, or other
  misc_feature (64)..(64): Xaa is any aa, unknown, or other
  misc_feature (75)..(75): Xaa is any aa, unknown, or other
  misc_feature (84)..(84): Xaa is any aa, unknown, or other
  misc_feature (91)..(91): Xaa is any aa, unknown, or other
  misc_feature (92)..(92): Xaa is any aa, unknown, or other
  misc_feature (93)..(93): Xaa is any aa, unknown, or other
MAAVEVQVPTAAPVEEAAQLAAASAVETPNEETAAPAVETEVVVAKEPEPVEAETETETXXXRXVAEPTRAEPKXAEPGAAAPXAETEVRXXXRRAAAPAEKTKAAAAPGRSCLTRK

SEQ ID NO: 18118 - DNA, 661 bp, Zea mays
  misc_feature: Ceres CLONE 1383810-F
  misc_feature: Encodes the peptide sequence at SEQ ID NO. 18119
  misc_feature (433)..(433): n is a, c, t, g, unknown, or other
  misc_feature (440)..(440): n is a, c, t, g, unknown, or other
  misc_feature (453)..(453): n is a, c, t, g, unknown, or other
  misc_feature (459)..(459): n is a, c, t, g, unknown, or other
  misc_feature (467)..(467): n is a, c, t, g, unknown, or other
  misc_feature (518)..(518): n is a, c, t, g, unknown, or other
tggagctccccgcggtggcggccgctctagaactagtggatcccccgggctgcaggaattcgcacgagaccattacctagaacatcctaatcgaaaaaagatccgatctccctctctctccccaatcctccccgcctccccgcctccccctaccaaatcagcaccacccaaggcgcatccgagccacggccgcgcaatgccgccctctgtcgatgcaatgccggcccccggagacgccgcgggcggcggcgacgtgcgcatgatctcctccaaggagctccgctctcacgcgtccgccgacgacctctggatctccatctccggcgacgtgtacgacgtcacgccctggctcccccaccaccgggcggcgacctcccgcttctcaccctggcggggcaggacgccaccgacgccttcgacggctaacacccgncctcggngcgcccgatcctnccgcgnttcttcgntggccgcctctccgaatacgccgtctcccccgcgtccgccgactacggccngctcctcggggagttatcctccgcgggcctcttcgaaggcgtcggccccacccccaaggcccagtcggccctgatggccgtccttctcaaaggcggggtttaaactcgtcctccccgtggccaaggccgggggcgcacctccc

SEQ ID NO: 18119 - protein, 131 aa, Zea mays
  misc_feature: Ceres CLONE 1383810-F
  misc_feature: SWISSPROT Homolog: EC 1.7.1.1 Nitrate reductase (NADH)
  misc_feature (82)..(82): Xaa is any aa, unknown, or other
  misc_feature (86)..(86): Xaa is any aa, unknown, or other
  misc_feature (88)..(88): Xaa is any aa, unknown, or other
  misc_feature (91)..(91): Xaa is any aa, unknown, or other
  misc_feature (108)..(108): Xaa is any aa, unknown, or other
MPPSVDAMPAPGDAAGGGDVRMISSKELRSHASADDLWISISGDVYDVTPWLPHHRAATSRFSPWRGRTPPTPSTANTRPRXARSXRXSSXAASPNTPSPPRPPTTAXSSGSYPPRASSKASAPPPRPSRP

SEQ ID NO: 18120 - DNA, 693 bp, Zea mays
  misc_feature: Ceres CLONE 1383812-R
  misc_feature: Encodes the peptide sequence at SEQ ID NO. 18121
ccgattgggtaccgggccccccctcgaggtcgacggtatcgataagcttttttttttttttttttgacagcgaaggcaactacactttgtatatacactggtagtaatgatcgaacgaacgagaaccatgtacagcagcacgccacgcttacagattgcagtattaatagttgcaccaggtttggtttatatccacaagaagaatgatgcaattcatgaaagaaaacgctacaatcaatattgcttaacgaagctgttccgttgacgacgccggcagcagcgagcgaaggagatcgcagatcggcatccaccacatcttggacgcctacatcaccagctccgacacccatcccaagtccggcccgtcgtcctccgtgaccgcagccgcaggcaggaccggcgccgacgacgacgccttggccttcctgaatccgagctcccgcatcgcgagcaacagctcctccacctcggcgtccgccggctcgtcgacccacctccggccctccaccggcgacaccggcggcgactcccagggcggcgccagcgtcaacttgggcgagagcgcgagcgcgagcggcgagcacccgtccttggcggcgccggcgccggcgcggagctcggccgcggcgtgcgcgaagaacagacgcggcggcggcaggcaacgcccgcgcggcagggcgcgtgccgtaacgg

SEQ ID NO: 18121 - protein, 45 aa, Zea mays
  misc_feature: Ceres CLONE 1383812-R
MYSSTPRLQIAVLIVAPGLVYIHKKNDAIHERKRYNQYCLTKLFR

SEQ ID NO: 18122 - DNA, 658 bp, Zea mays
  misc_feature: Ceres CLONE 1383814-F
  misc_feature: Encodes the peptide sequence at SEQ ID NO. 18123
aagctggagctccccgcggtggcggccgctctagaactagtggatcccccgggctgcaggaattcgcacgagaccattacctagaacatcctaatcgaaaaacaccaacaaaccagaacaccatccgccacgaccacgactccacgagagagcggaggaggagggggagcaatggcagagccgggccagcagttgctgcggtcgttcgtggaggtggcagcggtctcgcacttccctatccagaacctgcccttcggggtcttccgccggcgggggtcgccaccgcaggctccgctccccccggtggccatcggggacttcgcgctcgacctcgccaccgtcgccgacgcgggtctcttcgacggtgccgcgctctccggttccccgtgcttccaccaggagacgctcaacatgttcttggggatggtccgaccggagtgaagggaggcgcgcgccacgctactaaaaatcctctcagccgacgagccagtcttgcgtagacaacgaagccctgaggaataaatgtcttattccaatgagtgatatcgagatggttctaccaatcacgggtggaggttacacagatttcttttgttctgtgcaccatgcaaggaactgcggattcgtcttccgagggccgtagactccagttaatcca

SEQ ID NO: 18123 - protein, 89 aa, Zea mays
  misc_feature: Ceres CLONE 1383814-F
  misc_feature (11)..(88): Pfam Name: DUF1969 Pfam Description: Domain of unknown function (DUF1969)
  misc_feature: SWISSPROT Homolog: EC 3.7.1.2 Fumarylacetoacetase
MAEPGQQLLRSFVEVAAVSHFPIQNLPFGVFRRRGSPPQAPLPPVAIGDFALDLATVADAGLFDGAALSGSPCFHQETLNMFLGMVRPE

SEQ ID NO: 18124 - DNA, 692 bp, Zea mays
  misc_feature: Ceres CLONE 1383825-F
  misc_feature: Translation starting site: 159
  misc_feature (692)..(692): n is a, c, t, g, unknown, or other
ccagctggagctccccgcggtggcggccgctctagaactagtggatcccccgggctgcaggaattcgcacgagaccattacctagaacatcctaatcgaaaacccccaaagggcaaaggcccaaacccagccggtcagtcccccaccccccagcagccatggagttcggcttccgcgcaggaaaccgcacgcagcgccgcccttcccccgatcgacgcgtcacagcacagcaagccggacccttccacggcgaccacccgcagccctcgccgttgcagtgggaggatgcggcccggcgtgagcgcatcatacgcgaggtggagcgccggctcatccacgaggaggtccgcctggacctcgtccttgagcgcgcccgcctccacggtggttttgcccccgccccgttccctcgggaccgaccgctccgtcggggcggtgcaccaccacctctacctacaggtcgggctcccccgggcagaaggaccccccgttgacccccccccccccccgcggtagcgacggcccttgtgggcctcccaagattctacggaacccgattgttggttcgtcggacccctgtaccgtgggtgccccgctccccctaacgacgtaggctattcccctccctcgcgccccccgcagatccgcgggcccctagtagtagctttttgttaccccctcttttttttccn

SEQ ID NO: 18125 - DNA, 716 bp, Zea mays
  misc_feature: Ceres CLONE 1383830-F
  misc_feature (22)..(22): n is a, c, t, g, unknown, or other
  misc_feature (25)..(25): n is a, c, t, g, unknown, or other
  misc_feature (26)..(26): n is a, c, t, g, unknown, or other
  misc_feature (45)..(45): n is a, c, t, g, unknown, or other
ccccgctggagctccaccgcgntgnncgccgctcttgcttagtgnatcccccgggctgcaggattccgcacgagaccattacctagaacatcctaatcgaaaaagtcgcgcgccgccatgtcgcccaccgaatcggcggcagcggcgccgggggctgcggctgaatcgaagcctcggcgactgcgggggtacaagaagggcgccgtcacctgctgcgtcgcctcctccgcacgccccggaggcgtcgcggcctccggcgaggatggatgcccccgctggcccgatctgcgcaccaaagatgtaccttccgaacaaggacgcactacacaagccaatcggcttcgatctgctttaaaccagggaaatgaacacccctgcgcagagcgcggctgggaaccgaccacaggccgccttggaggtccgccatggggaactgaagacagaaggcaccccccgaccccatgggctaccaaccgagaccccgcccgcatccgactcgcccgaccgcgcctcgaaagcccccccccccccccgccgccacccgcatacgggtcgccgccacgcaaccgccacccctccccccccgacagcccgccaccgcaccccgccccccccccccgcacccccccgccgcccctgggaggagagagtcgacacgccgcacccacacccagcggcgtcgccccccacctctaccccgcccgacccccccgccg

SEQ ID NO: 18126 - DNA, 671 bp, Zea mays
  misc_feature: Ceres CLONE 1383832-F
  misc_feature: Encodes the peptide sequence at SEQ ID NO. 18127
  misc_feature (17)..(17): n is a, c, t, g, unknown, or other
  misc_feature (21)..(21): n is a, c, t, g, unknown, or other
  misc_feature (24)..(24): n is a, c, t, g, unknown, or other
gccggctgtagctcccngcgntgncggccgctctagaactagtggatcccccgggctgcaggaattcgcacgagaccattacctagaacatcctaatcgaaaacattgattgatcggacggacgcgcgtctccggtcccgtccgtaataacactgatccgatccacgccggccggcgatggagctcatcaagtccagggcgaccgtgtgcgcgctcctcctggcgctgctcctgctctcacactacgacggcgggacgacgacgacgatggtggcgcaggcccgggtgtgcatgggcaagagccagcaccactccgttccctgcatctccgaccgcctctgcagcaacgagtgcgtcacggcaggacgcgccgcgtaccttcccggtactgcagcctcccctacttgcaccgcccgccccccggcccgccccacgccgtccaccccgcccctcccccgcgccggacccgcttctgttagccacctcgggcccccccccgccccgcgcgccctcccccgcggcaccccccgccgcccgcgccgcgcgcaccgcggcccgcgaccgccgccggcggccccccgccggcgcccgcccctaccgccctagccaccgcccgcgtccgcggcttccgccccccacccccagcccccgtaccccacatcccccgcccc

SEQ ID NO: 18127 - protein, 142 aa, Zea mays
  misc_feature: Ceres CLONE 1383832-F
MELIKSRATVCALLLALLLLSHYDGGTTTTMVAQARVCMGKSQHHSVPCISDRLCSNECVTAGRAAYLPGTAASPTCTARPPARPTPSTPPLPRAGPASVSHLGPPPAPRALPRGTPRRPRRAHRGPRPPPAAPRRRPPLPP

SEQ ID NO: 18128 - DNA, 684 bp, Zea mays
  misc_feature: Ceres CLONE 1383833-F
cccagtggagctccaccgcggtggcggccgctctagaactagtggatcccccgggctgcaggaattcgcacgagaccattacctagaacatcctaatcgaaaagagaaggaaaagacaattttctcgtaaccttccgggctcctcttcctctcctcgcgttcccccaccaaaccctaatccgagcacccagcccctacccgcttccgctcgcgccggcctttggggctctcaccctgagcggtaggaatccgcagggctccggttgggtgccagaagcatccaagtcgttggcgggagaccgggaaatggcggaaaaagagggggcgaaggttggggcggaagagacggcacagcgccagcaccacaggcacgcccaccacctggagcctcacactcggccccccccagcgagcccccccggggcgcccgctcttccttggtggacaaccttccacccacaacacaggcccctcccctgtgaggatcctcccctcccagggccaccacccccccggcccccggcgacgtcgtggcgacgccgccccgtactcacataccctccccccacgcaacctgaccagagcccccccccaggatactacgcccagcttgccacccgcccctccccccacccccaaccggccccgccgcccccaaccaccccattgggtcttgcgcctatc

SEQ ID NO: 18129 - DNA, 769 bp, Zea mays
  misc_feature: Ceres CLONE 1383835-F
cccgctgtagctcaccgcggtggcggccgctctatactagtggatcccccgggctgcaggaattcccacgagatcattacctagaacatcctaatcgaaaaacactgaactgaacacgtgcgcgcgcacgccatccgcctcccgtagcgtgcggcgtgtcgtcaatccaaaccaccaaaagcaatgccgccgccgtccgcaaacggcgccaccgccgccgccgccgccgcgagggaataatgtaacagatgtaagtatggatggaaatgatagaagataactaatatcctgatcgcgaaaaagccaaacaacaaaaacaactcactttgaaaaaaaaacaacataacaaaatatcctactcctatcaacttaaatatacacaaaatccgccgctatacctcatcccctcctcttacccctcactataacacctactcttctagcttctttgtttttactgtttaaatgttttccaccatatgcattgtcttccctccctgctttcccatgtactcaatcttcttaacaccactctccacccccctcctaccaatctacgccttctatcactaaccccgtccccctccccccactctcacccccctcaatattcttttttccatctacttctcttaccctctcctctaactccacattccctactacctcccccccaccccccccacacctgagcttcttgccctacgttcattatctctacacccctcacaccaactctcaacccaacatccctactcaccctctcact

SEQ ID NO: 18130 - DNA, 684 bp, Zea mays
  misc_feature: Ceres CLONE 1383839-F
ccagctggagctcaccgcggtggcggccgcttcacactagtggatcccccgggctgcaggtaattcgcacgagaccattacctagaacatcctaatcgaaaaaaaacgaaaaggaaagctctctcattgccaaattgcccccgactcaagccccccgcgccgccggcgttggtggaatcgatcgacccggcctcgccggacaatccaccagcgttggtttcacctcaggtctttgtgtatggaagacgaccatgacgtcactgtcagaccccctgtgactgatcatttgccttttctcttcccaccaaaaaaatcgttttctccaaacttcctgcgcccggccggacactcctttttttttttttccccccccccaacgcagagacgccactccgcaaacatcacacctcctcccccgacgcaaccccacccgccgactccgcccgcccacgccgccccctccctcctccttcactatatcctcattctacaacctttgccccccccccctcccccacacgactggacgtcacggcaaggggactgcacccaagccccacgccccttgtggcgccctcgctccgctccacccccccagcgcgcctgccgaactccgccgcaagccccccatacgagcagggtggatgtctccattctattttctgcctctacctctcctccccg

SEQ ID NO: 18131 - DNA, 669 bp, Zea mays
  misc_feature: Ceres CLONE 1383840-F
  misc_feature (363)..(363): n is a, c, t, g, unknown, or other
cccagctggagctcaccgcggtggcggccgctctagaactagtggatcccccgggctgcaggaattcgcacgagaccattacctagaacatcctaatcgaaaaatcatcactgccatctctctctgactctgtgtccgtgctctaaactctagtctgtgcgaatctgctgccagcagcgaggaacagaacagtagccaatttgccatctcacagttgcgttcctccgattccccgtcccccgatggacctgtctcccagctcgtcggcgccatccgcgccgccggtgccgtgcgagtggtccggcgccgggctcggctccgcggcgtgcggcctcgcctgcagggcgctctgcgccgccgccncctgggtttctctggcccgcgcgccgctgcccgccccggcgccccctttctgtcggcgccgccccccccccccccctcctggggcctcgggcccccccccgcgctgcctggtcgggccccttgcccccccccccccccccccccccccccccccccggcccgcccccctcgccccctcttcgtgggtggcgccccgccctcctccgcccccccccccctcccgcgcccgcccccgcccccccccccccccccgtcgcctccccctttgtgcctcccggccgctggctcccgcgtttcccccccccg

SEQ ID NO: 18132 - DNA, 672 bp, Zea mays
  misc_feature: Ceres CLONE 1383841-F
ctggctggagctcaccgcggtggcggccgctctataactagtggatcccccgggctgcaggaattcgcacgagaccattacctataacatcctaatcgaaaacgactcactctctctgaaaactaggaaccccactcccctcccgaaactaccgccgccgccgctgccgccgcgatccaggtctcccgccccgcctgagatctcgacctcttcactcctcgccgctactgctcgccctcccgcgtatcctcgtatcagctctcaggttttcagcctgatcaaaccggtgtacccagccgtgcatgactgcattggttcggctcgccggaagagcagcttcgcggagcagggtcggcatagcggcggcggcggcaccccctcctgtcggcttgtccgtgcagcgccggagggcgttccagggcgtgagaatgccgacgggcggcagcaagggcggccgtggcggtctgagcggccctggacggcctgggccccccccccccccacctttgcagcgggcctggggtggttgcccccctgcgtggcggcaggcgccgtctttcccaccgcgtggggtgtttgtcgattgccccctccccccccccgctcttttcccctcgtcttccctacccagggagcgcgcctcaccccgcctcccttcccccctctcccccc

SEQ ID NO: 18133 - DNA, 644 bp, Zea mays
  misc_feature: Ceres CLONE 1383842-F
  misc_feature (274)..(274): n is a, c, t, g, unknown, or other
  misc_feature (292)..(292): n is a, c, t, g, unknown, or other
  misc_feature (395)..(395): n is a, c, t, g, unknown, or other
caagctggagctccccgcggtggcggccgctctagtactagtggatcccccgggctgcaggaattcgcacgagaccattacctagaacatcctaaatcgaaaaatcaccaccactgggtcttcagaccattagctttatctactccagagcgcagaagaacccgatcgacaccatgagggtgttgctcgttgccctcgctctcctggctctcgctgcgagcgccacctccacgcatacaagcggcggctgcggctgccagccaccgccgccggntcatctaccgccgccggngcatctgccacctccggttcacctgccacctccggtgcatctcccaccgccggtccacctgccgccgccggtccacctgccaccgccggtccatgtgcccccnccggttcatctgccgcctgcaccatgccactaccctactccaccgccccggcctcagcctcatccccagccacacccatgcccgtgccaacagccgcatccacgcccgtgccagctgcagggaacctgcggcgttcgccgccccccgatcctgcgcccaggccgcgcgtcgctgaggcatcagcgcagccccgacgccgacgcccctactggctcgccctcatgccagtcgttgccaccagcagttctc

SEQ ID NO: 18134 - DNA, 653 bp, Zea mays
  misc_feature: Ceres CLONE 1383844-F
  misc_feature: Encodes the peptide sequence at SEQ ID NO. 18135
ccccgctgggagctcacgcggtggcggccgctctacactagtggatcccccgggctgcaggaattcgcacgagaccattacctagaacatcctaatcgaaaaaaaacctagcacctcggcgctccctcttctgactccttcgaggtactcccatcgctatcgaccgggtcctcgagcgcgggagatggcggatcaggagaccccagttgcagttgaggcccctaccccggtccttggggagccgatggacttgatgactgctctgcagcttgtcatgaagaagtcgggtgctcatgatggccttgttaagggtcttcgtgaggctgccaaagcaattgagaagcatgctgctcagctttgtgtgcttgcggaggactgtgaccagcctgattatgtcaagctggcgaaggcctctttgctctgagcaccacgctcacctggttactgtgcctagcgttaaaactcttggggaacgggcggggttttgcccccccgcttctgacggcaagggggaggaaggttgtggcctggtcccgcgctgttccccacgcccccccccgccgcctctgcggcccctaccccacgtcgcgcgtaccctcccgcccccatccccccccttccctgcgggccgcggatacactcccgccccctcc

SEQ ID NO: 18135 - protein, 79 aa, Zea mays
  misc_feature: Ceres CLONE 1383844-F
MADQETPVAVEAPTPVLGEPMDLMTALQLVMKKSGAHDGLVKGLREAAKAIEKHAAQLCVLAEDCDQPDYVKLAKASLL

SEQ ID NO: 18136 - DNA, 666 bp, Zea mays
  misc_feature: Ceres CLONE 1383849-F
  misc_feature: Encodes the peptide sequence at SEQ ID NO. 18137
  misc_feature (1)..(1): n is a, c, t, g, unknown, or other
  misc_feature (21)..(21): n is a, c, t, g, unknown, or other
ncccgctggagctcaccgcgntggcggccgctctttcctagtggatcccccgggctgcaggtatttcgcacgagaccattacctagaacatcctaatcgaaaaatcctctcgctcgccaggagaagcagccgccgttgctgctgccgcgtccacagaatggggggtttcgtgaagactcctaagaccaatgcgtatttcaaacgtttccaagtgaaattcaagagaaggcggtctggcaagacagactacagggccaggataaggttgattaaccaacacaaacccaactacaacacccccacatacagatttgttgtgggatttacccaccaggccatccccgcccaacccatatctgcttttttttctcccgctcctgccccttgctcctgcctccccccccataactaccccccccccggggcgtctctacgcatctgacctccctctgtgctttttccatcttgaacgccccttcctcccccacccctcccccccctccctctccttccctctcccttcctctctccgcccccctccccccctcacccccaaccctcatcatctaccccccccccccccccccgttccataccactcaattcaccaccctccctcagctttctttcttctctcccccctccttccctctcccactcccttcc

SEQ ID NO: 18137 - protein, 94 aa, Zea mays
  misc_feature: Ceres CLONE 1383849-F
MGGFVKTPKTNAYFKRFQVKFKRRRSGKTDYRARIRLINQHKPNYNTPTYRFVVGFTHQAIPAQPISAFFSPAPAPCSCLPPHNYPPPGASLRI

SEQ ID NO: 18138 - DNA, 715 bp, Zea mays
  misc_feature: Ceres CLONE 1383852-F
cccgctggagctcaccgcggtggcggccgctctatactagtggatcccccgggctgcaggaattcgcacgagaccattaccaaaaacatcctaatcgaaaattaaagcttactcgaccattcttcgtcctctaatatacgatgggtgtactgatctcatagattggcgcgggcggaggtccctacgacgactgaaccatgtgcggcggagcgatccttgccgaccgacgtgagccgggggtgggactcctcttagaacgtcacacctgccgcgacacatacacgagctcgaggaacgttggacacgacaagcgatgcccccacagcttcagattgtgatggcgtgcagcgcccacagcgacaccgtccaccgctagtagaaagaaacgacactgtcaacccacctgctgaccacccggcgacgcaactcattgacagaatgccctccgcaccacacgacggactccctttcttcccatggtctacggctgaataaactagtgaccgtgcccccggcgccgcccacaaacccggcaaaaccccccccacgctagcccccaacacccaccaccacccatgcccgacaacaagccgcccacgggcacctgtaacaccccgcccgcgcacaggctcttgatgccagcggcgggcgatcatcgatacaccacgaataattcgtcgggctcgcgccaccgccctgtctgtctaccacaccg

SEQ ID NO: 18139 - DNA, 747 bp, Zea mays
  misc_feature: Ceres CLONE 1383858-F
  misc_feature: Translation starting site: 171
ccggctggagctcaccgcggtggcggccgctcttgacatagtggatcccccgggctgcaggaattcgcacgagaccattacctagaacatcctaatcgaaaaatcaaccatattattgagaccaacaagcaacatagaaagtggaatccagtagcaacaacagagcaacaatggcgaccaagatattttccctccttatgctccttgctctttctgcatgtgttgctaacgcgacaattttccctcaatgctcccaagctcctataccttcccttcttcccccatacccttccgtctacgctaccccccgaacggcccccccccgcctcttccccgccatcacggcgcccccacgcctgcccagtcccgccccctccccttccctacccctggacccgttcacacaactgcatttcctcaccccctcccggcggcttctttggttgatcgacacacacaaccacccccactcactcacggcgattcgtctgcatcaggactcagtaataggccgcaatcatctggcgccgtagcgccccttctcgcccacaccccctcccacccgccagcccgccccctctgctctctccttaccattggcctactcgtccaacccctcccctcccccccctctaccttccgccgtccgcgcccccccgcccacccctacggctagcctcaggccccgccactccgcacccccactcattcccccttcccctcatcaccccaccacacacccacccc

SEQ ID NO: 18140 - DNA, 517 bp, Zea mays
  misc_feature: Ceres CLONE 1383864-R
cattgggacgggccccctcgaggtcgacggtatcgataagcttttttttttttttttttatggtgatacgaagaaattatctttgcaaaagtttgacgaagtacaaatgtttcctgatctaccgtctaaccagatcagtgttaccctagagtttgcccttacaaatccaaccagctacagatcaagtcgcgcgacactgcgatatactcacactcaactagccactagaatcagaaggccgattctacgacttagctggcacagcgctagtctttgcgcaaaagcctaaacaaaccaaaagcgtccaaaaaaaagggaaaaaatttccgtcatttttagcccaccggggtcccaaaccaaaacccccaaaaaaaaaacccggggtcccccccccagaaacttcccccccggccgcggggaaaaaaccacaaaaaggggggcccccgggggccaccttttttaaaaaaaaaaaacattggtcgccccctattttttttccaaggggggcccaaaaaaa

SEQ ID NO: 18141 - DNA, 657 bp, Zea mays
  misc_feature: Ceres CLONE 1383864-F
  misc_feature: Encodes the peptide sequence at SEQ ID NO. 18142
  misc_feature (621)..(621): n is a, c, t, g, unknown, or other
aaagctggagctccccgcggtggcggccgctctataactagtggatcccccgggctgcaggaattcgcacgagaccattacctagaacatcctaacgaaaaaaccgtgcagggagcggtggacggtatggattcctcgtcaagctcagctttgaccgcgcggcaatggagagagagaccacagaccatgaccaccatgcccaccgcccagctcgctgctgcacactgccccactctcctctacctccgcgccaatgcgcctccccaacatttaaacggccaaaccagcccaaaccccaaacccacagtagtaacaggggcacactagctaagctaaacctcgccacggcacagcaatggcgccgctccccgcttccctcacgccctgcctctggctcttcctctgcctcctcgctgcgccgtgccccgcggcgcgggcggcgcggttcgcgtgcaacgccacggcgccgcgagcgtccacgtgccaggcgctcgtctcctacgcgccgcccaacgggacggccacgcccacgctggccgccgtgcgggcgctcttccagctccgctcccaccgcgcgctgctggccgccaacggcctcccgctctccacgccgcccacggngcccgcgcccgtgccgctgcgggtccgcctgccctg

SEQ ID NO: 18142 - protein, 100 aa, Zea mays
  misc_feature: Ceres CLONE 1383864-F
  misc_feature (89)..(89): Xaa is any aa, unknown, or other
MAPLPASLTPCLWLFLCLLAAPCPAARAARFACNATAPRASTCQALVSYAPPNGTATPTLAAVRALFQLRSHRALLAANGLPLSTPPTXPAPVPLRVRLP

SEQ ID NO: 18143 - DNA, 667 bp, Zea mays
  misc_feature: Ceres CLONE 1383877-F
  misc_feature: Translation starting site: 206
  misc_feature: SWISSPROT Homolog: EC 5.3.3.2 Isopentenyl-diphosphate Delta-isomerase
  misc_feature (394)..(394): n is a, c, t, g, unknown, or other
  misc_feature (440)..(440): n is a, c, t, g, unknown, or other
  misc_feature (441)..(441): n is a, c, t, g, unknown, or other
  misc_feature (451)..(451): n is a, c, t, g, unknown, or other
  misc_feature (463)..(463): n is a, c, t, g, unknown, or other
aaagctggagctccccgcggtggcggccgctctataactagtggatcccccgggctgcaggaattcgcacgagaccattacctagaacatcctaatcgaaaaacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttncactcaaaatatgagctgctacttcagcaaaggtccgcgacaaggnntacttttccnttagttggacantacctgctgcagccaccctctgtaccgtgagtctgagcttatccaggagactactttggtgggagaaatgcagccccaagaaactactgaatgacttgggcatccagcaaaaaaggccccggttgaccatttcccccctttggcccaagggtttacagggcccctttgacggaaagggggggaaaatgaattttaaaaccctgg

SEQ ID NO: 18144 - DNA, 664 bp, Zea mays
  misc_feature: Ceres CLONE 1383879-F
  misc_feature: Encodes the peptide sequence at SEQ ID NO. 18145
acagctggagctccccgcggtggcggccgctcaatcactagtggatcccccgggctgcaggatttcgcacgagaccattacctagaacatcctaatcgaaaaaagtccagaacctcgcttccaatctgccctcccgtgtccccctccctgtccgattccccacagtagcgcctcgccctcgtcctcctcctccagtccggatcgccatttcccaccgatccgtcccggaatcggtatgggtgcgcccaagtcaaaggggccggcgcccagtgcttcggcagcctagcgtttgtttgcctccgaggatttccgcctatcgcgttaccggatcttcggtgggccggcgaccctctacgccactatgagctccgacgggcgcctccgccgcgcgctggccgcgttcggaggcgacgtgtgtgacctcgtggacgcggcgctcgccgtcgccgcgcgtgacagccccggcgacctgaacgcgcgccgcgacggaatcgtcccccgcctctactcagggggagcccgctgccgcaactgagacgccgacgaaaccccggagcctgctcacccgaagaaggctgatgaccccgacattgctggctgtttatccagcggacggggcgccgaacgtttaccagcctcgcaagaaaaaagagggccaacccgc

SEQ ID NO: 18145 - protein, 57 aa, Zea mays
  misc_feature: Ceres CLONE 1383879-F
MSSDGRLRRALAAFGGDVCDLVDAALAVAARDSPGDLNARRDGIVPRLYSGGARCRN

SEQ ID NO: 18146 - DNA, 673 bp, Zea mays
  misc_feature: Ceres CLONE 1383886-F
  misc_feature: Translation starting site: 446
cagaactagtggatcccccgggctgcaggaattcgcacgagaccattacctagaacatcctaatcgaaaaatcacctataatattttgagcattcagaaacacaccaagcgaagcgcactagcaacaacctaacaacaatggctaccaagatattatccctccttgcgcttcttgcgctttttgcgagcgcaacaaatgcgtccattattccacaatgctcacttgctcctagttccattattccacagttcctcccaccagttacttcaatggccttcgaacacccagctgtgcaagcctataggctacaacaagcgattgcggcgagcgtcttacaacaaccaattgcccaattgcaacaacaatccttggcacatctaacaatacaaaccatcgcaacgcaacagcaaccaccagttctaccagcactgaacccacctagccatggtgaacccctgtcgcctactttgcaacagcagcttgcttgcatcccaacccactttgcctctaacaaacggtaagtggaaaaaccagcaaacaacaaacaactggaaaaaggttttcggcccagccgtttaattcaacttaccccttggttgaaacccctggcccgcctaaccttaaaacaaagaaacaaattgggttttatatttaaacccccctctcgcgtgg

SEQ ID NO: 18147 - DNA, 659 bp, Zea mays
  misc_feature: Ceres CLONE 1383887-F
  misc_feature: SWISSPROT Homolog: EC 6.3.2.19 Ubiquitin--protein ligase
aaagctggagctccccgcggtggcggccgctctagaactagtggatcccccgggctgcaggaattcgcacgagaccattaactagaacatcctaatcgaaaagtttcaggtctcctcccatttcgtcgttttcatttgtcgtcgtcgtaagctgcagttagtgtggactggagatccaccactccaccagtccggtccatctgctggacctcgattggtttcttcttacctacgaacatccggggatgtcgactcctgcgagcgaaaggctgatgatgaatttcaagcggttgatgcatgaccctccggccggcataattgtggccccgcatgataagcaacataatgttgtgcaatgctgtcatatttggacctgatgatacccctgtgatatggagtgactactaagctgactctccagtttaatgaacaagatccataccatccaccaactgtgctatttgtttctaggatgtgtccatcctagacatttatgctgatggaagtgtatgcttacatatcctgcagaatcagcgtagtctgatatatgatgtagctgcaatactcacgtcaatacagtcgttggtgtgcgatccacacccgaatatctgcgctaactatgaatccgctcgcatgttcagcgagaacaagcgagagtg

SEQ ID NO: 18148 - DNA, 661 bp, Zea mays
  misc_feature: Ceres CLONE 1383894-F
  misc_feature: Encodes the peptide sequence at SEQ ID NO. 18149
  misc_feature (476)..(476): n is a, c, t, g, unknown, or other
aaagctggagctccccgcggtggcggccgctctagaactagtggatcccccgggctgcaggaattcacacgagaccattacctagaacatcctaatcgaaaaatgaacgaactatctatcgtagcacgctagcacgcatctgttcccgtctcctcaggctccgtctcaaactcgcccggtcatcccatctccaccaccacatccgtcctcttccgccgccgccgatggcccgcctcctcacacaaaccctcaccctagcccgtcccgccgcctcctcctcccccaccgccgcattcgcctccctccgttgcctcgctaccaaggtcgagatcgtcgagatcgacctcaccgaggaagacgctggctcctcggcccacggctcctccccctcgtccccatcgatcgaggtggttgggatccggcgcctggaggaggcatccacggcgtcatggtgcgccgcgccgctcccgattggnctgccttcgtgcctggagggtcctactgggtgcccccgctgccgctcccgcacgaggtcaccgcgtttgtcggccggatcgcggcctcaggaggcgcttccggggtcgccaagttcatggacgggggcccgccccctggggccgccgggcccgttgcggcgccttccaagtcctgggaactcaaa

SEQ ID NO: 18149 - protein, 71 aa, Zea mays
  misc_feature: Ceres CLONE 1383894-F
  misc_feature (10)..(10): Xaa is any aa, unknown, or other
MVRRAAPDWXAFVPGGSYWVPPLPLPHEVTAFVGRIAASGGASGVAKFMDGGPPPGAAGPVAAPSKSWELK

SEQ ID NO: 18150 - DNA, 658 bp, Zea mays
  misc_feature: Ceres CLONE 1383900-F
  misc_feature: Encodes the peptide sequence at SEQ ID NO. 18151
aaagctggagctccccgcggtggcggccgctctagaactagtggatcccccgggctgcaggaattcgcacgagaccattacctagaacatcctaatcgaaaagatcggttcacatcccgcgagataatccatggctgggtgctagggtttacggcttcctccattcgcccccacccctgggcgctgcgggctcgcggagcaggatcgatcggttcggatggaggatggggagacggaggaggcgcagcgggacgcgatcacggcgaggatgcgggctcaggactacgcgggcgcgagggcgctgctgctgcggacgcttcagacgaaccccaggctggagggcgccctggagatgctcccggtgctcgaggtcctctgctgcgccgccgccggccgtgggggcgtggattggtacagagtcctccaggtgctgcctgtggatgacgccgccaggatcgaggcgcgctacaagagcatcgtggcccaggtggagccggccatgggggctctgcccggcgccgaattggccctcaagctcgtcgacgaggcttacgcggtgctgtctgatccagagagcgagaggggtttgattcgagcaacgttttcaccccggtcgttcggtccggtgtcgtcgatgctccaccgcccggtggcacac

SEQ ID NO: 18151 - protein, 147 aa, Zea mays
  misc_feature: Ceres CLONE 1383900-F
  misc_feature (64)..(124): Pfam Name: DnaJ Pfam Description: DnaJ domain
MEDGETEEAQRDAITARMRAQDYAGARALLLRTLQTNPRLEGALEMLPVLEVLCCAAAGRGGVDWYRVLQVLPVDDAARIEARYKSIVAQVEPAMGALPGAELALKLVDEAYAVLSDPESERGLIRATFSPRSFGPVSSMLHRPVAH

SEQ ID NO: 18152 - DNA, 607 bp, Zea mays
  misc_feature: Ceres CLONE 1383901-F
  misc_feature: Encodes the peptide sequence at SEQ ID NO. 18153
  misc_feature (223)..(223): n is a, c, t, g, unknown, or other
  misc_feature (329)..(329): n is a, c, t, g, unknown, or other
  misc_feature (506)..(506): n is a, c, t, g, unknown, or other
  misc_feature (523)..(523): n is a, c, t, g, unknown, or other
aaagctggagctccccgcggtggcggccgctctataactagtggatcccccgggctgcaggaattcgcacgagaccattacctagaacatcctaatcgaaaaaccaccgcatcccacaacccccgagctcagcttagctccactccagctccaatcgcagtcgtgaccagagcgcgagagctagctagagggccgtgaaaatgccgatcaataggatcgcccntggggagccaccaggaggtgtaccacccgggcgccctcaaggcggcgttcgctgagttcatctccaccctcatcttcgtcttcgccggccagggctccggcatggncttcagcaagctgaccggcggcggcccgacgaccccggcggccctgatcgcggcggcggtggcgcacgcgttcgcgctggtcgtgggcgtgtctgtgggcgcgaacatctccggcgggcacgtgaaccctgccgtgacctttcgcgccttcgtggggcgcaacatcaccctggtccnggggctcctgtactggntggcgcagctgctggggtccacggtgggtgcttcctgctccgctctcgacgggggggcagccacgggcaccttcggctgacggg

SEQ ID NO: 18153 - protein, 92 aa, Zea mays
  misc_feature: Ceres CLONE 1383901-F
  misc_feature (2)..(2): Xaa is any aa, unknown, or other
  misc_feature (61)..(61): Xaa is any aa, unknown, or other
  misc_feature (67)..(67): Xaa is any aa, unknown, or other
MXFSKLTGGGPTTPAALIAAAVAHAFALVVGVSVGANISGGHVNPAVTFRAFVGRNITLVXGLLYWXAQLLGSTVGASCSALDGGAATGTFG

SEQ ID NO: 18154 - DNA, 688 bp, Zea mays
  misc_feature: Ceres CLONE 1383909-F
  misc_feature: Encodes the peptide sequence at SEQ ID NO. 18155
  misc_feature (447)..(447): n is a, c, t, g, unknown, or other
  misc_feature (506)..(506): n is a, c, t, g, unknown, or other
  misc_feature (507)..(507): n is a, c, t, g, unknown, or other
  misc_feature (534)..(534): n is a, c, t, g, unknown, or other
aaagctggagctccccgcggtggcggccgctctagaactagtggatcccccgggctgcaggaattcgcacgagaccattacctagaacatcctaatcgaaaaccaagaccaagaccaacaccactccactccctccatttccctcacctcccgcagcagctagccgccagccaacaaccgaaccaaccaaccaacccacaggccacagcgagcgagtaaagcgtccaatggtagcgatggcggccgtgcagcagcagcagcagcagcagcgccgcgacgcggaggcggagctcaacctgcccccgggcttccggttccacccgacggacgaggagctggtggcgcactacctctgcgcgcgcgccgcggggcgccgcccgccggtgtccatcatcgccgaggtcgacctgtaccgcttcgacccctgggacctggcggagcgcgccntcttcgggccgcgcgagtggtacttcttcacgccgcggggacggcagtaccccaacggnntcccgccccaaccggggcggcggggtngggctactggaaggccacgggggggggacaagccccgtggagcacgggggcccgaacggcggggatcaaaagggggctcggggttcaaccccgcgaagccgcccgggggggttcaaaaacggaaggggatcttggcccaataccccccctcccg

SEQ ID NO: 18155 - protein, 150 aa, Zea mays
  misc_feature: Ceres CLONE 1383909-F
  misc_feature (21)..(150): Pfam Name: NAM Pfam Description: No apical meristem (NAM) protein
  misc_feature (71)..(71): Xaa is any aa, unknown, or other
  misc_feature (91)..(91): Xaa is any aa, unknown, or other
  misc_feature (100)..(100): Xaa is any aa, unknown, or other
MAAVQQQQQQQRRDAEAELNLPPGFRFHPTDEELVAHYLCARAAGRRPPVSIIAEVDLYRFDPWDLAERAXFGPREWYFFTPRGRQYPNGXPPQPGRRGXATGRPRGGDKPRGARGPERRGSKGGSGFNPAKPPGGVQKRKGILAQYPPS

SEQ ID NO: 18156 - DNA, 676 bp, Zea mays
  misc_feature: Ceres CLONE 1383912-F
  misc_feature (14)..(14): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ggggggtggggccnccccccgggtccctccacccccccccnnnnncccccccatcaaagctggagctccccgcggtggcggccgctctagaatagtggatcccccgggctgcaggaattcgcacgagaccattacctagaacatcctaatcgaaaagtatttttctctcctcactcaacgcggcgatgccccctagatcggatcacgccgccggcagcggcgccgcggcggcggccacgcaggcccacttcgactccatcgatccactcttccatgtgctccgcgtgctacccttctccttcctcctgccgccgcgcacccgcctgaggctgccgtcgaacctggcgcttccctctcccatgaccgtcttctccctcatcctgctcacctactttgcggtcgtctccggactcgtgtacgacgtcatcgttgagcccccctggcatcggcagcgcccaggaccccggaactggcgccgtccgccccgtcgtcttccttccagggcgcgttcacggccagtacatcatcgagggactctcctccggggtcatgttcctcccttggcggaattgggatcatcctcctcgacctcgccgtcgaccgcacgaggcccccggaagcctccgcgtctcgtttggaaagcgccggcgcaatccgcccgttgtccatcccccta

SEQ ID NO: 18157 - DNA, 651 bp, Zea mays
  misc_feature: Ceres CLONE 1383913-F
  misc_feature: Encodes the peptide sequence at SEQ ID NO. 18158
ggagctccccgcggtggcggccgctctagaactagtggatcccccgggctgcaggaattcgcacgagaccattacctagaacatcctaatcgaaaaatccgaattcggagcagagcagccgccgcggatgccgttaaaccctaactcccaacctcttctttgtcacactatttctagggttttacacgcaccaacaggagccccttccgtcacttcccctccaacaacagcagcgccgccaccgccgccgccgccgcttgctcgccgggatcgtcgccggaggaaagcgccatggatcggtaccagcgggtggagaagccgccgcccgaggccgccgccatcggcgagaatgagatccgcatcaccactcagggcctcgtccgcaactacgtcacctacgccacctccctcgtccaggaaaaacaggtgaaggaaattgtgttgaaggctatgggacaggctataagcaaggcagtggctattgctgagatcataaagaagaggattcctggtttgcatcaagatacaataatcagttctgtcagtattactgatgtatgggagcccattgaggaaggacttgcaccattggagatgactcgtcatgtttcaatgatatcgattcccttgtcacctacggagcataacaag

SEQ ID NO: 18158 - protein, 120 aa, Zea mays
  misc_feature: Ceres CLONE 1383913-F
  misc_feature (18)..(88): Pfam Name: Alba Pfam Description: Alba
  misc_feature: SWISSPROT Homolog: EC 3.1.26.5 Ribonuclease P
MDRYQRVEKPPPEAAAIGENEIRITTQGLVRNYVTYATSLVQEKQVKEIVLKAMGQAISKAVAIAEIIKKRIPGLHQDTIISSVSITDVWEPIEEGLAPLEMTRHVSMISIPLSPTEHNK

SEQ ID NO: 18159 - DNA, 658 bp, Zea mays
  misc_feature: Ceres CLONE 1383917-F
  misc_feature: Encodes the peptide sequence at SEQ ID NO. 18160
  misc_feature (556)..(556): n is a, c, t, g, unknown, or other
aagctggagctccccgcggtggcggccgctctagaactagtggatcccccgggctgcaggaattcgcacgagaccattacctagaacatcctaatcgaaaaaagagacaagaacgaggtcgtctcgccatcgccgccactcctatttaagagctgccggaggtgggggtagatccggcgagccgttcccgctgtccagattcaggaactagactcctccggtcctcctccttactccccgtctcgctccagcggctccacgccaccgtttgccattcactgccagaatggcgctcaacaaggagtacacgtacgcggagctggagaaggagccgtactggccgttcgagaagctgcgggtctccatcaccggggccggcgggttcatcgcctcccacatcgcgcgccgcctcaagggcgagggccactacgtcgtcgcctccgactggaagaggaacgagcacatgcccgaggacatgttctgccacgagttccacctcgtggacctgagggtcatggacaactgcctcaaggtcacccacgggggtgaccacgtngtcaccctcgcggctgacatgggtgggatggggttcatccagtccaccactccctctcatggtacacacacatgatcagctttacatgctggagctgctaga

SEQ ID NO: 18160 - protein, 114 aa, Zea mays
  misc_feature: Ceres CLONE 1383917-F
  misc_feature: SWISSPROT Homolog: EC 5.1.3.18 GDP-mannose 3,5-epimerase
MALNKEYTYAELEKEPYWPFEKLRVSITGAGGFIASHIARRLKGEGHYVVASDWKRNEHMPEDMFCHEFHLVDLRVMDNCLKVTHGGDHVVTLAADMGGMGFIQSTTPSHGTHT

SEQ ID NO: 18161 - DNA, 654 bp, Zea mays
  misc_feature: Ceres CLONE 1383927-F
  misc_feature: Encodes the peptide sequence at SEQ ID NO. 18162
  misc_feature (362)..(362): n is a, c, t, g, unknown, or other
  misc_feature (389)..(389): n is a, c, t, g, unknown, or other
  misc_feature (473)..(473): n is a, c, t, g, unknown, or other
  misc_feature (474)..(474): n is a, c, t, g, unknown, or other
  misc_feature (509)..(509): n is a, c, t, g, unknown, or other
  misc_feature (547)..(547): n is a, c, t, g, unknown, or other
tggagctccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacgganaggacaccccgcggaagagggaatggnagagcgagtgccgcgagcggcaccagcaagctgacgcgggcgaggacggcgacaggcgcgtggacgcctacgtctccgctcggnnaaagggccgagtgcccgcgccagtgcctgcgccgncacgagggccagccgtgggagaccccagaggccatgangcggtgccgccgccgcggactgggcgtcgactggagcaagagtacggtcgcggcagcgagagcgcgggcagtggccgggagagtgcgagcgccacacgcggggactg

SEQ ID NO: 18162 - protein, 151 aa, Zea mays
  misc_feature: Ceres CLONE 1383927-F
  misc_feature (55)..(55): Xaa is any aa, unknown, or other
  misc_feature (64)..(64): Xaa is any aa, unknown, or other
  misc_feature (92)..(92): Xaa is any aa, unknown, or other
  misc_feature (104)..(104): Xaa is any aa, unknown, or other
  misc_feature (116)..(116): Xaa is any aa, unknown, or other
MGKGSVGASWWAFLLLAGVLLVVAATAGAEDGVVERDRKEDLRWCKQACEWQYGXDTPRKREWXSECRERHQQADAGEDGDRRVDAYVSARXKGRVPAPVPAPXRGPAVGDPRGHXAVPPPRTGRRLEQEYGRGSESAGSGRESASATRGD

SEQ ID NO: 18163 - DNA, 601 bp, Zea mays
  misc_feature: Ceres CLONE 1383952-F
  misc_feature: Translation starting site: 193
  misc_feature: SWISSPROT Homolog: EC 2.7.10.1 Receptor protein-tyrosine kinase
  misc_feature (320)..(320): n is a, c, t, g, unknown, or other
  misc_feature (340)..(340): n is a, c, t, g, unknown, or other
  misc_feature (345)..(345): n is a, c, t, g, unknown, or other
  misc_feature (463)..(463): n is a, c, t, g, unknown, or other
  misc_feature (464)..(464): n is a, c, t, g, unknown, or other
  misc_feature (570)..(570): n is a, c, t, g, unknown, or other
tggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggncttcagcaagctgaccggcnggcgnccgacgaccccggcggcctgatcgcggcgggcgtggcgcacgcgttcgcgctggtcgtgggcgtgtctgtgggcgcgaacatctccgggaggcacgtgaaccctgccgtgactttcgnngcctcgtgggcggaacatcaccctggtcccggggctctggtactgggtggccaccctgctggggtcaaccgggggggggttcctgctcccgtccccaagggggggnaggcacgggaccttcggctgagggggggggg

SEQ ID NO: 18164 - DNA, 678 bp, Zea mays
  misc_feature: Ceres CLONE 1383953-F
  misc_feature: Encodes the peptide sequence at SEQ ID NO. 18165
  misc_feature (344)..(344): n is a, c, t, g, unknown, or other
aaagctggagctccccgcggtggcggccgctctagaactagtggatcccccgggctgcaggaattcgcacgagaccattacctagaacaccctaatcgaaaaaccgcatcccacaacccccgagctcagcttagctccactccagctccaatcgcagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggnggcggccacaccaccccggcgggcctgatcgcgggggggggggcgcacgcgttcgcgctgttcgggccggggtctgtgggggggaacatctccgggaggaacgtgaaccctgccggacctttgggggccttgggggggggaaaccttcccctggtccgggggcttccggtacgggggggggaatttgctggggcccccccgggggggggttcccgctcccctttccgaggggggggggagggccccggcacccttttcggttttaagaggggggtgcgggtgggggaaggcccttgctccttaaaaaaacgagataccccctggggggggggga

SEQ ID NO: 18165 - protein, 160 aa, Zea mays
  misc_feature: Ceres CLONE 1383953-F
  misc_feature (13)..(159): Pfam Name: MIP Pfam Description: Major intrinsic protein
MPINRIALGSHQEVYHPGALKAAFAEFISTLIFVFAGQGSGMAFSKLTGGGHTTPAGLIAGGGAHAFALFGPGSVGGNISGRNVNPAGPLGALGGGNLPLVRGLPVRGGEFAGAPPGGGSRSPFRGGGEGPGTLFGFKRGVRVGEGPCSLKKRDTPWGGG

SEQ ID NO: 18166 - DNA, 636 bp, Zea mays
  misc_feature: Ceres CLONE 1383962-F
  misc_feature: Encodes the peptide sequence at SEQ ID NO. 18167
  misc_feature (294)..(294): n is a, c, t, g, unknown, or other
  misc_feature (297)..(297): n is a, c, t, g, unknown, or other
  misc_feature (309)..(309): n is a, c, t, g, unknown, or other
  misc_feature (313)..(313): n is a, c, t, g, unknown, or other
  misc_feature (336)..(336): n is a, c, t, g, unknown, or other
  misc_feature (365)..(365): n is a, c, t, g, unknown, or other
  misc_feature (406)..(406): n is a, c, t, g, unknown, or other
  misc_feature (523)..(523): n is a, c, t, g, unknown, or other
  misc_feature (558)..(558): n is a, c, t, g, unknown, or other
  misc_feature (559)..(559): n is a, c, t, g, unknown, or other
  misc_feature (567)..(567): n is a, c, t, g, unknown, or other
aagctggagctccccgcggtggcggccgctctagaactagtggatcccccgggctgcaggaattcgcacgagaccattacctagaacatcctaatcgaaaactcggctcatctcatttttctatttcggcccctctactgttccaataataataaaaagattctcgattcgatttactcgccaattttcagtgagcggcggcgatcggcttcggatcggcgcagcgcggcggagcggagatggttgccgtggcggtggatggcctgatccgcggtgcggacgccgtgccggcgncgnaaagggaagcgntgangggcgcagctgcggagggcgcgnccaagggcggtgagggggaaatcgggaanggagaggtgagggagtatgaaagcgacatgaggaagctggnagagctgctttctaagctgaacccctcggcggaggagttcgtgccgcagtcccgccgccgcgtggacggcggcgctccccgccttttcggcgacgcgcccgtgttcgtgtcgccggngatcgactactaggcgcggcaacaccagttcccgnncgcgaagnttctgcagcagcagcagccgatgcacgtgctgcagtttgtgggtggcgtcggcgggtttggcatgggtg

SEQ ID NO: 18167 - protein, 98 aa, Zea mays
  misc_feature: Ceres CLONE 1383962-F
  misc_feature (57)..(74): Pfam Name: PAM2 Pfam Description: Ataxin-2 C-terminal region
  misc_feature (19)..(19): Xaa is any aa, unknown, or other
  misc_feature (20)..(20): Xaa is any aa, unknown, or other
  misc_feature (24)..(24): Xaa is any aa, unknown, or other
  misc_feature (25)..(25): Xaa is any aa, unknown, or other
  misc_feature (33)..(33): Xaa is any aa, unknown, or other
  misc_feature (42)..(42): Xaa is any aa, unknown, or other
  misc_feature (56)..(56): Xaa is any aa, unknown, or other
  misc_feature (95)..(95): Xaa is any aa, unknown, or other
MVAVAVDGLIRGADAVPAXXREAXXGAAAEGAXKGGEGEIGXGEVREYESDMRKLXELLSKLNPSAEEFVPQSRRRVDGGAPRLFGDAPVFVSPXIDY

SEQ ID NO: 18168 - DNA, 635 bp, Zea mays
  misc_feature: Ceres CLONE 1383995-F
  misc_feature: Encodes the peptide sequence at SEQ ID NO. 18169
  misc_feature (371)..(371): n is a, c, t, g, unknown, or other
  misc_feature (445)..(445): n is a, c, t, g, unknown, or other
aagctggagctccccgcggtggcggccgctctagaactagtggatcccccgggctgcaggaattcgcacgagaccattacctagaacatcctaatcgaaaagactccctcggctgcctcccgcagccgcccgctgctccggtccttccgaacgctggcctgttcttccctgcctttggcccattcgtcaggcggcccctccgcaggcgacgcaggcgcggtcacgacggcgcgtggccccgactacgtagacagctaaccggtctccgcctccggcccttctcctgtcgcccgattgagtcgctgctgcaactgccaacttcacccccggcgagctcaccacagtcttccggaaaggtgctatcaatttgnaagatggcagatgaggagcaggcccaagctctaggaaaagggttgcagtactcaaatcaacaaggataatccgnaacctgatgatgaaggaacagaaacagagatgggtacatttaagaaagctactgaagaaagtatggcacaccggaggattgtaaaaggtcgcgccagcagacgtcatcagctccttctaaccctttctctgcaatcaaatttgcccccactgattctagtgctcaaacaagtgctcctgtcccagaggtc

SEQ ID NO: 18169 - protein, 53 aa, Zea mays
  misc_feature: Ceres CLONE 1383995-F
MGTFKKATEESMAHRRIVKGRASRRHQLLLTLSLQSNLPPLILVLKQVLLSQR

SEQ ID NO: 18170 - DNA, 656 bp, Zea mays
  misc_feature: Ceres CLONE 1383998-F
  misc_feature: Encodes the peptide sequence at SEQ ID NO. 18171
  misc_feature (411)..(411): n is a, c, t, g, unknown, or other
  misc_feature (525)..(525): n is a, c, t, g, unknown, or other
  misc_feature (656)..(656): n is a, c, t, g, unknown, or other
aaagctggagctccccgcggtggcggccgctctagaactagtggatcccccgggctgcaggaattcgcacgagaccattacctagaacatcctaatcgaaaaacaagcagcgaaatccaatctagaagcacccctctccctctctctctcttcgccgtccgaagctccgcaccccaatctaatcgacacctcaccgagatgggccgcaagttcttcgtcggtggcaactggaaatgcaatggaaccacagatcaggtcgagaagattgtcaaaaccctgaatgaaggacaggttcccccttcagatgttgtcgaggtcgttgtcagccctccttatgtcttccttcctgtggtcaagagccagctgcgccaagaagtccatgttgctgctcaaaactgctgggtgaagaangggagtgctttcactggtgaagtcagtgctgagatgctcgtcacccttggtgttccctgggtcattcttggacactctgaaaggagagctctgctgggagaatcaaatgaattnggtggagacaagttgcgtatgccctgtctcaggaactaaagtcattgcatgtgttggtgagaccttgacaggagggaggtgggtctaccatggatgtgtgtgctgcacaacaaaagcatggctgagaagan

SEQ ID NO: 18171 - protein, 121 aa, Zea mays
  misc_feature: Ceres CLONE 1383998-F
  misc_feature (5)..(121): Pfam Name: TIM Pfam Description: Triosephosphate isomerase
  misc_feature: SWISSPROT Homolog: EC 5.3.1.1 Triose-phosphate isomerase
  misc_feature (71)..(71): Xaa is any aa, unknown, or other
  misc_feature (109)..(109): Xaa is any aa, unknown, or other
MGRKFFVGGNWKCNGTTDQVEKIVKTLNEGQVPPSDVVEVVVSPPYVFLPVVKSQLRQEVHVAAQNCWVKXGSAFTGEVSAEMLVTLGVPWVILGHSERRALLGESNEXGGDKLRMPCLRN

SEQ ID NO: 18172 - DNA, 653 bp, Zea mays
  misc_feature: Ceres CLONE 1383999-F
  misc_feature (335)..(335): n is a, c, t, g, unknown, or other
  misc_feature (349)..(349): n is a, c, t, g, unknown, or other
  misc_feature (418)..(418): n is a, c, t, g, unknown, or other
  misc_feature (456)..(456): n is a, c, t, g, unknown, or other
  misc_feature (457)..(457): n is a, c, t, g, unknown, or other
  misc_feature (462)..(462): n is a, c, t, g, unknown, or other
  misc_feature (463)..(463): n is a, c, t, g, unknown, or other
  misc_feature (528)..(528): n is a, c, t, g, unknown, or other
  misc_feature (583)..(583): n is a, c, t, g, unknown, or other
  misc_feature (589)..(589): n is a, c, t, g, unknown, or other
  misc_feature (594)..(594): n is a, c, t, g, unknown, or other
  misc_feature (605)..(605): n is a, c, t, g, unknown, or other
  misc_feature (608)..(608): n is a, c, t, g, unknown, or other
  misc_feature (641)..(641): n is a, c, t, g, unknown, or other
gctggagctccccgcggtggcggccgctctagaactagtggatcccccgggctgcaggaattcgcacgagaccattacctagaacatcctaatcgaaaaatttcagtttggaactgaactgggaatgacgaggccgaggacaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgaagggagactacgntcagaacgccgtcnagtttctctcccaccccaggtcaggggctcccccgtcgtctacaggcgatccttcctcgagaagaaggnccttagcacccgagagatcgacgaggccttccgaaggnntcctnngatctcaaccagtactacggctaccacttctccgcagcagcaggtcaacagccagaatcaatccngtcgggtgcaagctttatgcgcagcacaacctgtgcacccagcaaacgctggccntgtcgntcttnccacgcagccnagntttagctggtaccaagcattcctggctgcaggnctcttgcttggt

SEQ ID NO: 18173 - DNA, 652 bp, Zea mays
  misc_feature: Ceres CLONE 1384002-F
  misc_feature: Encodes the peptide sequence at SEQ ID NO. 18174
  misc_feature (281)..(281): n is a, c, t, g, unknown, or other
  misc_feature (307)..(307): n is a, c, t, g, unknown, or other
  misc_feature (354)..(354): n is a, c, t, g, unknown, or other
  misc_feature (411)..(411): n is a, c, t, g, unknown, or other
  misc_feature (520)..(520): n is a, c, t, g, unknown, or other
  misc_feature (573)..(573): n is a, c, t, g, unknown, or other
  misc_feature (578)..(578): n is a, c, t, g, unknown, or other
tggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcggncgcccgatgggtgagcaggtgaaggncatgctccacgacaaggggccgacggcgtcgcaggcgctgacggtgncgacgctgttcccgctgggcgggctgctgctggtgctgtcggggctggcgctgacgncctccgtggtggggctggccgtggccacgccggtgttcctgatcttcagccccgtgctggtccccgccgcgctgctcatcgggacggccgtcatggggttcctcacgtncggcgcgctggggctcgggggcctgtcctcgctcacgtgcctcgccaaacggngcggnagcgttccagcgcaccccggactacgtggagggagccgcaccgcagatggccgaggccgcgcggcacgcgggcc

SEQ ID NO: 18174 - protein, 150 aa, Zea mays
  misc_feature: Ceres CLONE 1384002-F
  misc_feature (44)..(147): Pfam Name: Oleosin Pfam Description: Oleosin
  misc_feature (36)..(36): Xaa is any aa, unknown, or other
  misc_feature (52)..(52): Xaa is any aa, unknown, or other
  misc_feature (71)..(71): Xaa is any aa, unknown, or other
  misc_feature (107)..(107): Xaa is any aa, unknown, or other
  misc_feature (125)..(125): Xaa is any aa, unknown, or other
MADRDRSGIYGGAHATYGQQQQQGGGGRPMGEQVKXMLHDKGPTASQALTVXTLFPLGGLLLVLSGLALTXSVVGLAVATPVFLIFSPVLVPAALLIGTAVMGFLTXGALGLGGLSSLTCLAKRXGSVPAHPGLRGGSRTADGRGRAARG

SEQ ID NO: 18175 - DNA, 655 bp, Zea mays
  misc_feature: Ceres CLONE 1384003-F
  misc_feature: Encodes the peptide sequence at SEQ ID NO. 18176
  misc_feature (491)..(491): n is a, c, t, g, unknown, or other
  misc_feature (500)..(500): n is a, c, t, g, unknown, or other
  misc_feature (583)..(583): n is a, c, t, g, unknown, or other
  misc_feature (595)..(595): n is a, c, t, g, unknown, or other
  misc_feature (597)..(597): n is a, c, t, g, unknown, or other
  misc_feature (598)..(598): n is a, c, t, g, unknown, or other
  misc_feature (605)..(605): n is a, c, t, g, unknown, or other
  misc_feature (606)..(606): n is a, c, t, g, unknown, or other
  misc_feature (628)..(628): n is a, c, t, g, unknown, or other
  misc_feature (629)..(629): n is a, c, t, g, unknown, or other
  misc_feature (655)..(655): n is a, c, t, g, unknown, or other
aagctggagctccccgcggtggcggccgctctagaactagtggatcccccgggctgcaggaattcgcacgagaccattacctagaacatcctaatcgaaaaaattcccctgcctgttgccgtacgtgcctaagctagcttcgtcgtctcgttgcacgtacgtagtagctagacagccgaatcggctctctagctagctcctcccttccgatcgatatcatcgccatgtcggggatctcgctggcggtggcgccaaggtccgacccggaccacgggtcggagcggcagccgacggcgatgctgggcggcgtgatgggctcgctccgcgtcatcgagctgcagctggtggccttcatcatggtgttctcggcgtcgggcctcgtcccgctcatcgacctcgtgttccccgtcgccaccaccgtctacctcctcgccatctcccgcctcgccttccccgcgctgcacgccaccaagtcgtccaagcctgatgancgcgccggntcgcccgccgcctcctcccagtcgtccccagagatcttcccgcggcagcagtaatcaacaatccattcaccacttggcttccnttcgtccttccntnncatcatnncgctagctagcttaaagctggnnagctgggctgcgcaggctggtccagn

SEQ ID NO: 18176 - protein, 109 aa, Zea mays
  misc_feature: Ceres CLONE 1384003-F
  misc_feature (89)..(89): Xaa is any aa, unknown, or other
MSGISLAVAPRSDPDHGSERQPTAMLGGVMGSLRVIELQLVAFIMVFSASGLVPLIDLVFPVATTVYLLAISRLAFPALHATKSSKPDXRAGSPAASSQSSPEIFPRQQ

SEQ ID NO: 18177 - DNA, 685 bp, Zea mays
  misc_feature: Ceres CLONE 1384007-F
  misc_feature: Encodes the peptide sequence at SEQ ID NO. 18178
  misc_feature (311)..(311): n is a, c, t, g, unknown, or other
  misc_feature (312)..(312): n is a, c, t, g, unknown, or other
  misc_feature (356)..(356): n is a, c, t, g, unknown, or other
  misc_feature (375)..(375): n is a, c, t, g, unknown, or other
aaagctggagctccccgcggtggcggccgctctagaactagtggatcccccgggctgcaggaattcgcacgagaccattacctagaacatcctaatcgaaaactgcacacattccgcgcacaccccggggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatggtcgaagacgaatgcatttttgtggacgagcaggacaatggtnngtgccatgagtcaaagtacaactgccatttgatggaaaaagatngatctgagaatctgctacntaggccatgcaggggggtcccttttcaactcaaaaatgagctgctactccagaaaaggcccggaaaagggtacccttcccttaatttgaccaaaaccggtggaaccaccctttggaccgggggttgagttttccccggaaactcccttggggggaaaaatgcccccagaggagacttggggtgggggggccccccccaaaaagggcccccgggggacaattccccccttggggggggagttttttaaggaccccctttcgcgaaaaagaggggggaaaaaaaattttaccccccgggtgtttttcccggg

SEQ ID NO: 18178 - protein, 96 aa, Zea mays
  misc_feature: Ceres CLONE 1384007-F
  misc_feature: SWISSPROT Homolog: EC 5.3.3.2 Isopentenyl-diphosphate Delta-isomerase
  misc_feature (34)..(34): Xaa is any aa, unknown, or other
  misc_feature (49)..(49): Xaa is any aa, unknown, or other
  misc_feature (55)..(55): Xaa is any aa, unknown, or other
MAAAVVDDAGMDAVQKRLMVEDECIFVDEQDNGXCHESKYNCHLMEKDXSENLLXRPCRGVPFQLKNELLLQKRPGKGYPSLNLTKTGGTTLWTGG

SEQ ID NO: 18179 - DNA, 714 bp, Zea mays
  misc_feature: Ceres CLONE 1384008-F
  misc_feature: Encodes the peptide sequence at SEQ ID NO. 18180
  misc_feature (310)..(310): n is a, c, t, g, unknown, or other
  misc_feature (399)..(399): n is a, c, t, g, unknown, or other
caagagctggagctccccgcggtggcggccgctctagaactagtggatcccccgggctgcaggaattcgcacgagaccattaccagaacatcctaatcgaaaaacaacaccagaatccgcgaatcacagacgcgtctatctcagcttgctgcactgcactaccctgccctgccatcatatcgtacgtgagcccggccgagcgagagcgagggagagcatggctgctccgaagctcgcgacgctggcgctggccgtgctcctggcggcgaccgtggtggctccccccgcccgcgtgcgcgcggcgatgtcntgctccaccgtgtacagcacgctgatgccgtggcctgccgttcgtccagatggccggggccatggccccccagccgggctggggggggnatccgcagccttgttggaaaaaggcaaaaaaaccccccgaacgccgaaacatttgggggttggcccaaaaacgtcccccaaggccgccaaggggaaagggacccttaattaaggcgggccccccggtttttcccaaaaagggggggggccccccctgcccttaaaaaaacccccccccccgtttcccgcgaaaccataaattaaatggggggggggcccccgggccccccccccgcaaaaaaaattttttttgggcccccctccaaaaagaaaaaaaaaaaagggccgcggtgttttaaaaaaaaatacgggggg

SEQ ID NO: 18180 - protein, 97 aa, Zea mays
  misc_feature: Ceres CLONE 1384008-F
  misc_feature (61)..(61): Xaa is any aa, unknown, or other
MAAPKLATLALAVLLAATVVAPPARVRAAMSCSTVYSTLMPWPAVRPDGRGHGPPAGLGGXSAALLEKGKKTPRTPKHLGVGPKTSPKAAKGKGTLN

SEQ ID NO: 18181 - DNA, 710 bp, Zea mays
  misc_feature: Ceres CLONE 1384017-F
  misc_feature: Encodes the peptide sequence at SEQ ID NO. 18182
  misc_feature (540)..(540): n is a, c, t, g, unknown, or other
tccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtctttgcgagcatgatgtcgcaaatgatgatgccaccatgtcactgcgacggcgtctcccagattatgctgcaacagcagttaccattcatgttcanccaaatgggcatgacgattccacccatgttcttacagcaaacccttggttgggggctgatccaaaaaaaaaaaaattggggtggatcgaaaaaggattgactgccctccccgggggacccttaataaaaaaaaacagttccccccaaaaaaactttaaaatcccccccaa

SEQ ID NO: 18182 - protein, 162 aa, Zea mays
  misc_feature: Ceres CLONE 1384017-F
  misc_feature (130)..(130): Xaa is any aa, unknown, or other
MAAKMLALFALLALCASATSATHIPGHLPPVMPLGTMNPCMQYCMMQQGLASLMACPSLMLQQLLALPLQTMPVMMPQMMTPNMMSPLMMPSMMSPMVFASMMSQMMMPPCHCDGVSQIMLQQQLPFMFXQMGMTIPPMFLQQTLGWGLIQKKKNWGGSKKD

SEQ ID NO: 18183 - DNA, 703 bp, Zea mays
  misc_feature: Ceres CLONE 1384023-F
  misc_feature: Encodes the peptide sequence at SEQ ID NO. 18184
  misc_feature (703)..(703): n is a, c, t, g, unknown, or other
gctctagaactagtggatcccccgggctgcaggaattcgcacgagaccattacctagaacatcctaatcgaaaaaaaacttagccgcgtggacgcacaccagcacctgccctcctcgccgtcgccgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcagttcaaggtgccggactggttcctcaacaggaagaaggattacaaggacgggaggttctcgcaggtcgtctccaacgcccttgatatgaagctcagggacgaccttgagaggctcaagaagatcaggaaccaccgtggtctgcgtcactactggggcctccgcgtccgtgggcagcacaccaagactactggtaggcgtggaaagaccgctggtgtctccaagaagcgatgagctctatatcaccctgagacatcttgtccgcactaccgtgatggtttgtgtcctaacagtcctgatggagggtatctgtn

SEQ ID NO: 18184 - protein, 152 aa, Zea mays
  misc_feature: Ceres CLONE 1384023-F
  misc_feature (14)..(142): Pfam Name: Ribosomal_S13 Pfam Description: Ribosomal protein S13/S18
MSLIAGEDFQHILRLLNTNVDGKQKIMFAMTSIKGVGRRFSNIVCKKADIDMNKRAGELTPDELERLMTVVANPRQFKVPDWFLNRKKDYKDGRFSQVVSNALDMKLRDDLERLKKIRNHRGLRHYWGLRVRGQHTKTTGRRGKTAGVSKKR

SEQ ID NO: 18185 - DNA, 727 bp, Zea mays
  misc_feature: Ceres CLONE 1384028-F
  misc_feature: Encodes the peptide sequence at SEQ ID NO. 18186
aagctggagctccccgcggtggcggccgctctataactagtggatcccccgggctgcaggaattccacgagaccattacctagaacatcctaatcgaaaaatcgacccagccatctcctcaccctcgttcaccacacagtccgccactcctttagtagcttgtgatttgtacgtcgacgagatcactggtcgggtggcggacgactacacatggggaagggtagtgtgggtgcatcatggtgggcgttcctcctgctcgccggcgtgctgctggtcgtatcagccacggccggggcggaggacggagtggtcgaacgggaccgcaaggaggacctgcggaggtgcaagcacgcgtgcgagtggcagtacggaaaggacaccccgcggaagagggaatgcgagagcgagtgccgcgagcggcaccatcaagctgacgcgggcgaggacggcgacagcggcgtggacgcctacgtctcccgctccgggaggggcgagtgccggcgccagtgcctgcgccgccactagggccagccgtgggagacccaggagtgcatgaggcggtgccgccgccgcggactggccgtcgacatggaacaagagtacggtcgcggcaacgagagcggggtcaagtgccgggaagaggtgcgagcgccaccaccgcgggtactggtgggagaggcaccgctgcctgatggactgaaaaaaaccttaaacggttagtaagagg

SEQ ID NO: 18186 - protein, 104 aa, Zea mays
  misc_feature: Ceres CLONE 1384028-F
MGKGSVGASWWAFLLLAGVLLVVSATAGAEDGVVERDRKEDLRRCKHACEWQYGKDTPRKRECESECRERHHQADAGEDGDSGVDAYVSRSGRGECRRQCLRRH

SEQ ID NO: 18187 - DNA, 920 bp, Zea mays
  misc_feature: Ceres CLONE 1384032-F
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
ccccccccccccccctcgggggctgcaaaaactccncnnnnaacctgcagctcaccgcgctggggggcgctctataactagtggatcccccgggctgcaggaattcgcacgagaccattacctacaacatcctaatcgaaaaaaattgaccgtcattgtgcgacccagacccccttcgccattttcaccaactccctccgatcccggtcatggcggcggaggactgcccccccggcgcggcaaaggacgcgctcgtacgaggcttgcaggctccaccgcgaggttccttcgccgtacgacccccgagagggtcgcggtgccggtccccgctcccgcagggtccacctagctgctacagcccggcacagcgcggcggtcgaccggctcgcacaccgcggaggagactggcccccgaggaccgcctccatcaggcgcacagatgctccgtccaatataatccgaccaccacacttagaacagagtaatggggcgcccccacctcacagggtggcacgagggggcgaatcggcggaggaccgcgatcatccaaggacgagtgccaccgaggaattcagtaacgtccttacgcccgccccgatgccacaagccccccatcgcttaggatgcccgccccccccctaccgccgagccaagaactgagtgggcgttccaaccatagaggattctaccccctggttgtgttccttatgccactggagcctcatccccgctgcagagaactccagtcccttctacagactctccctggccggggacgcggggtgggggagactcttggcccgcctcgggaccccccgacagttgggggtctctcctgcagcatagctagttctcccctgcacacgtcggtgggcttgacagtgcggcaggctggttcgtaggcggttccgtcgcaacaa

SEQ ID NO: 18188 - DNA, 672 bp, Zea mays
  misc_feature: Ceres CLONE 1384033-R
ccgattgggtaccgggccccccctcgaggtcgacggtatcgataagcttttttttttttttttttatttgaaatacttgattaaaaagaagttaaataaaaaatcggaatcaaagcaatgactgctggcaagtagcaacctggttctaccagtacgaccacgcgacacggttcaagaccagtcgcagcacactactaactataaaccgggagcaaattgcaaacgagaactagacattagacaagcatcacagttccagactagttcacgaaatagtttcaacgaattaggactccttatacaattttttgtaataaaaacggctcgaatctaaaggaactccacttaacataggacaacacaacatagcaagttcaacagagaattgttcccaactttccagcaagcagaatctcctaatcatggttgaaagactggtacagaggaacctgagacatcattggactaacattatcatagcaatggggatacatcattgttggggttggccaatgtcgataaacagcagctccagaagaccctattgttagatcaggctggccaaagtacatagtatgctggtttgtggacatgccaggagattgcacataaccaatgccatactgcataaacttttgtagtttcgatcgtagtctgggtcactacgatcct

SEQ ID NO: 18189 - DNA, 740 bp, Zea mays
  misc_feature: Ceres CLONE 1384036-F
  misc_feature (306)..(306): n is a, c, t, g, unknown, or other
  misc_feature (358)..(358): n is a, c, t, g, unknown, or other
  misc_feature (365)..(365): n is a, c, t, g, unknown, or other
  misc_feature (403)..(403): n is a, c, t, g, unknown, or other
  misc_feature (420)..(420): n is a, c, t, g, unknown, or other
  misc_feature (425)..(425): n is a, c, t, g, unknown, or other
  misc_feature (536)..(536): n is a, c, t, g, unknown, or other
cgcggtggcggccgctctagaactagtggatcccccgggctgcaggaattcgcacgagaccattacctagaacatcctaatcgaaaagaattttcgaatttctagttcgtctgcgatccaatcgtgtgggggtgctctcgagaatcgttaaacctcgtcagaggttttgctttcacgacacgatggccgcaccgttcttctcaactccattccagccatatgtctaccaggtacgtgtgaacgcatgacccggccagttagtattcatgtgattatgtcatttgataaacatttgtatgcagagtncacaagatacagtcacaccttttcagattttgggtggtgaagctcaagttgntcagatnatggtaaagtcagagaaagagtcatggctaagccaggntccaggggtaacatggnctggnctcgtggaaaggaaaaaaactttacccctgaacaaaaagtggaggcctaacgggagttttgggaaaaagggaaaccccggtttttttttcgaaaattggcaaaaaaggggnttttttgggggggggggcgcccccttttttccccggggtttccggggtgtttttccttgtgggggggggggggaatttttgccccaggaggttttttttttttttacacgggggggggaagggggggctccttttttcagaaaaaaaaaaatttgtggggcggggggggggggttttttttcaaaccttttttggggggggggt

SEQ ID NO: 18190 - DNA, 796 bp, Zea mays
  misc_feature: Ceres CLONE 1384041-F
  misc_feature: Encodes the peptide sequence at SEQ ID NO. 18191
  misc_feature (221)..(221): n is a, c, t, g, unknown, or other
  misc_feature (237)..(237): n is a, c, t, g, unknown, or other
  misc_feature (270)..(270): n is a, c, t, g, unknown, or other
  misc_feature (314)..(314): n is a, c, t, g, unknown, or other
  misc_feature (317)..(317): n is a, c, t, g, unknown, or other
tggagctccccgcggtggcggccgctctagaactagtggatcccccgggctgcaggaattcgcacgagaccattacctagaacatcctaatcgaaaaacttctacctggcctcgcaggcttcgcaaggcggccacacgccgatacctcctccttcacccgctccgtcgtcccccccagccggccacgccaccatgctgccaccggccgcgcgccttgcggnccgccgcctcctcggnctcgcctccgcatctgcgtcggaagccgccggncgccgggtagcttcctctccgatcgcttccgcaggctactccgnccngcgcgtcagggggctccgtctccagcaccaggccccttctccacggttcttaactaccacctgtgactccccggaaaaacaaagccgaaatgaaaatggaagttctccaagggcgaaaatgaaaaaggccaaaggaatttttgccccctatacccagggaataaaaagagattggggattaatccccgtgcgtttaactttgcaacaaaaacaaatggggggaggggggcccctttgcaaaaaagggtggtttttgtaaaattggggaaagtgtccccacacaggggttaagaagtgcggccccccctaaacaaggttaaaacgagaaaaggggggaaaaccccaccttttggggggggagaaaaacccttgtgataaatcgggggccccaaaaaaaaaaaaaaatggtggggcgccccctgggaaaaaaaaaaagggggggccggggggtgtttttttttggggaaaagaggggaggg

SEQ ID NO: 18191 - protein, 127 aa, Zea mays
  misc_feature: Ceres CLONE 1384041-F
  misc_feature (10)..(10): Xaa is any aa, unknown, or other
  misc_feature (41)..(41): Xaa is any aa, unknown, or other
  misc_feature (42)..(42): Xaa is any aa, unknown, or other
MLPPAARLAXRRLLGLASASASEAAGRRVASSPIASAGYSXXRVRGLRLQHQAPSPRFLTTTCDSPEKQSRNENGSSPRAKMKKAKGIFAPYTQGIKRDWGLIPVRLTLQQKQMGGGGPLCKKGWFL

SEQ ID NO: 18192 - DNA, 724 bp, Zea mays
  misc_feature: Ceres CLONE 1384042-F
  misc_feature: Translation starting site: 278
  misc_feature (444)..(444): n is a, c, t, g, unknown, or other
  misc_feature (445)..(445): n is a, c, t, g, unknown, or other
  misc_feature (452)..(452): n is a, c, t, g, unknown, or other
  misc_feature (494)..(494): n is a, c, t, g, unknown, or other
  misc_feature (564)..(564): n is a, c, t, g, unknown, or other
aagctggagctccccgcggtggcggccgctctagaactagtggatcccccgggctgcaggaattcgcacgagaccattacctagaacatcctaatcgaaaaatgcacactcactcactccagtgcccactgcccactgcccactgcccgacgaggaagtttcacgatcccaacccgtataaatcgacgccgcgagggggagcgacgagcgatccccgtaattaacctgtcccagccgcaccgatccaccccccctcggcctcggcctccctccggccatggaggtgttctactacgtcgtgttcggcgcgctggccgccgtcgtggcggggctcgagctcggcaagagcggcaaggaccgcgtcgccaccacctccgcatttcactcctttcagaaacactacgtcctcgtctactccctcatgatgtccggggactggctgcnnaggcccntacgtctactacctctacagccagtatgggttcgacaagggngaaatcgggccgctcttcatcgccgggttcggattctccatgctcttcggaacatcgtcggttccctcgncgaaaaaagggcccaaaaaagggctgggtcacctattgattagttactcctaggtggattccaagattcccccgagtaaggggccccatggacggccgatcccccggggggatgcccccctgtgggtttttccccctttagagcttgggttcgcccagaa

SEQ ID NO: 18193 - DNA, 712 bp, Zea mays
  misc_feature: Ceres CLONE 1384046-F
  misc_feature: Encodes the peptide sequence at SEQ ID NO. 18194
  misc_feature (457)..(457): n is a, c, t, g, unknown, or other
  misc_feature (512)..(512): n is a, c, t, g, unknown, or other
  misc_feature (567)..(567): n is a, c, t, g, unknown, or other
  misc_feature (676)..(676): n is a, c, t, g, unknown, or other
  misc_feature (692)..(692): n is a, c, t, g, unknown, or other
gctcttaactagtggatcccccgggctgcaggaattcgcacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgagcggcaccagcaagctgacgcgggcgaggacggcgacagcggcgtggacgcctacgtctcccgctccggnaaggggcgagtgccggcgccagtgcctgcgccgccacgagggccagccgtggganacccaggagtggcatgaggcggtgccgccgccgcggactggccgtcgactggagncaagagtacggtcgcggcagcgagagcgcgggcagtgggcccgggagaggtgcgagcccaccaccgcggggaactgggtgggagaggcagcggctgcctgagtactganaaaacccggagagcgnaaggaaggagggcggcaacg

SEQ ID NO: 18194 - protein, 73 aa, Zea mays; identical to SEQ ID NO: 14723
  misc_feature: Ceres CLONE 1384046-F

SEQ ID NO: 18195 - DNA, 700 bp, Zea mays
  misc_feature: Ceres CLONE 1384048-F
ggcggccgctctagaatagtggatcccccgggctgcaggaattcgcacgagaccattacctagaacatcctaatcgaaaaaaaattcgtcatattttctctcctcccctggtcccttctcgctctcgcccgcgtaattcctctctggagtctaccacaggccgagcacccccgcgcacgaaaaagggacgggcgcacaaaagcgacttaggctcccttccagttccctgatcccaactgagaaacaatggacatctgaagcacgaggagcccacccacctcactctgtcaaaccgcgccgcccaacgcgctcaatggctcgcggcgcttgcctgaccttgctctttgagctcacccggcccgcccgcattgcgacgccacgactatctcagcgaccttccgcactctaccccatagcgctccttgagcaccactaccacgaaccctcccccgcgaaccgaacccccgcgcagcgacaccatgacccccgcgacaagcacgctaccacaactgccaccctcgagcccacccccccctctactccgcctccccaccccccccccctcccaccccccggacctcggggcacatccgccaccccccccctctgcccctacaccctggcctcaccccacaaccccaccccctcgcccccacacccgggcccctgagaccgaccccccagaaccccctccataccg

SEQ ID NO: 18196 - DNA, 721 bp, Zea mays
  misc_feature: Ceres CLONE 1384052-F
  misc_feature: Encodes the peptide sequence at SEQ ID NO. 18197
tccccgcggtggcggccgctctataactagtggatcccccgggctgcaggaattcgcacgagaccattacctagaacatcctaatcgaaaagcaaaaatctctgccgtgcctctcgtctctcttctcaggcgccacgcaaaacgttctccgttttccctctccggatccggcccgcgggggccaggagctaccgatgatccggaccgcaacggtgcgagcgcgtctcctcctatcgcgctcctacgtagcacaggcacaggcagcttctcgctggcctctcgtccgctggaaggcttcgcatcttggatctgtacgctctctctatcagatggacattacaaggcaatacaataataaaagtttgactggaagagggtgccatagctcccctgagagtcaagaactagcaatgaaaagctgcgttccatgcaactctaaggatttacgtcccatggcagaagattctgctaaaaagttgcttgaacaggtgaatggttgggaactgatcactgaagggggggttctgaaattacctagaacatgcaaggtgtagaactttgttaaaggacttggagtcttttcgcttgttgctgctattggttgaggaagaaggtccccatccaaatcttcatcttgttgggtgggaataaaggggaaaatcgaggtttgggaccctttccgggcagagggttaaccaaggaaatgattccactccctggg

SEQ ID NO: 18197 - protein, 119 aa, Zea mays
  misc_feature: Ceres CLONE 1384052-F
MIRTATVRARLLLSRSYVAQAQAASRWPLVRWKASHLGSVRSLYQMDITRQYNNKSLTGRGCHSSPESQELAMKSCVPCNSKDLRPMAEDSAKKLLEQVNGWELITEGGVLKLPRTCKV

SEQ ID NO: 18198 - DNA, 866 bp, Zea mays
  misc_feature: Ceres CLONE 1384061-F
cgcggtggcggccgctctagaactagtggatcccccgggctgcaggaattcgcacgagaccattacctagaacatcctaatcaaaaaaaactttagtctactcgtcctcggtcctcctcttctcgcagcagccaggagaccaatcgggacaagcaaactcccccgattagtttaagcagcccgggcccggcgacgaccagctccggtccgcgcggggatttaaacgcgcgaaccgagaaggcacgcagcaggcggcaggggcaaacaaggaacgcgatcgcgcgccggacgacgacgcggggggccggggcctggtggtgaccgggttgcgacctccgccgcattcgtgtcgggccgggcgccggcggtaccgtgggggggcccggctggcgggggggagggggcccccccggcccctcctcctcccttccaggcgggtcggcccggggtccccaggcaagaacaggggggagtttatccaaagttgtgggggaccccccccgggtgggcacacaccagcagcccccggggggcggggaccggacccaccccccggaggcaacctggggtgcggccaggcgggcgccggcgccccacgcccgtctgggtagcgcgggctcccgggggacgacccgcatcgggcgcggcgcgtcccaagaaggcgccgcctcacctgcctcgtgacctgatctcaccctcccgagggacgcgggggcgggggcgccggggctgtctcccccccgctcgacgggaggagaaaaagaggcgactgtgggccacgcccgggtgccgatacacttcgctacatgaatgagggcctcgccgaacgccgggacacacacgcctctctcacggggaggcggggg

SEQ ID NO: 18199 - DNA, 756 bp, Zea mays
  misc_feature: Ceres CLONE 1384089-F
  misc_feature: Encodes the peptide sequence at SEQ ID NO. 18200
  misc_feature (36)..(36): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (63)..(63): n is a, c, t, g, unknown, or other
tcaccgcggtggcggccgctctagaactagtggatnccccngnnctgcagaattcgcacgagnacattacctagaacatcctaatcgaaaaaccccaacgagaagagcggcggcgcggccggacaaggagcaggcggaggaggagctgtgccaagccacaatgggtatctcgcgggactcgatgcacaagcgccgggccaccggtggaaagcacaaggcctggagcaacaaccgaaagtatgagcttggtcgccagccagccaacacccagttgtcaagcacataagacagtgaggagggcccgcggcccgcggaagcccatgccaaatgcaccgccccttccccttgatactggctacctcctcatggggaaactgaagcctgttacccccccgacccccaatcctcgaacgcgccctaccacggcatcaacacatggagcttgtgaaggaccccaaccccttgcgcaacagcgccccttggtgcaccgttgacgctcgccccccttcaacgcgggggccccttcaccccctcaggcgacctgacctcttgcccccgacaaacaaacaccccctgcctgccaacaaagcctacctgcccacgcaccaacgacgctcccggcccacccctctgtgccaacacacaaccacccaccctttggccacccagtaaactctgcacaaacgccacggctggaaaccctaccctcgaccccccctcctctcccctgcccatcctgcccggcctcgccacccc

SEQ ID NO: 18200 - protein, 41 aa, Zea mays
  misc_feature: Ceres CLONE 1384089-F
MGISRDSMHKRRATGGKHKAWSNNRKYELGRQPANTQLSST

SEQ ID NO: 18201 - DNA, 619 bp, Zea mays
  misc_feature: Ceres CLONE 1384100-F
  misc_feature: Encodes the peptide sequence at SEQ ID NO. 18202
aaagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccagggtggagaacaagaagccatttgctcctccgagggaggtacatgtccaggttacacattcaatgccatctcacaagattgaaattttcaagtcacttgatgattgggctagagataatatcttgacacatctcaagccagtcgagaagtgttggcagccacaggatttcctccctgacccagcatctgaaggatttcatgatgaagttaaggagctcagagaacgtgccaaggagatccctgatgattattttgtttgtttgggtggagacatgatt

SEQ ID NO: 18202 - protein, 132 aa, Zea mays
  misc_feature: Ceres CLONE 1384100-F
  misc_feature: SWISSPROT Homolog: EC 1.14.19.2 Acyl-[acyl-carrier-protein] desaturase
MALRLHDVALCLSPPLAARRRSGGSFVAVASMTSAAVSTRVENKKPFAPPREVHVQVTHSMPSHKIEIFKSLDDWARDNILTHLKPVEKCWQPQDFLPDPASEGFHDEVKELRERAKEIPDDYFVCLGGDMI

SEQ ID NO: 18203 - DNA, 679 bp, Zea mays
  misc_feature: Ceres CLONE 1384103-F
  misc_feature: Encodes the peptide sequence at SEQ ID NO. 18204
aaagctggagctccccgcggtggcggccgctctagaactagtggatcccccgggctgcaggaattcgcacgagaccattacctagaacatcctaatcgaaaaccaacctcatcttctctccttttgctcggaacgcacacaccgcccggtctccgatctccgatccccgatcccctcgtcgatccaagatgcagatcttcgtcaagactctcactggaaagactatcaccctcgaggtggagtcctctgacaccattgacaacgtcaaggccaagatccaggacaaggaaggcattcccccggaccagcagcggctcatcttcgctggcaagcagctcgaggacgggcgcacacttgccgactacaacatccagaaggagagcaccctccaccttgttctccgcctcaggggaggcatgcagatcttcgccaagaccctcattggaaaactatcaccctcgaggtggagtcttctgacaccatcggacacgtcaagggcaagatccaggacaaggagggcatccctcccggaccagaagcggctcatttttgctggcaagcaggctcgaggacggggggacggttggccgactatcacattcagaaggggaggcccctccacctgggggtggcgtctcaggggcggcatgcaaatcttcggagaaactctgactggaag

SEQ ID NO: 18204 - protein, 163 aa, Zea mays
  misc_feature: Ceres CLONE 1384103-F
  misc_feature (6)..(74): Pfam Name: ubiquitin Pfam Description: Ubiquitin family
MQIFVKTLTGKTITLEVESSDTIDNVKAKIQDKEGIPPDQQRLIFAGKQLEDGRTLADYNIQKESTLHLVLRLRGGMQIFAKTLIGKLSPSRWSLLTPSDTSRARSRTRRASLPDQKRLIFAGKQARGRGDGWPTITFRRGGPSTWGWRLRGGMQIFGETLTG

SEQ ID NO: 18205 - DNA, 718 bp, Zea mays
  misc_feature: Ceres CLONE 1384105-F
  misc_feature: Encodes the peptide sequence at SEQ ID NO. 18206
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (50)..(50): n is a, c, t, g, unknown, or other
naaaannnnccccccccccccaccctcacacacccccagccccnnnnngngagtttgttcaaagctggagctccccgcggtggcggccgctctagaactagtggatcccccgggctgcaggaattcgcacgagaccattacctagaacatcctaatcgaaaaaggagatacagcgagcgagcgaccaaagccatggctctccgcaccctggcatcgaagaaggtcctatccttcccgttcggcggcgcgggccggccgttggcggcggcggcgtctgcgaggggggtgacgacggtcacactccccgacctctcctacgacttcggcgcgctggaaccggccatctcgggggagatcatgcgcttgcaccaccagaagcaccacgccacctacgtcgccaactacaacaaggcgctggagcagcttgacactgccgtctccaagggcgacgcctccgctgtcgtccagctgcagggcgccatcaagttcaacggcggcggtcatgtgaaccattcaatcgggctggaagaacctcaagcccattagcgaaggtggcggggcagccgccttcatgggaaaacttggcttgggcccatcgatgaaggattttgggttccccttggaagcaccttggtaaagaagaaggaatggccgaaaggcccctggctttaacaagggggccccggaataggggtggggggtctaaagcgtttgggaa

SEQ ID NO: 18206 - protein, 117 aa, Zea mays
  misc_feature: Ceres CLONE 1384105-F
  misc_feature (34)..(112): Pfam Name: Sod_Fe_N Pfam Description: Iron/manganese superoxide dismutases, alpha-hairpin domain
  misc_feature: SWISSPROT Homolog: EC 1.15.1.1 Superoxide dismutase
MALRTLASKKVLSFPFGGAGRPLAAAASARGVTTVTLPDLSYDFGALEPAISGEIMRLHHQKHHATYVANYNKALEQLDTAVSKGDASAVVQLQGAIKFNGGGHVNHSIGLEEPQAH

SEQ ID NO: 18207 - DNA, 667 bp, Zea mays
  misc_feature: Ceres CLONE 1384106-F
  misc_feature: Encodes the peptide sequence at SEQ ID NO. 18208
aaagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagagggtgtggacaaaagaacttctaggaagatgatccgatctacggaaggctgtgcaaagagcattactttggagaggaacaacaaatcagacgatgtgcagcttcacgatctgccgaatgacatcctaggtagcatactatcacggttgacattcagagaatcctcacagatgggccttgtttctcatacctggcggcggctgtggagaagctgttgccggaaactggtcttcaccagtgccaccatgttccaacccggaaataggagcatcaaacatacaaggaccaactttgccatgagagtcaacagtttcttgcgtcagctacgcactcatcctactcttaataagtttgttattaagttcgggctgcgcaggaagcacactcgccatgtcaa

SEQ ID NO: 18208 - protein, 137 aa, Zea mays
  misc_feature: Ceres CLONE 1384106-F
  misc_feature (38)..(85): Pfam Name: F-box Pfam Description: F-box domain
MAKQKEGVDKRTSRKMIRSTEGCAKSITLERNNKSDDVQLHDLPNDILGSILSRLTFRESSQMGLVSHTWRRLWRSCCRKLVFTSATMFQPGNRSIKHTRTNFAMRVNSFLRQLRTHPTLNKFVIKFGLRRKHTRHV

SEQ ID NO: 18209 - DNA, 797 bp, Zea mays
  misc_feature: Ceres CLONE 1384111-F
  misc_feature: Encodes the peptide sequence at SEQ ID NO. 18210
ggcggccgctctagaactagtggatcccccgggctgcaggaattcgcacgagaccattacctagaacatcctaatcgaaaaactagctgctctggctcccccgaggcaatcgagtaatcgacgaaggccaccaccacctccacaccactttgcctcgagaaggttccaccaagcctctcggctagggtttggggactttgggggcgatcgcaatggaggggcgcgtcgcggaacaagcaccctaggcggaggcggaagtgaaaatgccgaggtgcttcatggacctccccatcggcggcgagatggaggtcaggatcgttggaaaactctacgcttccgggggaccccggccggcggaagaacttccgcgcgctctagacagggggaaacacgcctccgggcccctcgggggggaagcccgcttccgctttcgggggcgcaggctctcccccgggcgtcttaaacgcggctttagggactgacgggccggacaccacctctggttggcgaaaccggattgggggcgaggaagtacaactttcaggcgcgccccattttttaggacccgacgagctttggtttttagagccgctgggacggcaacacgaaatggtcttccaatagcggcacctgccttggtccccgcgccccagaggggccacttgccggtcttcttcccccgcggtacatgctccgtcgctaccctaccattgtacaacgcgtacaaatcttgcggtctcgcgctgctgagaaggagctaccaaagcggagcggccgccacaagctgtgcgctcttg

SEQ ID NO: 18210 - protein, 72 aa, Zea mays
  misc_feature: Ceres CLONE 1384111-F
  misc_feature: SWISSPROT Homolog: EC 5.2.1.8 Peptidylprolyl isomerase
MPRCFMDLPIGGEMEVRIVGKLYASGGPRPAEELPRALDRGKHASGPLGGEARFRFRGRRLSPGRLKRGFRD

SEQ ID NO: 18211 - DNA, 858 bp, Zea mays
  misc_feature: Ceres CLONE 1384112-F
  misc_feature: Translation starting site: 272
cccccccccccccgcccccgcgttgaacccggccgccaccccaagctgggactccccgcggtggcggccgctctagaatagtggatcccccgggctgcaggaattcgcacgagaccattacctagaacatcctaatcgaaaaaccctacactgagaaccgcagagacaggcgtcttcgtactcgcctatctccgcgactcaaagctttccccaattcccccccttctcccatttctcaccaccgccgccgctccccccgttcaacaacaccatgagggagtgcatctcgatccacatcggccaggctggtatccaggtcggaaaccgcgtgctgggagctgtacctgcctcgagcatggcattcaggctgatggccagatgcccggtgacaagacccattggggcgaggagatgatgctttccacacccttcttcagtgagactggcgctggcaaacaaccgtccccccgtgctggttttttggttgaccttgagcccacctgccctccgatgaggggaggactgggacctaccggccaagctctttccattcctggagcacctcatcaagtgggcaaaggaagggaatgggaaggcaacaaactttccgcctcggggggccactacccccatttggcccaaggggaagaatcgcgtgaaccctgggcccttgacccgcactcacggaagctttgacgaaataattgcccccggctccccagggccttcccccccacattaacacgctggtcgggcgcaggaaaccgggctccgggcgcctgggacccccacccccacggggagggcgctcggccatgttgactcagtggccacaaaactccaagcctcggggcttcc

SEQ ID NO: 18212 - DNA, 946 bp, Zea mays
  misc_feature: Ceres CLONE 1384119-F
  misc_feature (42)..(42): n is a, c, t, g, unknown, or other
  misc_feature (834)..(834): n is a, c, t, g, unknown, or other
gcgtcccccccccccccaccccccccgcccggccccacacanaccaaaaactggagctccccgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgaaccatggggaagggtagtgtgggtgcatcatggtgggcgttcctcctgctcgccggcgtgctgctggtcgtatcagccacgggcgggggcggaggacgcagtggtcgaacgggaccggcaggaggatctggcggggcggcaagcatggggtgtcgagggggaagcacgggagggggacacccccgcggcaagagggaaatgcggagagcggacccgcccgcggaaggggggccccagaccaaggcttgtacggcgggggcgaaggcacgggccgaacaagccgggcgctgggacccgccctacgctccctccccggccccgcgggtgaaagcggagccaaaggtggccccggatggcccccagatgggggcctggcgcggcgcgcgctacctggagagaggcccgagcccgccccgcgacaccgagccccagtgacagcgcggccctggcagggtggggctggccccaccgcgcacgctgcgaaactggggccccggtacgcaaaatagctactctacaaaacaaccggttccgcgcgggcaggcgagcgtagcggcgggcggaacggcgggcggcncgcaaaggcgccgaaagttcacaccccgccaggcggcgaaccgggtacggccaccaggcgaccgcggcccctgtgtggggcccgcacggaccccgccgagccgcgcgagggg

SEQ ID NO: 18213 - DNA, 678 bp, Zea mays
  misc_feature: Ceres CLONE 1384121-F
  misc_feature: Translation starting site: 263
  misc_feature: Pfam Name: Mago_nashi Pfam Description: Mago nashi protein
  misc_feature (392)..(392): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (444)..(444): n is a, c, t, g, unknown, or other
  misc_feature (486)..(486): n is a, c, t, g, unknown, or other
  misc_feature (499)..(499): n is a, c, t, g, unknown, or other
  misc_feature (549)..(549): n is a, c, t, g, unknown, or other
  misc_feature (550)..(550): n is a, c, t, g, unknown, or other
  misc_feature (555)..(555): n is a, c, t, g, unknown, or other
  misc_feature (558)..(558): n is a, c, t, g, unknown, or other
  misc_feature (617)..(617): n is a, c, t, g, unknown, or other
aaagctggagctccccgcggtggcggccgctctagaactagtggatcccccgggctgcaggaattcgcacgagaccattacctagaacatcctaatcgaaaaatttgcagattactctacacgagtcacgataggaggaagactggaagaggaggcgagcacgtttgcggtgcccaccctcaccgtccactccagaaccccaaatccagttccgttccaatcgccgagaagggcagcaaaggggagaaaaaaaaggaaatctatggcggcggccggcggcgagaacagcggcgctggcgagggcgagggcgagttctacctgcgctactacgtgggacacaagggcaagttcgggcacgagttcctcgagttcgagttccgccccgacggcnagctccgctacgccaacaactcccactacnagaanncgacaccatgatcccngcagggaggtcttcgtctcgccctcgtcctccgcgagccagnaggatcatccagnagtccgacatcatgaagggagacgacagcaactggcccgagcccgaccgnnatcgncgncaggagttcgaaatcgtcatgggcaacgaggaacttttcatccccacttcaagatcggntccctccgcaatggccatccaagaaggaaccggagggcctcccgaatttcaaatactttgt

SEQ ID NO: 18214 - DNA, 622 bp, Zea mays
  misc_feature: Ceres CLONE 1384124-F
  misc_feature: Encodes the peptide sequence at SEQ ID NO. 18215
aaagctggagctccccgcggtggcggccgctctagaactagtggatcccccgggctgcaggaattcgcacgagaccattacctagaacatcctaatcgaaaaacgggctacggcctacctgttcacagtgactggcctcccgactcgactctcctccccctatctctatctgcttcctgctgagctcaaaccccttccgcctccccatcaaccattccatccgccgccgccgccgcctgcgcaagatgaatgtggagaagctcaagaagatggctggcgctgtacgcaccggagggaagggcagcatgcgcaggaagaagaaggcagttcacaagaccacgaccacagatgacaagcggcttcagagcaccttgaaaaggatcggggggaacaccattcctggtatccaggaagtcaacatccttcaggacgatgttgttatccagtttcagaaccctaaagggcaagcaatccattcctgcaatacatgggtgggtaaggggagaaccccaaacaaaagtctggaaaaccctctgccataatttatccaccaacgggcccctaataacctggacaacctaaaaaagtggttgaaatttcccaagggaggacccgggggtta

SEQ ID NO: 18215 - protein, 98 aa, Zea mays
  misc_feature: Ceres CLONE 1384124-F
  misc_feature (34)..(92): Pfam Name: NAC Pfam Description: NAC domain
MNVEKLKKMAGAVRTGGKGSMRRKKKAVHKTTTTDDKRLQSTLKRIGGNTIPGIQEVNILQDDVVIQFQNPKGQAIHSCNTWVGKGRTPNKSLENPLP

SEQ ID NO: 18216 - DNA, 576 bp, Zea mays
  misc_feature: Ceres CLONE 1384125-F
  misc_feature: Encodes the peptide sequence at SEQ ID NO. 18217
aaagctggagctccccgcggtggcggccgctctagaactagtggatcccccgggctgcaggaattcgcacgagaccattacctagaacatcctaatcgaaaacttttttccccgctcttctcccacacaaacgccaccgccgcatcgaatccgagacgccgatctcggattcgccgtcaccacacgctgccctcgtcgcgctctcccgccgccgccgctcgtctcgtcagccatggcaggattggcaccagaagggtcgcaatttgatgacaagcagtatgacaagaaaatgcaggagatattaactgaagacttcttcacttcatatgatgatgtttgtgaaagttttgacagcatgggactgcaagagaaccttctgagagcatctatgctatgtttgagagcatcggtatcagcaagggatagtccctctgcaggggctgacggatcagcagctcatctggactggaaaacgctaccttctgtctggaatctgcagcaactgataatgattggttgatgccaggaattgtttctgggtccaaccggggggtttgctcccaaattggaaagggt

SEQ ID NO: 18217 - protein, 95 aa, Zea mays
  misc_feature: Ceres CLONE 1384125-F
MAGLAPEGSQFDDKQYDKKMQEILTEDFFTSYDDVCESFDSMGLQENLLRASMLCLRASVSARDSPSAGADGSAAHLDWKTLPSVWNLQQLIMIG

SEQ ID NO: 18218 - DNA, 678 bp, Zea mays
  misc_feature: Ceres CLONE 1384129-F
  misc_feature: Pfam Name: Caleosin Pfam Description: Caleosin related protein
  misc_feature (377)..(377): n is a, c, t, g, unknown, or other
  misc_feature (401)..(401): n is a, c, t, g, unknown, or other
  misc_feature (402)..(402): n is a, c, t, g, unknown, or other
  misc_feature (590)..(590): n is a, c, t, g, unknown, or other
aaagctggagctccccgcggtggcggccgctctagaactagtggatcccccgggctgcaggaattcgcacgagaccattacctagaacatcctaatcgaaaatttcttttcctacctaacaagaaagcttgcgttaaagttgtgtccttactaacttgaccgattttctcattatgtcatggctccttccgctgcctcttcaaacactaaataactagaatctggcgatcaacgatatactgcattggataacatgcacgcttcttcaacagagacggacacggcctcatctatccttggcaaatcgtactacgatttagagcgcatagtgaagggcgtctcccgtcagctagtgctgctctccttatcgacgtgcnagttatccatacagctctccccgnngaatgcatgctcgctgctgcttgcagtagagggaataatagaagctttgcatccatgccacggtcactggactaataccacagcaccggaatttctgtggaatcgaaaattcaggggatatttcacaaagctgggtggctctcttccaaatggctctacttaaaagggacctccttacaatggttaantccaacagaaccccgggacaccttttgcgggttggtttggcaaatccggggaatgggaatttttattttgattttccccaaaatggga

SEQ ID NO: 18219 - DNA, 671 bp, Zea mays
  misc_feature: Ceres CLONE 1384131-F
  misc_feature: Encodes the peptide sequence at SEQ ID NO. 18220
  misc_feature (671)..(671): n is a, c, t, g, unknown, or other
agagctggagctccccgcggtggcggccgctcttttataatggatcctccgggctgcaggaattcccacgagaccattacctagaacatcctaatcgaaaaatcatcatccaatccagatcagcaaagcggcagtgcgtagagaggatcgtctaacagaacagcatgaagatggtcatcgttctcgtcgtgtgcctgggtctgtcagctgccagcgcctctgcaatgcagatgccctgcccctgcgcggggctgcagggcttgtacggcgctggcgccggcctgacgacaatgatgggcgccggcgggctgtacccctacacgtagtacctgaggcagccgcagggcagcccgctggcggcggagccctactacgccgggggtgggcagccgagcgccgtgttccagccgctccggcaacagtgctgccagcagcagatgaggatgatggacgtgcagtccgtcccgcagcagctgcacatgatgatgcagcttgagcgtgccgctgccgccagtagcagcctgtacgagccagctctgatgcagcagcagcagcagctgctggcagcccaggctctcaaccccatggccatgatgatggcgcagaacatgccggccatgggtggactctaccagtaccagctgcccagctaccgcaccaacccctgtggn

SEQ ID NO: 18220 - protein, 78 aa, Zea mays
  misc_feature: Ceres CLONE 1384131-F
MRMMDVQSVPQQLHMMMQLERAAAASSSLYEPALMQQQQQLLAAQALNPMAMMMAQNMPAMGGLYQYQLPSYRTNPCG

SEQ ID NO: 18221 - DNA, 575 bp, Zea mays
  misc_feature: Ceres CLONE 1384134-F
  misc_feature: Encodes the peptide sequence at SEQ ID NO. 18222
aaagctggagctccccgcggtggcggccgctctagaactagtggatcccccgggctgcaggaattcgcacgagaccattacctagaacatcctaatcgaaaaaccaataaaaaggtagagaatacaagaaaccgtcacgaccgcctccgcggtgctctaccatccgttccatggcgccgccgctcgccctgtttcttctcgccgccatcgtgctctcgcgggccgtctcccacgcccacggcggcggcgggcggcttctacgacccggcgagcgtcactcaggctctcctcgcgccccagggcgttccttgtacagcggctccctctcggaaaccgaaggggaccacctcgtcagcctggcaaaaggaccatggaggaggggatgtgggcgggtaaccacccgggaaaaggggggggaaagtaagggggaaccaatttcgggaacttttttggcaaagccgagggagaaaaacgggtcccgaattaaaaaaaaccgaaatttgttggaaattttccccccggaaaaaaaaccgaaaaaccccccggggtcccggggcaaaaaaaacccggcaaaa

SEQ ID NO: 18222 - protein, 135 aa, Zea mays
  misc_feature: Ceres CLONE 1384134-F
MAPPLALFLLAAIVLSRAVSHAHGGGGRLLRPGERHSGSPRAPGRSLYSGSLSETEGDHLVSLAKGPWRRGCGRVTTREKGGESKGEPISGTFLAKPREKNGSRIKKNRNLLEIFPPEKKPKNPPGSRGKKNPAK

SEQ ID NO: 18223 - DNA, 676 bp, Zea mays
  misc_feature: Ceres CLONE 1384138-F
  misc_feature: Encodes the peptide sequence at SEQ ID NO. 18224
  misc_feature (402)..(402): n is a, c, t, g, unknown, or other
aaagctggagctccccgcggtggcggccgctctagaactagtggatcccccgggctgcaggaattcgcacgagaccattacctagaacatcctaatcgaaaacccaacaagtctctcggccaggtctccctctccccggctctccgccttcctcttccagtccccgcgcgcgagatcgccgccccgtgtgggccctagatcccgatggcctcgcgccgccgcaccctgctcaaggtcatcatcctcggcgatagtggggttgggaagacttccttgatgaaccaatatgtgaacaagaagttcagcaatcagtacaaggctacgatcggcgcggatttcctcaccaaggaggtgcagttcgaggacaggctcttcactctgcaaatatgggacaccgctggncaggaaagtttcagagtcttggtggtgcattctaccggggagcagattggtgtggcctagtctatgatgttaattctatgaaatcattttgacacctggaacaactggcgagaagagtttctaattcaggctaggccatcagatcctgataattttcctttttgttctgttggggtaacaaaagtgatgtagatggtgccaacagcccgcgtgtatctgagaaaaggcaaagggatggggtgcttgcaaagggacattccggaacttgagacgt

SEQ ID NO: 18224 - protein, 85 aa, Zea mays
  misc_feature: Ceres CLONE 1384138-F
  misc_feature (10)..(86): Pfam Name: Ras Pfam Description: Ras family
  misc_feature: SWISSPROT Homolog: EC 2.7.11.1 Non-specific serine/threonine protein kinase
MASRRRTLLKVIILGDSGVGKTSLMNQYVNKKFSNQYKATIGADFLTKEVQFEDRLFTLQIWDTAGQESFRVLVVHSTGEQIGVA

SEQ ID NO: 18225 - DNA, 693 bp, Zea mays
  misc_feature: Ceres CLONE 1384140-F
  misc_feature: Encodes the peptide sequence at SEQ ID NO. 18226
  misc_feature (519)..(519): n is a, c, t, g, unknown, or other
  misc_feature (523)..(523): n is a, c, t, g, unknown, or other
  misc_feature (658)..(658): n is a, c, t, g, unknown, or other
aaagctggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgccccgccagctgttgctgtgcgccagctgctgcttccctacggcggctccagtcgcggacggagaggtgcaggtgcttgcctgcccgcagcatctccaccgcttgccgaggcgtcaggatctccgtcgncagnggcccgcgccgtcgccatccctcagttcgtcgggcctccaccagcagccgcgaacagcgcggcctttgtagctgtcccagcgccgcgtccaccttcgggggtccgcggctccctacccggcccggcctgaaccgncgcccggggccgaacgtttcaaagttccggtggga

SEQ ID NO: 18226 - protein, 96 aa, Zea mays
  misc_feature: Ceres CLONE 1384140-F
  misc_feature (74)..(74): Xaa is any aa, unknown, or other
MLLTSCRQGRGMASLSCARADGVVRSGALPRQLLLCASCCFPTAAPVADGEVQVLACPQHLHRLPRRQDLRRQXPAPSPSLSSSGLHQQPRTARPL

SEQ ID NO: 18227 - DNA, 667 bp, Zea mays
  misc_feature: Ceres CLONE 1384141-F
  misc_feature: Translation starting site: 222
  misc_feature: Pfam Name: zf-AN1 Pfam Description: AN1-like Zinc finger
  misc_feature (498)..(498): n is a, c, t, g, unknown, or other
  misc_feature (505)..(505): n is a, c, t, g, unknown, or other
  misc_feature (507)..(507): n is a, c, t, g, unknown, or other
  misc_feature (597)..(597): n is a, c, t, g, unknown, or other
  misc_feature (598)..(598): n is a, c, t, g, unknown, or other
  misc_feature (607)..(607): n is a, c, t, g, unknown, or other
  misc_feature (667)..(667): n is a, c, t, g, unknown, or other
aaagctggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacatgaacgtgcagcagcccgctgnatgtgcngnacccagcgagggggtggcggcgatctccaaggggggaaggtagggccgaaccggtgcagcgcctgcaggaagagggttggacttacgggnnatcactggncgtgtgggaacttgtactgggcactccaccgctactccgacaagcacgactgcaagttcn

SEQ ID NO: 18228 - DNA, 673 bp, Zea mays
  misc_feature: Ceres CLONE 1384143-F
  misc_feature: Encodes the peptide sequence at SEQ ID NO. 18229
agagctggagctcaccgcggtggcggccgctctataactagtggatcccccgggctgcaggaattcgcacgagaccattacctagaacatcctaatcgaaaaaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggttcgagaaggaggctgctgaaatgaacaagcggtccttcaagtacgcgtgggtgctcgacaagctcaaggctgagcgtgagagaggtatcaccattgatatcgctctgtggaagtttgagaccacccagtactactgcacggtcattgatgcccctggacaccgtgacttcatcaagaacatgatcactggtacctcccaggctgactgtgctgtccttatcattgactccaccactggtggttttgagggtggaatctccagggatggccagacccgggacatgctctcctggcgtcacccttggagtgaacaaatgatttgctgctggaacaaaatggatggaaccacttccaatactccaagggacggtatgaaa

SEQ ID NO: 18229 - protein, 167 aa, Zea mays
  misc_feature: Ceres CLONE 1384143-F
  misc_feature (5)..(167): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTQYYCTVIDAPGHRDFIKNMITGTSQADCAVLIIDSTTGGFEGGISRDGQTRDMLSWRHPWSEQMICCWNKMDGTTSNTPRDGMK

SEQ ID NO: 18230 - DNA, 703 bp, Zea mays
  misc_feature: Ceres CLONE 1384152-F
  misc_feature: Encodes the peptide sequence at SEQ ID NO. 18231
  misc_feature (314)..(314): n is a, c, t, g, unknown, or other
  misc_feature (315)..(315): n is a, c, t, g, unknown, or other
  misc_feature (365)..(365): n is a, c, t, g, unknown, or other
aaagctggagctccccgcggtggcggccgctctagaactagtggatcccccgggctgcaggaattcgcacgagaccattacctagaacatcctaatcgaaaaatctatccacctttccaccgtcaccatggccaccgccactacgtccgcctatcattgcaacgccgtcctctaccttcccagacctccgcagttccgccggatcctgccccctctcccctccctcgtcacccgcagagccgcgagcgtcgggctgagggtcgcccgtctcgggtcgagggcgagggcaagggcaaggtccgtaccgccaccgnncacatttttggaaccgtgcaggaggaggaggaggaggaggaggatcctgnttgctcgaaggggaggcgggattcaggggacaagcaaaggaataacagggaggggtcggcgtaaacggcccggaaacgggaaaaaacctgggcccgaaccccgcaaggaccttaaagggggggggtcggtaagggccccccccccccgaaaaatttttcgggggaacccccccgcgcccgtggggaacccaaaaaaacttttctaatttttttccccccccggggccccttctttctcgttgggaattcccccggggggcggccgccccgaaaataacccgggaaaagttttttgggggagagaggtttttttcaaaaaaaagcccgcgggggctcta

SEQ ID NO: 18231 - protein, 147 aa, Zea mays
  misc_feature: Ceres CLONE 1384152-F
  misc_feature (63)..(63): Xaa is any aa, unknown, or other
  misc_feature (80)..(80): Xaa is any aa, unknown, or other
MATATTSAYHCNAVLYLPRPPQFRRILPPLPSLVTRRAASVGLRVARLGSRARARARSVPPPXTFLEPCRRRRRRRRILXARRGGGIQGTSKGITGRGRRKRPGNGKKPGPEPRKDLKGGGSVRAPPPRKIFRGNPPAPVGNPKKLF

SEQ ID NO: 18232 - DNA, 649 bp, Zea mays
  misc_feature: Ceres CLONE 1384153-F
  misc_feature (218)..(218): n is a, c, t, g, unknown, or other
  misc_feature (223)..(223): n is a, c, t, g, unknown, or other
  misc_feature (303)..(303): n is a, c, t, g, unknown, or other
aaagctggagctccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactaggctagcctagccttttagtcgtcgaagaagagcaagaagggcgcncacgncagcaggcaagcaagaagagaggcgatcgaccgagagctagcccgcgatggccaagtcttcccagatgatggtggggggnaactctgcttggcctttggccctgggcgggtccaattgcccaggggggggacatcccaaaccccccccacccgaaaaaaagggccgcgccggggggtggaaccgaaaaaaattttcccccttttaaacccccctccggggggggggggcccccccccggtttttggggcccccccccgggggagaatttcctggaaagaaaaatttcccccggtttaacaagtgccccccggggggggaaaaacccaacccccggttttttttttcccgcccgggagagaaaattccccccctttttggggggggggcccccccgccttttttaaggtttttttgggggagtcccc

SEQ ID NO: 18233 - DNA, 671 bp, Zea mays
  misc_feature: Ceres CLONE 1384154-F
  misc_feature: Encodes the peptide sequence at SEQ ID NO. 18234
  misc_feature (362)..(362): n is a, c, t, g, unknown, or other
agagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcgncaggtgcagacgcacgcgtacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgcacgagatcaagtcaggcctgtggacgagcccgcacgtggcggggctgctggagaaggcggagctggaccacatgcgccgcacgttcgggaagttctggtgccactgggaggtggaccgcggggacggcctggcgctg

SEQ ID NO: 18234 - protein, 172 aa, Zea mays
  misc_feature: Ceres CLONE 1384154-F
  misc_feature (26)..(172): Pfam Name: DUF1264 Pfam Description: Protein of unknown function (DUF1264)
MASSDGKPLPTPASVGGGGGSSTAPPGQPTTVASKVLDMGAAAMQSLRPVKQAKQHMCTFALYAHDPKRQVQTHAYVSRLNQDFLQCAVYDSDKADARLIGVEYIVSRKIFDSLPAEEQRLWHSHAHEIKSGLWTSPHVAGLLEKAELDHMRRTFGKFWCHWEVDRGDGLAL

SEQ ID NO: 18235 - DNA, 622 bp, Zea mays
  misc_feature: Ceres CLONE 1384158-F
  misc_feature: Translation starting site: 166
  misc_feature (304)..(304): n is a, c, t, g, unknown, or other
  misc_feature (346)..(346): n is a, c, t, g, unknown, or other
aagctggagctccccgcggtggcggccgctctagaactagtggatcccccgggctgcaggaattcacacgagaccattacctagaacatcctaatcgaaaaatttttcgaccgccgccgcccccagtccccgatccgaagctgtgcctcgtaccatttcgatccaatggcgccgacgtcgaagctgtcgacgggcatcaagcgcgcttcgcggtcgcacacgtaccatcgaggtgggctgtgggccatcaaggccaagaacggcggcgccttccccaaggccgacaaggccgccgccgccgtgnaacccaagttctaccctgccgacgacgtcaagccccgcgttnccagcacccgcaagcctaagcctaccaagctcggggtcgagcatcacgcctgggacggtgctgatcctcctcgcagggcgcttcatggggaagagagtggtgtttctcaagcagctcaagtctggcctgctccttatctctggggctttcaagatcagtggagtacggatccgccgtgtggaccagacctatgtcattgctacatcaaccaaagttgacatctctgggggttgatgtgcccaaggtttgatgacaagtactttgccggggagaaga

SEQ ID NO: 18236 - DNA, 735 bp, Zea mays
  misc_feature: Ceres CLONE 1384164-F
  misc_feature: Encodes the peptide sequence at SEQ ID NO. 18237
  misc_feature (620)..(620): n is a, c, t, g, unknown, or other
ggagctccccgcggtggcggccgctctagaactagtggatcccccgggctgcaggaattcgcacgagaccattacctagaacatcctaatcgaaaaaataaaagtgaaattccattaccttgctgtctcggtctgtcggccatcgccggttgcgcagcgggcagcggctcacgtcgacggggaagactccggaggccacgggcgttacattctcctgccgtatttttgcgggattgaagtgacagccagggatccactcatcccctgggtggaaaaattcaggttgtggattggattgctagctaccgaacaagccctcagcgtgctaatttcagtggaatcttggtagacaccactgaacttcttggtttccaattaagttcgagcatagagatcgtcttctctcacactgagttgccagtttattccgaaggtccttcaagctaagttctgatgatggctaaggccaatggagcagtccatgcatccacgaaggaacccttgttttcttttggtgtccgagctgatgttcagtatgctgatatcccagatggtcgctcattgcctcggtgtcccaagatactaccgccatagcatcactgtccctccaaagggccgtncacaggtggaacgaacagggcacatcaagttctcaatcaattttggtgacattattgatggctactgcccaaaggacaatcatttgtgggcggtgcagaaagtccttgatgaatt

SEQ ID NO: 18237 - protein, 88 aa, Zea mays
  misc_feature: Ceres CLONE 1384164-F
  misc_feature (51)..(51): Xaa is any aa, unknown, or other
MEQSMHPRRNPCFLLVSELMFSMLISQMVAHCLGVPRYYRHSITVPPKGRXQVERTGHIKFSINFGDIIDGYCPKDNHLWAVQKVLDE

SEQ ID NO: 18238 - DNA, 682 bp, Zea mays
  misc_feature: Ceres CLONE 1384166-F
  misc_feature: Encodes the peptide sequence at SEQ ID NO. 18239
  misc_feature (404)..(404): n is a, c, t, g, unknown, or other
  misc_feature (443)..(443): n is a, c, t, g, unknown, or other
  misc_feature (444)..(444): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatggnagagcgagtgccgcgagcggcaccagcaagctgacgcgnncgaggacggcgacagcggcgtggacgcctacgtctccgctcggaaagggggcgaagtgccggcgccagtgcctgcgccgccacgagggccaggccgtggaggaaccaggagggcaatgagggcgtgcccgccgccgccggactggccgtcgacatggagccaaagagtacggtcgcggcagccagggcgcgggcagtggccccggggagaggtgcgagcgccccacccgcgggggact

SEQ ID NO: 18239 - protein, 156 aa, Zea mays
  misc_feature: Ceres CLONE 1384166-F
  misc_feature (64)..(64): Xaa is any aa, unknown, or other
  misc_feature (77)..(77): Xaa is any aa, unknown, or other
MGKGSVGASWWAFLLLAGVLLVVAATAGAEDGVVERDRKEDLRWCKQACEWQYGKDTPRKREWXSECRERHQQADAXEDGDSGVDAYVSARKGGEVPAPVPAPPRGPGRGGTRRAMRACPPPPDWPSTWSQRVRSRQPGRGQWPRGEVRAPHPRGT

SEQ ID NO: 18240 - DNA, 739 bp, Zea mays
  misc_feature: Ceres CLONE 1384167-F
  misc_feature: Translation starting site: 310
  misc_feature (393)..(393): n is a, c, t, g, unknown, or other
  misc_feature (663)..(663): n is a, c, t, g, unknown, or other
aaagctggagctccccgcggtggcggccgctctagaactagtggatcccccgggctgcaggaattcgcacgagaccattacctagaacatcctaatcgaaaagtctccaacccgactctgaaatccacgagctcttccccctcgtccacaccccgcccctccctgctctccgcctccccgtccccgcccccatcgctacccacaagcaccttcggaggctccaggcaacccacctcctgcacccggcgtccctcgcggcggcgacgcgcgaacgtcccgctccccggtgagtaacggagagacggagccatgagcggaggggtggagccggataccccgcccggtagcagcagcagcagcagcaggagcgggggcagcacgcccgtgggcggnaagccgccacgccaccacctcacgtccatccgccactgcgccagcagtgcccgcatcgccgctgcctccgccgaattcgtaagcaagctcgctgccacccaagccatctatccctaacacgaatttgatgtctgcccttctgttctcctgcaggggctggagtcggggacgctcagcttgatttcacctaccgcagacatccgtccgggcttcttggctgtgttcagggtcgggaagtttcgcggatattggacccaaatccttcatggnagacgagcatgtctgtgtggacaacctcgtcgagcaccttggactccgtggcccggcatccctgcaccggtggctt

SEQ ID NO: 18241 - DNA, 676 bp, Zea mays
  misc_feature: Ceres CLONE 1384169-F
  misc_feature: Translation starting site: 227
  misc_feature: SWISSPROT Homolog: EC 2.4.1.207 Xyloglucan:xyloglucosyl transferase
  misc_feature (364)..(364): n is a, c, t, g, unknown, or other
  misc_feature (365)..(365): n is a, c, t, g, unknown, or other
aaagctggagctccccgcggtggcggccgctctagaactagtggatcccccgggctgcaggaattcgcacgagaccattacctagaacatcctaatcgaaaaaagttccatatccaacacacacagcaacgctcgctcgacactgtcactagctagttgctctactagagggcgggtatagagctgcctgcaatccgccgctgagaagggaggatcggaagcgacgatgaggtcgtttgctcctgtctttctgtcggcggtcgtggcctggctggagctggcgggcaccgcgcagggcggcaacttctaccaggacacagagatgacctggggcgatggccgcggcaaggtagtggacggcggnncgcggctggacctgacgctgggacgcacgtccggctccgggttccagtccaagagcgagtacctgttcgggaggatcgacatgcagatcaggctgtggcagggcactcccgtggcacggtcacacctttctacctggcgtcccagggcgacgcgcacgacgagatcgacttcggagtcctgggcaacgggagcggggagccctacccgctgcacaccaacgggttcacgcggggacaggccaggggaaacaccatttcccccttgggttaaacttaccagtggcttccaaccaattccttcgtggggaccc

SEQ ID NO: 18242 - DNA, 648 bp, Zea mays
  misc_feature: Ceres CLONE 1384170-F
  misc_feature: Encodes the peptide sequence at SEQ ID NO. 18243
  misc_feature (355)..(355): n is a, c, t, g, unknown, or other
  misc_feature (360)..(360): n is a, c, t, g, unknown, or other
  misc_feature (361)..(361): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (618)..(618): n is a, c, t, g, unknown, or other
agagctggagctccccgcggtggcggccgctctagaactagtggatcccccgggctgcaggaattcgcacgagaccattacctagaacatcctaatcgaaaatctcacggcttcgcttcagtgtcttcacgggccgccggcggagatgcggttcacggcgtctccggtggtggagcttccggtcagcggcgcggtgttgactttcgagcaggacaacgactccttcgaggtgggcacctctgtgtggccctcgtccctggtcctcgtcaagttcgtcgagcgctgcatccgcgacccggccctcccctttgccgacgtgctccgcttcccgggaacccgggccgtggagctcggntccgnntncnnaccgggaagatgggggctctcccgcctcggcctcaccgatctcgtcctcaccgacatcgccgccgtgctcccggcgctccgccgcaacctgcggcgcaaccgagtccacctcgcgcgcgggccccgcctcggccaggtccactggaactgccccgcgcatctcgcgacgctagccaccccgcgccgcttcgatctcgtcgtcgccgcagacgtggtctacctgcaggagtccgtgccgcacctcatcgcggncatggatgcgctcgcccacgccgagcgggg

SEQ ID NO: 18243 - protein, 167 aa, Zea mays
  misc_feature: Ceres CLONE 1384170-F
  misc_feature (72)..(72): Xaa is any aa, unknown, or other
  misc_feature (73)..(73): Xaa is any aa, unknown, or other
  misc_feature (74)..(74): Xaa is any aa, unknown, or other
  misc_feature (158)..(158): Xaa is any aa, unknown, or other
MRFTASPVVELPVSGAVLTFEQDNDSFEVGTSVWPSSLVLVKFVERCIRDPALPFADVLRFPGTRAVELGSXXXPGRWGLSRLGLTDLVLTDIAAVLPALRRNLRRNRVHLARGPRLGQVHWNCPAHLATLATPRRFDLVVAADVVYLQESVPHLIAXMDALAHAER

SEQ ID NO: 18244 - DNA, 629 bp, Zea mays
  misc_feature: Ceres CLONE 1384176-F
  misc_feature: Translation starting site: 149
  misc_feature: SWISSPROT Homolog: EC 2.5.1.47 Cysteine synthase
  misc_feature: SWISSPROT Homolog: EC 4.2.1.22 Cystathionine beta-synthase
gagggaattcgcacgagaccattacctagaacatcctaatcgaaaaatctccagcggcttcttccaaaggctccaactccgacgagaaccgccactcctcgaaatctcgaaggattttctgcggcgaaccccttcgtgacgtgacccaatgggagaggcctcgccgtcgatcgccaaggacgtcaccgagttgatcgggaacacgccgctggtgtacctcaacaaggtgaccgatgggtgcgtcgggcgcgtcgccgccaagctcgagtccatggagccctgctccagcgtcaaggataggattggctacggcatgatcacgggggggggaggagaaagggctgattactccaggcgtgagtgttctgattgaaccaactagcggcaacacaggcattgggactggcctttatggctggtgccaagggctacaaacttacactcacaatgcctgcctccctgagcatggagaggaggatcatagtggagggcttttgggggctgacttggccttactgacccactcttgggagtgaaaggagctgtcaggaaagcggaagagatacaaggaaagacacccagctcgtacattcttcgaaatttgaaaatccggctagcccaaggatgcc

SEQ ID NO: 18245 - DNA, 690 bp, Zea mays
  misc_feature: Ceres CLONE 1384179-F
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
aaagctggagctccccgcggtggcggccgctctagaactagtggatcccccgggctgcaggaattcgcacgagaccattacctagaacatcctaatcgaaaaacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgatggagcagggactgggagagaggagaagagagggtgaaagggggcaagaaaacgcttcttgttgcctttgtgcttcagcggatccgcggtggctgcgcacgccgcngnnaaagaaggagtcgcgggcggcgcgcctccagtctttttttcgcctccgtgctctccgggctcttcggccaggcggagggccgaggacgaggacgaggacgaagagatgcccacgcgcaaccacacggctgccgcggctgccgctccgcacatccctcacaagaccggggggggtgctcccgctctgggaagaaaccagggcccgggccgggcccgagctgatggcattgaaccgcgagccccccctcgggggatatgggaaaccttcgtcagggtcgcgcccaggccaaa

SEQ ID NO: 18246 - DNA, 744 bp, Zea mays
  misc_feature: Ceres CLONE 1384182-F
  misc_feature: Encodes the peptide sequence at SEQ ID NO. 18247
  misc_feature (390)..(390): n is a, c, t, g, unknown, or other
  misc_feature (552)..(552): n is a, c, t, g, unknown, or other
  misc_feature (559)..(559): n is a, c, t, g, unknown, or other
  misc_feature (592)..(592): n is a, c, t, g, unknown, or other
  misc_feature (599)..(599): n is a, c, t, g, unknown, or other
  misc_feature (619)..(619): n is a, c, t, g, unknown, or other
  misc_feature (688)..(688): n is a, c, t, g, unknown, or other
  misc_feature (689)..(689): n is a, c, t, g, unknown, or other
  misc_feature (697)..(697): n is a, c, t, g, unknown, or other
  misc_feature (739)..(739): n is a, c, t, g, unknown, or other
  misc_feature (744)..(744): n is a, c, t, g, unknown, or other
ggagctccccgcggtggcggccgctctagaactagtggatcccccgggctgcaggaattcgcacgagaccattacctagaacatcctaatcgaaaagaaccactttatgtgctgacacagtcgccggcgaaaagtctcatctcaccgccactcgattccgtgccctgaagtcctccgacatttctctctcttctccgagaagatttcgactggcgatgggagacgagaagccgacggtggtgatggccaatcgagaaagagatctggagcttctgatgcccgttgctgataaagaggaaggttctacttcgaagccgtcttcctcttcctcttcgcatcatcaggctagccacgagactttaagcttgttcataaggggttgggcctcanagaagttcatgactggctgtgttatcctccttcccattgcgattacattttatataacatggtggtttattcactttgttgatggtttcttctctcccatttatgctcaacttggaatcaacattttttggtttcgggttcttgacttcatccgcatcatcnttcttgngtcggggtgttcatgtcctcaatggtggggggnctcggtnctgacccgggggggagtggnttatcaagcgggatgccattttgttcgtcacatcttacaacgcttccaagcaattaagcactggccttnntcctccgnagttagataaccaagcttttagcaggaggtgcatcatccagncatcn

SEQ ID NO: 18247 - protein, 163 aa, Zea mays
  misc_feature: Ceres CLONE 1384182-F
  misc_feature (59)..(59): Xaa is any aa, unknown, or other
  misc_feature (113)..(113): Xaa is any aa, unknown, or other
  misc_feature (115)..(115): Xaa is any aa, unknown, or other
  misc_feature (126)..(126): Xaa is any aa, unknown, or other
  misc_feature (135)..(135): Xaa is any aa, unknown, or other
  misc_feature (158)..(158): Xaa is any aa, unknown, or other
  misc_feature (161)..(161): Xaa is any aa, unknown, or other
MGDEKPTVVMANRERDLELLMPVADKEEGSTSKPSSSSSSHHQASHETLSLFIRGWASXKFMTGCVILLPIAITFYITWWFIHFVDGFFSPIYAQLGINIFWFRVLDFIRIIXLXSGCSCPQWWGXSVLTRGGVXYQAGCHFVRHILQRFQAIKHWPXSSXVR

SEQ ID NO: 18248 - DNA, 688 bp, Zea mays
  misc_feature: Ceres CLONE 1384186-F
  misc_feature: Encodes the peptide sequence at SEQ ID NO. 18249
  misc_feature (362)..(362): n is a, c, t, g, unknown, or other
aaagctggagctccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcgacgatgcagtcgttgcgccccgtgaagcaggcgaagcagcacatgtgcacgttcgcgctgtacgcgcacgacccgaagcgncaggtggagacgcaccactacgtctcccgcctcaaccaggacttcctccagtgcgccgtctatgactccgacaaagccgacgcgcgtctcatcggcgtggagtacatcgtgtcgaggaagatcttcgactcgctgccggcggaggagcagcggctgtggcactcgcacgcgcacgaaatcaagtcaggcctgtggacgagcccgcacggtgccggggctgctggagaagggggagctggaccacatggccgcaccgttcgggaaggtctgttccaccctggcagggggacggcggcgaccggctggcggctgggccccccggggtt

SEQ ID NO: 18249 - protein, 177 aa, Zea mays
  misc_feature: Ceres CLONE 1384186-F
  misc_feature (26)..(162): Pfam Name: DUF1264 Pfam Description: Protein of unknown function (DUF1264)
MASSDGKPLPTPASVGGGGGSSTAPPGQPTTVASKVLDMGAATMQSLRPVKQAKQHMCTFALYAHDPKRQVETHHYVSRLNQDFLQCAVYDSDKADARLIGVEYIVSRKIFDSLPAEEQRLWHSHAHEIKSGLWTSPHGAGAAGEGGAGPHGRTVREGLFHPGRGTAATGWRLGPPG

SEQ ID NO: 18250 - DNA, 692 bp, Zea mays
  misc_feature: Ceres CLONE 1384190-F
  misc_feature: Translation starting site: 231
  misc_feature (443)..(443): n is a, c, t, g, unknown, or other
  misc_feature (515)..(515): n is a, c, t, g, unknown, or other
  misc_feature (556)..(556): n is a, c, t, g, unknown, or other
  misc_feature (557)..(557): n is a, c, t, g, unknown, or other
  misc_feature (621)..(621): n is a, c, t, g, unknown, or other
aaagctggagctccccgcggtggcggccgctctagaactagtggatcccccgggctgcaggaattcgcacgagaccattacctagaacatcctaatcgaaaactcccgcccgatacatttctcgtacatcgctctcgctctcgctctctctcctgctgtccacgaccgaccaaaggcgccgggcacagactcttcgtcggatccaagagaagctcgcgccctccccgaccatggtctcggcggataccatccgtacggctatcggcgtcatcggcaatggcaccgcccttgtgctcttcctctccccggtgcccaccttcgtgggcatctggaagaagcgtgcggtggagcagtactcgccgatcccgtacgtggcgacgctgctgaactgcatgatggtgggtgctgtacgggctgccgctggtgcacccgcacagcatgcntggtggtgaccatcaacggcaccggcatgctcatccagctcacctacgtggcgctcttctctctgtcccccngggggggggggggggccccacagggtccgtgctcctgtccnncccgcgaggtccgccttcgtcgtcgccttgggccggggctggtgctcacccctggcgcacacgncacgagcgcaggtccatgctcggtcggcatcggtctccgtcttcttcggcacccggaatgtacgctgcgcc

SEQ ID NO: 18251 - DNA, 740 bp, Zea mays
  misc_feature: Ceres CLONE 1384192-F
  misc_feature: Encodes the peptide sequence at SEQ ID NO. 18252
  misc_feature (449)..(449): n is a, c, t, g, unknown, or other
  misc_feature (521)..(521): n is a, c, t, g, unknown, or other
  misc_feature (551)..(551): n is a, c, t, g, unknown, or other
  misc_feature (725)..(725): n is a, c, t, g, unknown, or other
tggagctccccgcggtggcggccgctctagaactagtggatcccccgggctgcaggaattcgcacgagaccattacctagaacatcctaatcgaaaaccccggcccggtccggcctaaacacgcattcttccttctcccaacgacggaagaaacttcctgcctggatatccatccatccaaccgctcctccctcgtccggcaggcgacgactcgattccttcctcccttcctcctcctcgtctctttcatcggcgactccgatcttctctgccgtcgccgccgccgccaagagatcgacccgaccccgagcgcccgacccgaccccccaatccaaccaccaaccgccggcgcgcgcggaagattcagatttggcccctcgccggtaagggagaaagcgaggatgggtgcgtggatgtcgcgcgtgtggttcctcatggtcccagcgcgnaagtacaagctcgtcgttgtggggctcgacaacgcgggggagaccaccacgctctacaagctccacctcggngaggccgtcaccgcccgcgcccacatcggnagcaacgttgaggaggtcgtcttcagaaactgcgcttcgaggtctgggatctaagagggcaagaaagcctgcgcacttcgtgggcgacgtactaccgggaacacacgccgtgatcgtggtgatcgacagcacggaccgggcccggatcacatcatcaaggaccagctgttccgnttgctgcagacgcga

SEQ ID NO: 18252 - protein, 67 aa, Zea mays
  misc_feature: Ceres CLONE 1384192-F
MGAWMSRVWFLMVPARKYKLVVVGLDNAGETTTLYKLHLGEAVTARAHIGSNVEEVVFRNCASRSGI

SEQ ID NO: 18253 - DNA, 736 bp, Zea mays
  misc_feature: Ceres CLONE 1384196-F
  misc_feature: Translation starting site: 241
  misc_feature: SWISSPROT Homolog: EC 4.4.1.5 Lactoylglutathione lyase
  misc_feature (357)..(357): n is a, c, t, g, unknown, or other
  misc_feature (396)..(396): n is a, c, t, g, unknown, or other
  misc_feature (537)..(537): n is a, c, t, g, unknown, or other
aagctggagctccccgcggtggcggccgctctagaactagtggatcccccgggctgcaggaattcgcacgagaccattacctagaacatcctaatcgaaaaaccggaggaaggaagcgagaagaccagaaggtgagaagagagagagagagtgtgtgtgatcggtacaaggatcaccgctgtgcctgcgcgtgctgcttcaccgaatcgagtcagatcctgtccgaatccgagctaagggatggcaaccggtagtgaagcctcgaaggcagctgaggctgtggttgactggcataaacacgacagcaagaggatgctccatgcggtttaccgtgttggggatctggaccgcacaatncagtactacacggaatgctttgggatgaaactgctgagnaaaagggatgttcctgatgagaagtacaccaatgccttccttggctttggccagagaaacaccactttgcaggtgaattgacatacaactatggcgttgacaagtatgacattgggaacgggctttgggcatttcgcattngctaatgatgatgtgtaccagttagctgagatatcaaatccaggggtggtagatcacccgcgaacctgggtctggtcaaggagggatccactgttattgctttcccacaggatcctgatggctacttggttgagcttatccggagggctgacccacctgagcctctttgccaggccatggtttcgtggttggggacttt

SEQ ID NO: 18254 - DNA, 683 bp, Zea mays
  misc_feature: Ceres CLONE 1384199-F
agagctggagctccccgcggtggcggccgctctagaactagtggatcccccgggctgcaggaattcgcacgagaccattacctagaacatcctaatcgaaaaagtcatttgtcattatctgtctctctccactgagattcaacacgttatcagcactttgctctccaccgagcggttaccgtcgacagcaatgtccatgcatccgtgcatccggcgtctgtcggacgaaaagcgattcaaagacaagttcatggagacgctgcttatgtatggctacagaggctagtacatgtctaatggttggacgctggacaacaacccgacaccactggaaggagatgatctcgctgtagtctgtcagcttgaccacaaggggttgatctctactcatcaacagttgcaccacagcatctgtatcggcattaagcgggactgcgtggccatggcgccgccctacgactcctaggcatgcacgaacctgctgctgaccggcaacaagctgcagtcgttccactcgactactagctgcgttgaaactctgctactaatgtgcgacaacgacaactacgcatgcagccagcctatctgatgtctaccccccggcagattcgttccggtcaaccagctgacagagattgaactcctcctgccttattaccggcagaagcggactactaccattg

SEQ ID NO: 18255 - DNA, 731 bp, Zea mays
  misc_feature: Ceres CLONE 1384200-F
  misc_feature: Encodes the peptide sequence at SEQ ID NO. 18256
  misc_feature (490)..(490): n is a, c, t, g, unknown, or other
  misc_feature (522)..(522): n is a, c, t, g, unknown, or other
  misc_feature (563)..(563): n is a, c, t, g, unknown, or other
  misc_feature (676)..(676): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtggacgcctacgtctcccgctccggnaggggcgagtgccggcgccagtgcctgcgccngcacgagggccagccgtgggagacccaggaatgcatgaggncgtgccgccgccgcggactggccgtcgacatggagcaagagtacggtcgcggcagcgagagcgcgggcagtgcccgggagaggtgcgagcgccaccaccgcgggactggtggnagagcagcctgcttgtgaaaaaaaaannnnnnnnggggggggggaaagaagggcg

SEQ ID NO: 18256 - protein, 159 aa, Zea mays
  misc_feature: Ceres CLONE 1384200-F
  misc_feature (103)..(103): Xaa is any aa, unknown, or other
  misc_feature (117)..(117): Xaa is any aa, unknown, or other
MGKGSVGASWWAFLLLAGVLLVVAATAGAEDGVVERDRKEDLRWCKQACEWQYGKDTPRKRECESECRERHQQADAGEDGDSGVDAYVSRSGRGECRRQCLRXHEGQPWETQECMRXCRRRGLAVDMEQEYGRGSESAGSARERCERHHRGTGGRAACL

SEQ ID NO: 18257 - DNA, 704 bp, Zea mays
  misc_feature: Ceres CLONE 1384201-F
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (253)..(253): n is a, c, t, g, unknown, or other
  misc_feature (257)..(257): n is a, c, t, g, unknown, or other
  misc_feature (258)..(258): n is a, c, t, g, unknown, or other
  misc_feature (263)..(263): n is a, c, t, g, unknown, or other
  misc_feature (265)..(265): n is a, c, t, g, unknown, or other
  misc_feature (266)..(266): n is a, c, t, g, unknown, or other
  misc_feature (269)..(269): n is a, c, t, g, unknown, or other
  misc_feature (271)..(271): n is a, c, t, g, unknown, or other
  misc_feature (276)..(276): n is a, c, t, g, unknown, or other
  misc_feature (281)..(281): n is a, c, t, g, unknown, or other
  misc_feature (282)..(282): n is a, c, t, g, unknown, or other
  misc_feature (284)..(284): n is a, c, t, g, unknown, or other
  misc_feature (309)..(309): n is a, c, t, g, unknown, or other
  misc_feature (310)..(310): n is a, c, t, g, unknown, or other
  misc_feature (313)..(313): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (331)..(331): n is a, c, t, g, unknown, or other
  misc_feature (332)..(332): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (353)..(353): n is a, c, t, g, unknown, or other
  misc_feature (355)..(355): n is a, c, t, g, unknown, or other
  misc_feature (356)..(356): n is a, c, t, g, unknown, or other
  misc_feature (360)..(360): n is a, c, t, g, unknown, or other
  misc_feature (394)..(394): n is a, c, t, g, unknown, or other
  misc_feature (396)..(396): n is a, c, t, g, unknown, or other
  misc_feature (398)..(398): n is a, c, t, g, unknown, or other
  misc_feature (406)..(406): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (513)..(513): n is a, c, t, g, unknown, or other
  misc_feature (520)..(520): n is a, c, t, g, unknown, or other
  misc_feature (521)..(521): n is a, c, t, g, unknown, or other
  misc_feature (534)..(534): n is a, c, t, g, unknown, or other
  misc_feature (586)..(586): n is a, c, t, g, unknown, or other
  misc_feature (612)..(612): n is a, c, t, g, unknown, or other
  misc_feature (615)..(615): n is a, c, t, g, unknown, or other
  misc_feature (616)..(616): n is a, c, t, g, unknown, or other
  misc_feature (695)..(695): n is a, c, t, g, unknown, or other
  misc_feature (699)..(699): n is a, c, t, g, unknown, or other
aaagctggagctccccgcggtggcggccgctctagaactagtggatcccccgggctgcaggaattcgcacgagaccattacctagaacatcctaatcgaaaagaggtggagagatcgcacgcgccctctgccgcttgttcgttcctcgcgcttgccaccaggcaccaccacacacatcccaatctcgcgaggcggcgaggcagcacagagggtcctcgggcggcgnnnnnnnnnnttccnnntccccttcccnttgnnctccncnntgncnctccncctcnncncttccttctcttcctctctcctccnntcnccctccccctcccnnntnncccccccnnnnnctctttccncnncccnttcctccccccccccggggggggggggggggccncncnttcctccntttcccccccccctgggttccggccgggcgggggcgcgccgtggtgggtttccggggggggcgggggnnnttttccggcccctgggcggggccggggttttggcccncccttcnnctcgccgcttttnccccttccccctggggccggccggggcgggggggggggtcccccgtttcccncggttccggggggggtgggggggggnctnnccccgccccggggggttgctggggggggggtcccgggggggctctctgtgggggggggggggggggcgccttctgtggnggtngcgca

SEQ ID NO: 18258 - DNA, 670 bp, Zea mays
  misc_feature: Ceres CLONE 1384202-F
  misc_feature: Encodes the peptide sequence at SEQ ID NO. 18259
  misc_feature (235)..(235): n is a, c, t, g, unknown, or other
  misc_feature (526)..(526): n is a, c, t, g, unknown, or other
  misc_feature (567)..(567): n is a, c, t, g, unknown, or other
  misc_feature (568)..(568): n is a, c, t, g, unknown, or other
aaagctggagctccccgcggtggcggccgctctagaactagtggatcccccgggctgcaggaattcgcacgagaccattacctagaacatcctaatcgaaaaaacgagccaggaccctgttgtgatgctaccgtcgccgccggtgctactacgcccttgcgctgcccgggcctccccgcttccgccccctagacctagagctgcaaatcctaacaccgagtcggcgacgacgacnaccgccgccacttcagcggacagagcggccaccatgggcgcggcagcgtggtggcggcgcgccctggggcagcggttcaacccagccggtgtggccgcggtggcggccgtcgcggcgtccaagccgcgcctggcgctgccgcacgtgtcggtgcaagacatcaggtggctcgactgggctgagctccgccgcgccggttcccgcgggcgtcgttttcgacaaggacaacacgctcacggccccctacgcgcccgcgctctggccgccgctcgctgcagcatttgaccaggncccgtgcgacgttccccgcccggtgcgctcgccatctacgnnactccccgcagggttgacggagtatgatccccgaacggggggggatggcgaggccaatcgagctgtcctttcgggggggggtttcatgtggatcaggcatga

SEQ ID NO: 18259 - protein, 83 aa, Zea mays
  misc_feature: Ceres CLONE 1384202-F
MGAAAWWRRALGQRFNPAGVAAVAAVAASKPRLALPHVSVQDIRWLDWAELRRAGSRGRRFRQGQHAHGPLRARALAAARCSI

SEQ ID NO: 18260 - DNA, 635 bp, Zea mays
  misc_feature: Ceres CLONE 1384203-F
  misc_feature: Encodes the peptide sequence at SEQ ID NO. 18261
  misc_feature (351)..(351): n is a, c, t, g, unknown, or other
  misc_feature (388)..(388): n is a, c, t, g, unknown, or other
aaagtggagctccccgcggtggcggccgctctagaacagtggatcccccgggctgcaggaattcgcacgagaccattacctagaacatcctaatcgaaaacttttcctagggtgttcgtcgcttccagccgccgccgcgtccgcctcgccagcgcagcagccgcccagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacacccgcggggcgctactcccnagaagcggttcccccaggcggagggggcccgatcggntgagcgcctttacaaactcccctcatggatgcacgggcgcaacaaccgcaagaaggggcatggggtgtccgcatcatcaagcaaaccccggaaaaacatttccccgggtccccgaagcgcaccccattccggggtgggggtcaaaccgattattccaacgggggccccccgggaggaaggccccccccaattgggtccccccctggaattgtgaaaaaaaaccagcccccggaaaatcccccccccg

SEQ ID NO: 18261 - protein, 147 aa, Zea mays
  misc_feature: Ceres CLONE 1384203-F
  misc_feature (66)..(66): Xaa is any aa, unknown, or other
MAEVEQQQDTPKLFNRWTFDDVQVNDISLNDYLAVNATKHAMYLPHTRGALLPRSGSPRRRGPDRXSAFTNSPHGCTGATTARRGMGCPHHQANPGKTFPRVPEAHPIPGWGSNRLFQRGPPGRKAPPNWVPPWNCEKKPAPGKSPP

SEQ ID NO: 18262 - DNA, 716 bp, Zea mays
  misc_feature: Ceres CLONE 1384206-F
  misc_feature: Translation starting site: 132
  misc_feature: Pfam Name: Hist_deacetyl Pfam Description: Histone deacetylase domain
  misc_feature (413)..(413): n is a, c, t, g, unknown, or other
  misc_feature (476)..(476): n is a, c, t, g, unknown, or other
  misc_feature (571)..(571): n is a, c, t, g, unknown, or other
  misc_feature (572)..(572): n is a, c, t, g, unknown, or other
tggagctccccgcggtggcggccgctctagaactagtggatcccccgggctgcaggaattcgcacgagaccattacctagaacatcctaatcgaaaaatcttcgtgaggaccttcaaccatctcaggcggaatggcggcttctggtgagggcgcgtcgctgccgtctccggcgggcggggaggatgcgcaccgccgccgcgtcagctatttctacgagccgtcgatcggagactactactacgggcaaggtcacccgatgaagccccaccgcatccgaatggcgcactcgctggtggtccactacggcctccaccgcctcctcgagctctcccgcccctacccggcctctgaggccgacatccgccgcttccactccgacgactacgtcgccttcctcgcgtccgccaccggnaaacccgggtgtcctcgacccgcgcgccattaagcgctttaacgtcggtgaggactgccccgntgttcgacggtctcttccccttctgccaggcctccggctgggggaagcatccggcgccgccgtcaagcttacccgcggggacgccgacatcacgnncaattggggggggcgggctccacacgccaggagaggggggggcctccgggttctgctacgtcaacgacatcgtcctcgccatcctcgagctcctcaggtcccacaggcgtggggtatatggaaaacattgatgtcaccagggga

SEQ ID NO: 18263 - DNA, 680 bp, Zea mays
  misc_feature: Ceres CLONE 1384207-F
  misc_feature (344)..(344): n is a, c, t, g, unknown, or other
  misc_feature (347)..(347): n is a, c, t, g, unknown, or other
  misc_feature (359)..(359): n is a, c, t, g, unknown, or other
  misc_feature (392)..(392): n is a, c, t, g, unknown, or other
  misc_feature (394)..(394): n is a, c, t, g, unknown, or other
  misc_feature (425)..(425): n is a, c, t, g, unknown, or other
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcggcggcgtgctggtggtcgtaacaaccacggccggggcggaggacggagtggtcaaacgggaccgcaaggaggacctggcgntgntgcaaacaagcntgccaatgccaatacggaggggaggcccggggnanaaggaatgccaaagacgagtgccccaaacgncaccaacaggcttaagcgggccgaagaacgcgaacggcggggtggacggcttacgtctcccgctccggaagggggggaggggccgcccccagggcctggccccccccaaggggccagccgggggaaaacccagaagggcttggggggggggccccccccggggaattggccgttcactggaacaaaaaagaacggtcgcggcaacgaaggggcgggaaggggcccgggagaagttgcaagggcccacccgggggn

SEQ ID NO: 18264 - DNA, 669 bp, Zea mays
  misc_feature: Ceres CLONE 1384213-F
  misc_feature: Encodes the peptide sequence at SEQ ID NO. 18265
  misc_feature (50)..(50): n is a, c, t, g, unknown, or other
  misc_feature (174)..(174): n is a, c, t, g, unknown, or other
  misc_feature (290)..(290): n is a, c, t, g, unknown, or other
  misc_feature (307)..(307): n is a, c, t, g, unknown, or other
  misc_feature (336)..(336): n is a, c, t, g, unknown, or other
  misc_feature (397)..(397): n is a, c, t, g, unknown, or other
  misc_feature (420)..(420): n is a, c, t, g, unknown, or other
aagctggagtccccgcggtggcggccgctctagaactagtggatcccccngggctgcaggaattcgcacgagaccatacctagaacatcctaatcgaaaactcaagtcaagtgtgtcacggggtccatcctctcgagagtctaggcccttctcccgaagccgcagacgcagaanacggctctacatatggaggcgaagaagaagccgtcggcccccgccgccgtcggagccgcgccgccgccgccgggtaacgggtacttcagcaccgtcttctccgcgccgactgcggnaagcgcaagtgacgcanagcatgcggacttgtacacgatgctgaancagcagagcttcagagggcagaatggcagagatggcaaatcccgcgggcggcctacttacnaggatggcaaacatgctcatccnatggggcatcaggattctctttacttggggtcacccgggaatacggggggcgggggttctacgggaggggttttcgggaggcacccggccagggacccccatagggttaaaagggggggaacaaccgggtgggtttttccaacaaagggggggtggggggggggggggtcccctttttttagggagaaagggggggggggaaccctctccctttttttggaaaggggaaaaaaaaaggggggggggggg

SEQ ID NO: 18265 - protein, 161 aa, Zea mays
  misc_feature: Ceres CLONE 1384213-F
  misc_feature (35)..(35): Xaa is any aa, unknown, or other
  misc_feature (41)..(41): Xaa is any aa, unknown, or other
  misc_feature (50)..(50): Xaa is any aa, unknown, or other
  misc_feature (71)..(71): Xaa is any aa, unknown, or other
MEAKKKPSAPAAVGAAPPPPGNGYFSTVFSAPTAXSASDAXHADLYTMLXQQSFRGQNGRDGKSRGRPTYXDGKHAHPMGHQDSLYLGSPGNTGGGGSTGGVFGRHPARDPHRVKRGGTTGWVFPTKGGWGGGGSPFFREKGGGGTLSLFLERGKKKGGGG

SEQ ID NO: 18266 - DNA, 542 bp, Zea mays
  misc_feature: Ceres CLONE 1384214-F
  misc_feature: Encodes the peptide sequence at SEQ ID NO. 18267
aaagctggagctccccgcggtggcggccgctctagaactagtggatcccccgggctgcaggaattcgcacgagaccattacctagaacatcctaatcgaaaaacgtttgcatctctaaccacctgcgctgcgctcgcgtctctcgtccccctcagatccaccgactcgctctgagtctctgaccgccccttccgtcgtccccgttcgaaggcgcggcaagcgagcgattcagccagattcgattcgacatgaatcccgagtacgactaccttttcaaacttctgcttattggtgattctggtgttgggaaatcatggcttgcttctcagatttggcgatgatcatatttggacggctacatcaacacaatggggtgattttaaattcggacgtaaagcagatggaaaacataaactcaaattgggatctgctggcagagggctcaggacatcctaacgctacaccggggagtccgggatcttattggttttacgggcaaaccagaaggttccataagggggaacaagggtgaaagggaattg

SEQ ID NO: 18267 - protein, 30 aa, Zea mays
  misc_feature: Ceres CLONE 1384214-F
MNPEYDYLFKLLLIGDSGVGKSWLASQIWR

SEQ ID NO: 18268 - DNA, 615 bp, Zea mays
  misc_feature: Ceres CLONE 1384216-F
  misc_feature: Encodes the peptide sequence at SEQ ID NO. 18269
  misc_feature (298)..(298): n is a, c, t, g, unknown, or other
  misc_feature (299)..(299): n is a, c, t, g, unknown, or other
  misc_feature (302)..(302): n is a, c, t, g, unknown, or other
  misc_feature (304)..(304): n is a, c, t, g, unknown, or other
  misc_feature (305)..(305): n is a, c, t, g, unknown, or other
  misc_feature (312)..(312): n is a, c, t, g, unknown, or other
  misc_feature (318)..(318): n is a, c, t, g, unknown, or other
  misc_feature (319)..(319): n is a, c, t, g, unknown, or other
  misc_feature (321)..(321): n is a, c, t, g, unknown, or other
  misc_feature (322)..(322): n is a, c, t, g, unknown, or other
  misc_feature (393)..(393): n is a, c, t, g, unknown, or other
  misc_feature (464)..(464): n is a, c, t, g, unknown, or other
  misc_feature (465)..(465): n is a, c, t, g, unknown, or other
  misc_feature (498)..(498): n is a, c, t, g, unknown, or other
aaagctggagctccccgcggtggcggccgctctagaactagtggatcccccgggctgcaggaattcgcacgagaccattacctagaacatcctaatcgaaaaactcccccacaccacactcgagagccatctcccagcacacgagcgcgatggcttccaccaccaccaccaccttcctcgccatcttgctagtcgtggcagcttcggcggcgccggcacggtcctgctcaccgcgcgacatccacgcgctgctgagcgtgaagcaggcgctgggcaaccccggcgtcgctgtcgaccnnttngnnaaaacgncccggnncnntcgcccactgctgcgcgtgggaccacctcgatgcacgacgcgggcggtgaacacgtctcatcgacgggcgnacgagtgcgcgccaaatcccgtcgcgtgggcggctgacggactcatgccctgaccctgtcgggctgcgggnntgagggggcatcccggctggctcaggggggtgncaaccctcaggtcctcccatttccaaaacaaagtggcccggggccatccccgaatccctgggggggggttggccccccccaaaccccggggaccttgcccaaaaaccggggtgaggg

SEQ ID NO: 18269 - protein, 98 aa, Zea mays
  misc_feature: Ceres CLONE 1384216-F
  misc_feature (50)..(50): Xaa is any aa, unknown, or other
  misc_feature (51)..(51): Xaa is any aa, unknown, or other
  misc_feature (52)..(52): Xaa is any aa, unknown, or other
  misc_feature (55)..(55): Xaa is any aa, unknown, or other
  misc_feature (57)..(57): Xaa is any aa, unknown, or other
  misc_feature (58)..(58): Xaa is any aa, unknown, or other
  misc_feature (82)..(82): Xaa is any aa, unknown, or other
MASTTTTTFLAILLVVAASAAPARSCSPRDIHALLSVKQALGNPGVAVDXXXKTXRXXRPLLRVGPPRCTTRAVNTSHRRAXECAPNPVAWAADGLMP

SEQ ID NO: 18270 - DNA, 673 bp, Zea mays
  misc_feature: Ceres CLONE 1384217-F
  misc_feature: Encodes the peptide sequence at SEQ ID NO. 18271
agagctggagctccccgcggtggcggccgctctagaactagtggatcccccgggctgcaggaattcgcacgagaccattacctagaacatcctaatcgaaaactcacaaaaccctcgccagcttatcccccttccctccctcacacgatctctcctcgacggctaacccggattgccgtctcaggctcgggatccgggcgctcgcggcgatggacggcggcggcggcgctggcggcgcggagggggagctcacggcgcaggagacagcgctctacgaccgccagatccgcgtctggggcgtcgatgcccagaagagttctgcaagaatattgttctagctggagttggaagtttatccttgatggatgataatgtaggcgcagaggaggatctgaatgcaaatttcttaattcctcctgatgagagcatatatggtggtagatctcgagcccaagtttgctgcgagtctttgatagatttcaatcctatggttagagtttctgttgaaaagggtgatccatcattaagtgatggagaattccttgacaagttcgacattgttgtacttaggcggggatctcttaaaacaaagttgttgattaatgaaaactggcgaaagagaagcaaaaatatggcattttatactataggatggcagggattcatgggggga

SEQ ID NO: 18271 - protein, 104 aa, Zea mays
  misc_feature: Ceres CLONE 1384217-F
MDDNVGAEEDLNANFLIPPDESIYGGRSRAQVCCESLIDFNPMVRVSVEKGDPSLSDGEFLDKFDIVVLRRGSLKTKLLINENWRKRSKNMAFYTIGWQGFMGG

SEQ ID NO: 18272 - DNA, 746 bp, Zea mays
  misc_feature: Ceres CLONE 1384218-F
  misc_feature: Encodes the peptide sequence at SEQ ID NO. 18273
  misc_feature (730)..(730): n is a, c, t, g, unknown, or other
catagctggagctccccgcggtggcggccgctctagaactagtggatcccccgggctgcaggaattcgcacgagaaccattacctagaacatcctaatcgaaaaagcagcacagtcatccacactaacgaacgaactgaggtcgacgacgactgatcgagcagcgacgatggcggctgtgctgaacagcaggaagacgccgcaggtggttgccgtgctggtggcggcggcgctgctggcgtcgtccgcttcggcggcgatcacctgcgggcaggtggggtcgtcgctggctccgtgcatcccgtacgcgacggggagggccagcgcgctccccgcgtcgtgctgcagcggcgtcaagagcctcaacagcgcggcgcggaccagcgcggaccgccaggcggcgtgccgctgcctcaagagcctcgccaacagcgtcaagagcgtcaacatgggcaccgtcgccaccatccccggcaagtgcggcgtctccgtcggattccccatcagcatgtccaccgactggcaacagatcagctaagttatacgacgaccaagctaataagcctaccgaacgtacacgtacgtcccgcgcgctgcacgagtgatgaagccagggaagaataaataaagctagctgtattggcagagcagcatgcagtatcgatctatatatatactgtactgtagactctataatatatgaatgggggccctgcaggggagttgcttcnatccacctacttgttc

SEQ ID NO: 18273 - protein, 122 aa, Zea mays
  misc_feature: Ceres CLONE 1384218-F
  misc_feature (33)..(118): Pfam Name: Tryp_alpha_amyl Pfam Description: Protease inhibitor/seed storage/LTP family
MAAVLNSRKTPQVVAVLVAAALLASSASAAITCGQVGSSLAPCIPYATGRASALPASCCSGVKSLNSAARTSADRQAACRCLKSLANSVKSVNMGTVATIPGKCGVSVGFPISMSTDWQQIS

SEQ ID NO: 18274 - DNA, 776 bp, Zea mays
  misc_feature: Ceres CLONE 1384219-F
  misc_feature: Encodes the peptide sequence at SEQ ID NO. 18275
  misc_feature (371)..(371): n is a, c, t, g, unknown, or other
  misc_feature (408)..(408): n is a, c, t, g, unknown, or other
  misc_feature (417)..(417): n is a, c, t, g, unknown, or other
  misc_feature (426)..(426): n is a, c, t, g, unknown, or other
  misc_feature (683)..(683): n is a, c, t, g, unknown, or other
  misc_feature (684)..(684): n is a, c, t, g, unknown, or other
aagctggagctccccgcggtggcggccgctctagaactagtggatcccccgggctgcaggaattcgcacgagaccattacctagaacatcctaatcgaaaatcatgcagcagcgaacaacacaaattaagtagtggagtgtcagaacttgggaggcacaaattaagtacaaagcagtctaattaatgacgggcccgatggagattccggtgatcgatctcggcggcctcaacggcggcggcgaggagaggtcgcggaccttggcggagctccacgacgcctgcaaggactggggcttcttctgggtggagaaccacggcgtggacgcgccgctgatggacgaggtcaagcgcttcgtctacggccactacnaggagcacctgggagggcaagtctacgcctccgcccntcgcatggnactcgaggncgcaaccagagggtgacatgatgaagcctcccccaaagaggggggcctggggagttcaacttaatttatcccggaaccaccccaagaacaaagggcgccaaatttcccaagaaatcacgcccgcccaaaccgaaaaaccctttgaccgctaacctcccgcaaaagggtggcctccccggggagggtttgggccaaagggaaagaccctaacgggggcgctcccgggggggacacagggcgcccctttttttttgggnnttttttgggggaccaaaaatttccctttaccccccttgcccgccccaccacaaagagttgggggggcgcgcccccgccaaccccccgcccgc

SEQ ID NO: 18275 - protein, 81 aa, Zea mays
  misc_feature: Ceres CLONE 1384219-F
  misc_feature: SWISSPROT Homolog: EC 1.14.17.4 Aminocyclopropanecarboxylate oxidase
  misc_feature (59)..(59): Xaa is any aa, unknown, or other
  misc_feature (71)..(71): Xaa is any aa, unknown, or other
  misc_feature (74)..(74): Xaa is any aa, unknown, or other
  misc_feature (77)..(77): Xaa is any aa, unknown, or other
MEIPVIDLGGLNGGGEERSRTLAELHDACKDWGFFWVENHGVDAPLMDEVKRFVYGHYXEHLGGQVYASAXRMXLEXATRG

SEQ ID NO: 18276 - DNA, 692 bp, Zea mays
  misc_feature: Ceres CLONE 1384222-F
  misc_feature: Encodes the peptide sequence at SEQ ID NO. 18277
  misc_feature (388)..(388): n is a, c, t, g, unknown, or other
aaagctggagctccccgcggtggcggccgctctagaactagtggatcccccgggctgcaggaattcgcacgagaccattacctagaacatcctaatcaaaaaaaaaaagtcttcacttccattccaccggctccgatcccaactgccatggcgctctccatctacacgcccacctcctcctccctcgtcccgccctccattcaggaggtcaggctgacttcgcgaccgccaaagcccgcgactttcagcctacggaggccacatctggccgcgcgggccgccgctggcaacgcacccacgtccccggtccgcgaggtcgtcactgagctcgacgcggtcgccggcttcagcgagatcgtgccggacaccgtcgggggggatgatttcnagaggttcgcacccacgacgggcacagtgagctcgtcgctgctgctggggatcactgggctcccagacactaaggtcaagagtgcgatagatactgcactggaagatgggggagggcaagcactggaaaaggctgaggaaaaggatgtcctggttacctccccagggctcttgcaaatggttgggccttaactgggttcaacacaggccccggggaaaatttccaacggaaaaagaaggcccggttagtttatgaacccccggggcaaaaacccccagggaaactgagacgtgtgaaacccaaa

SEQ ID NO: 18277 - protein, 143 aa, Zea mays
  misc_feature: Ceres CLONE 1384222-F
  misc_feature (81)..(81): Xaa is any aa, unknown, or other
MALSIYTPTSSSLVPPSIQEVRLTSRPPKPATFSLRRPHLAARAAAGNAPTSPVREVVTELDAVAGFSEIVPDTVGGDDFXRFAPTTGTVSSSLLLGITGLPDTKVKSAIDTALEDGGGQALEKAEEKDVLVTSPGLLQMVGP

SEQ ID NO: 18278 - DNA, 680 bp, Zea mays
  misc_feature: Ceres CLONE 1384223-F
  misc_feature (680)..(680): n is a, c, t, g, unknown, or other
aaagctggagctccccgcggtggcggccgctctagaactagtggatcccccgggctgcaggaattcgcacgagaccattacctagaacatcctaatcgaaaaatttacctgtagagaaatttgctattttgccactctcaattgtggttgcctgttattataccatcccgagtctatgactagtggcaccgtctgtgtctatgatttacgggctcgatggtatattggcgaagcccacaactgatcatggaaaaattgccaatgctctaggccagtgactctcattgcacttggacgataggccagtgactctcattgcacttggagggtacgctgacttaccatctccccaagagtacgctgaacttaccatctccccaagggtgagagaacacttcataatttcacatacacagggaataatttgatgagagactctcattgcacttggcgggtacattgacttaccatctcccttgtgttacagtggacgtcataatttgttaccatctccccatgggtgagagtgagagtcccttttttgttttacacttaacatctcctctagcgcgacagagcccctccataatgagtgttacagagcccctaatttggtgttagaagcgcgttagctcctcgggcaataggaataaataaaatttttagtctgactaaactan

SEQ ID NO: 18279 - DNA, 682 bp, Zea mays
  misc_feature: Ceres CLONE 1384225-F
  misc_feature: Encodes the peptide sequence at SEQ ID NO. 18280
agagctggagctccccgcggtggcggccgctctagaactagtggatcccccgggctgcaggaattcgcacgagaccattacctagaacatcctaatcgaaaaaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaggggccgcatttacccggcgatcctgcccgttgagagcaagagagttgctgggagggttatcatgggtgggaggtggggaggagctccagcttcttgacgcgtttgaagacgtggagtacacgaggacaagaggtgagatatcattggctgactcttccgagaacatgctggctgacacttacgtgtgggagtgatgcagaggatctcaatctttatggaggatggaactttgaggggatatgacttgtttcctggagccctgggggggtaatggtatgggattatcatggtacgggggtcctatcagaatgggggactctatcggttactgcgcgtcttcgggatctaaaatttctggttcgacgaccgcacaagtga

SEQ ID NO: 18280 - protein, 86 aa, Zea mays
  misc_feature: Ceres CLONE 1384225-F
MAMKPAAAAPPTPAAAHSVFVYGSLMADEVVRTILKRVPPAAPALLPNYHRFNIRGRIYPAILPVESKRVAGRVIMGGRWGGAPAS

SEQ ID NO: 18281 - DNA, 709 bp, Zea mays
  misc_feature: Ceres CLONE 1384227-F
  misc_feature: Encodes the peptide sequence at SEQ ID NO. 18282
  misc_feature (159)..(159): n is a, c, t, g, unknown, or other
aaagctggagctccccgcggtggcggccgctctagaactagtggatcccccgggctgcaggaattcgcacgagaccattacctagaacatcctaatcgaaaactacactgagaaccgcagagacaggcgtcttcgtactcgcctatctccgcgactcanagctttccccaattcccccccttctcccatttctcaccaccgccgccgctccccccgttcaacaacaccatgagggagtgcatctcgatccacatcggccaggctggtatccaggtcggaaacgcgtgctgggagctgtactgcctcgagcatggcattcagggctgatggccagatgcccggtgacaagacattggggggaggtgataatgctttcagcgcgttctcagggaaacgggggcttggaaacacggcccccccggttgtttttgtgagccttgagccccttggctgcgggggggggggaatgggcctaaccgcgggtttttcttccgggaagttccccggggggggggggggggggcccaaaatttccccggggggccacaaaacccttggaaaggagaattttcacctttgccctttccccccttaagagatttggaaaaaaattgggggggggcccccaggggtctcccctcctttaaaaaattttgggggggagaaaaacccccctcgggtgtttttcttccctcctgcgggggggggg

SEQ ID NO: 18282 - protein, 32 aa, Zea mays
  misc_feature: Ceres CLONE 1384227-F
MRECISIHIGQAGIQVGNACWELYCLEHGIQG

SEQ ID NO: 18283 - DNA, 723 bp, Zea mays
  misc_feature: Ceres CLONE 1384228-F
  misc_feature: Encodes the peptide sequence at SEQ ID NO. 18284
  misc_feature (569)..(569): n is a, c, t, g, unknown, or other
  misc_feature (595)..(595): n is a, c, t, g, unknown, or other
tggagctccccgcggtggcggccgctctagaactagtggatcccccgggctgcaggaattcgcacgagaccattacctagaacatcctaatcgaaaagggaaaatcataggttctccacgacgcggccatctccgccaccgccagcgccacctgctagggtcaacacccgctctctgcggactgcgtgaagcaccagcggcggccaccgggcaggacgagccccctccccaaacagagaggggcggggatcagtgcgtgcgctcctggtggagggcgtggaagagcttggcaggcggcaagcaggggtttgggaggatggtttcgctctcgacttggttccgctatgccgcacaaaagttcgagtactgcgtttccctctcgttgaaaaatataatgacgtgggccggatcagcagcacacagctaactgatgtgttaaacaaaaatttattccaaggcaagctcacctacgtgtgtccgaccaaaggggaagaagccatggctcccatcgcatctcccactggaggagccgtccttgtcagaaaactcgcaaatttgagccccacgcnagtgtttgtccggggacgttgtgttngtaaaagaccagaggaatctgatgatttaattattcgacgactggctgcctttgaaggctatgagatggtctctaatgatgagaaggattgagccgttggtgcttgagaagaaccaatgctgggtcct

SEQ ID NO: 18284 - protein, 62 aa, Zea mays
  misc_feature: Ceres CLONE 1384228-F
  misc_feature (24)..(24): Xaa is any aa, unknown, or other
  misc_feature (33)..(33): Xaa is any aa, unknown, or other
MAPIASPTGGAVLVRKLANLSPTXVFVRGRCVXKRPEESDDLIIRRLAAFEGYEMVSNDEKD

SEQ ID NO: 18285 - DNA, 730 bp, Zea mays
  misc_feature: Ceres CLONE 1384234-F
  misc_feature: Encodes the peptide sequence at SEQ ID NO. 18286
  misc_feature (466)..(466): n is a, c, t, g, unknown, or other
  misc_feature (606)..(606): n is a, c, t, g, unknown, or other
aaagctggagctccccgcggtggcggccgctctagaactagtggatcccccggtgtgcaggaattcgcacgagaccattacctagaacatcctaatcgaaaactctgtctctctagggtttttgattttaatccgccgccgactgctcatctcacatccctcgaagaagacgcctgtctactcagccgatcgaataacacatcatccagtgcttctcctgaccaaccactgtgccgtggtggcagcagttgtagtggcgatctgcttcgtcgtcctcgccgccgccctcccttcgcatgcgtcgacgtcggtggacgagccggcgaagtataagcccagcagggcgccagcgccgtcccctgcatctgcatcatcatcctacgtcccgccgccggtccagcccgtgatcgtcgtccagggcgtcatctaatgcaagtcctgcaagctcaggggctacaacagcggnatgggacgcgtcccctctccccaatgcgacagagaagtctggtgtgctacggcgacgcggagagcaaagtactgggtgctgaaccagacgagcacggccaccgacacgaacggctacttcatcgtgatgggtgtacgacngtgggcatgttcgaccgccgcagctgcaggctgtactcgcccccccccccccgagggggttcgggcgcgcgctcttcttcccgtcgaacgccgagatggggtcacactcaagggaggacacgag

SEQ ID NO: 18286 - protein, 88 aa, Zea mays
  misc_feature: Ceres CLONE 1384234-F
  misc_feature (47)..(47): Xaa is any aa, unknown, or other
MGRVPSPQCDREVWCATATRRAKYWVLNQTSTATDTNGYFIVMGVRXWACSTAAAAGCTRPPPPEGVRARALLPVERRDGVTLKGGHE

SEQ ID NO: 18287 - DNA, 782 bp, Zea mays
  misc_feature: Ceres CLONE 1384235-F
  misc_feature: Encodes the peptide sequence at SEQ ID NO. 18288
  misc_feature (324)..(324): n is a, c, t, g, unknown, or other
  misc_feature (326)..(326): n is a, c, t, g, unknown, or other
  misc_feature (329)..(329): n is a, c, t, g, unknown, or other
  misc_feature (331)..(331): n is a, c, t, g, unknown, or other
  misc_feature (379)..(379): n is a, c, t, g, unknown, or other
  misc_feature (455)..(455): n is a, c, t, g, unknown, or other
  misc_feature (487)..(487): n is a, c, t, g, unknown, or other
catagctggagctcaccgcggtggcggccgctttagaacttagtggaatcccccgggcttgcaggaattcgcacgagaccatttaacccaagaacattcctaatcgaaaaagcggcaactaacacgccagagagaagggaaggggaggttggccagaagagccgagagcagccctgcagtcgagagcatccgactgctagctactagcaatagcataggcagataagctcgggccgggccggggcacgcgcacaatgaggtcgcggcggtggcacagcgtggtcgccgtagcgcttggcagcgcgcgtgggtgtttgttgcgcngncgncncaagcgcaggcgcaggcgcagctgagccagagctacaacgcgtcgacntgccccgacgtggagacgctggtcccgcggcggcgtcacccagaagctgcaggagaccttcacggcggggccgggnagggtccgccttcttctccagcgatggtttcntaaggggctggaaacggtcccgtgttggttgtcgggcccccgaagaaagaaaaagggggggggggccaacccccgcgtttgcccccggaggggggttgaacgtggccccccgggcccaagggcccccgggggaccccaaccccggtggggacaaaaggggggggttgggggcaaaattttctccccttcggcgcgcgcgggaggtttttcccagaggggggggggccgaaaaaaaggggggagagtggggggggggtggaaaaaaaagtaaaaccccccccccccgggaaaaaac

SEQ ID NO: 18288 - protein, 33 aa, Zea mays
  misc_feature: Ceres CLONE 1384235-F
  misc_feature (24)..(24): Xaa is any aa, unknown, or other
  misc_feature (26)..(26): Xaa is any aa, unknown, or other
MRSRRWHSVVAVALGSARGCLLRXRXKRRRRRS

SEQ ID NO: 18289 - DNA, 744 bp, Zea mays
  misc_feature: Ceres CLONE 1384237-F
  misc_feature: Translation starting site: 241
  misc_feature: Pfam Name: CDC50 Pfam Description: LEM3 (ligand-effect modulator 3) family / CDC50 family
  misc_feature (517)..(517): n is a, c, t, g, unknown, or other
  misc_feature (580)..(580): n is a, c, t, g, unknown, or other
  misc_feature (599)..(599): n is a, c, t, g, unknown, or other
aagctggagctccccgcggtggcggccgctctagaactagtggatcccccgggctgcaggaattcgcacgagaccattacctagaacatcctaatcgaaaaaccagatctcgaggcagcggagtccggggacgccgttctttccgttgtgcttcctttgcctcttgctgccggtggccggtgattttcccgaggtctgtttgggcggcaggtagaggctattttcttggcggctggtgggatggatagccacgccgccgggtcgagctccggcgggtccggggatggcggcgcgcagcccaggaggagctccaggaaacccacgtattccaagtttactcagcaggagcttccagcttgcaagccgattcttactccaaaatgggttatttcagtattcgttcttgttggcgtgatttttgtctcgattggtattgtttcgctgcgagcttcacgacaggttgtcgagatcgttgatcggtatgatgatgcatgtgtcccctgctggtgtgactgancagcttgcttacatcgggaatgatagtataccaaaaagctggcacaggaatctgacgattacnaaggatatgaagcagcccnatttttgtgtattatcagctggatgacttttacagaatcattaggagtatgttcagagccgtaatgatgcaagctaaaagataaaggtaggggaggacttttcccaatgggatcctgaggcaaaacggagacgaaaaccattggg

SEQ ID NO: 18290 - DNA, 727 bp, Zea mays
  misc_feature: Ceres CLONE 1384240-F
  misc_feature: Encodes the peptide sequence at SEQ ID NO. 18291
  misc_feature (637)..(637): n is a, c, t, g, unknown, or other
  misc_feature (656)..(656): n is a, c, t, g, unknown, or other
  misc_feature (708)..(708): n is a, c, t, g, unknown, or other
ggagctccccgcggtggcggccgctctagaactagtggatcccccgggctgcaggaattcgcacgagaccattacctagaacatcctaatcgaaaacattcgcggtttgcctctctgcctgcctccctcagatcctccctaagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaggaggccttccgcgtgttcgacaaggaccagaacggcttcatctctgctgctgagcttcgacatgtcatgaccaacctaggtgagaagctgacggacgaggaggtggatgagatgattcgtgaaagcgacgtggacggtgatggccagatcaactacgaggaggtcgtgaaggtgatgatggcccagtgagatgatgtgcctgttttgagctagtcctctcttggtgntagtagctagtctagtgtngagactgactgcattggtcccgcttgtcctctcctcatcatggacatatccngttggttcctccagggatt

SEQ ID NO: 18291 - protein, 149 aa, Zea mays
  misc_feature: Ceres CLONE 1384240-F
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature (121)..(149): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIRESDVDGDGQINYEEVVKVMMAQ

SEQ ID NO: 18292 - DNA, 759 bp, Zea mays
  misc_feature: Ceres CLONE 1384241-F
  misc_feature (286)..(286): n is a, c, t, g, unknown, or other
  misc_feature (307)..(307): n is a, c, t, g, unknown, or other
  misc_feature (324)..(324): n is a, c, t, g, unknown, or other
  misc_feature (353)..(353): n is a, c, t, g, unknown, or other
  misc_feature (386)..(386): n is a, c, t, g, unknown, or other
  misc_feature (398)..(398): n is a, c, t, g, unknown, or other
  misc_feature (399)..(399): n is a, c, t, g, unknown, or other
  misc_feature (426)..(426): n is a, c, t, g, unknown, or other
  misc_feature (516)..(516): n is a, c, t, g, unknown, or other
aaagctggagctccccgcggtggcggccgctctagaactagtggatcccccgggctgcaggaattcgcacgagaccattacctaagaacatcctaatcgaaaagacaccggctaaccctagcttctgtttggctgttgcctggcgggtggcggctgctttggtgcgctgcgcagtgcactccgtccgtcgaccggccggccgtcccctggcccctgctcgtcgtcttcctcgggcgctcgtcttcctccgaacgcgcgcgggccgccgaactacttgttctcctgnaggagcgcgcccggcgggcangcgacgcagtccagcgncgggttgaggaagaaagcgagcgaccggngaatccccatccagccgtcccctgctcgtcttnctcgggtcgggnngtcgtcaccaattctttcctcaggccntcatttgatcaaccgtcgaccgtcccttgggtcggtttcttgggggtctggtgctccaagggtcggcccctggtggaggggtgtttcggncccggcggaacttggtggaaaatttgcccaaccccggggggttgggttcccggtccccttcggaacaaattttaagcccccggggggggaaaaggaaaaagggccccccatttttataagagggtggttttgggggccgggctgtgtttttttttctataggaaaacgaaaaaccctcccccctctccccgaaaaattttgtttaaaaaaaaaattcccccccgcgggaaaaaaaaatttttt

SEQ ID NO: 18293 - DNA, 782 bp, Zea mays
  misc_feature: Ceres CLONE 1384242-F
  misc_feature: Encodes the peptide sequence at SEQ ID NO. 18294
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
aaaacaccacccccacccaaaaaaagggggggcnncnnctcttagattggcccgagctggagctccaccgcggtggcggccgctctagaactagtggatcccccgggctgcaggaattcgcacgagaccattacctagaacatcctaatcgaaaagctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggccaaggagctggacggccgcaacatccccgtcaacgagggccagtccccgcggggggccgtggaaggcggcggcggccggccggttaccggcggggggcccgggggaggccagcggcctaacggcgagaggccgaggcgcccgatgatgggcgcccgacgtgttaaccgcgcttggcccggccggtataacggcggggggtacgcgggcttttaaagtgggggtgggtgggtcgggctgcttaaaatgtgttgggtcaaacccgggtggggggggtgtttacccgtaacccccctgagtggataagttgggagtggag

SEQ ID NO: 18294 - protein, 110 aa, Zea mays
  misc_feature: Ceres CLONE 1384242-F
  misc_feature (10)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGQGAGRPQHPRQRGPVPAGGRGRRRRPAGYRRGARGRPAA

SEQ ID NO: 18295 - DNA, 685 bp, Zea mays
  misc_feature: Ceres CLONE 1384243-F
  misc_feature: Encodes the peptide sequence at SEQ ID NO. 18296
  misc_feature (283)..(283): n is a, c, t, g, unknown, or other
  misc_feature (308)..(308): n is a, c, t, g, unknown, or other
  misc_feature (316)..(316): n is a, c, t, g, unknown, or other
  misc_feature (397)..(397): n is a, c, t, g, unknown, or other
  misc_feature (403)..(403): n is a, c, t, g, unknown, or other
  misc_feature (428)..(428): n is a, c, t, g, unknown, or other
  misc_feature (501)..(501): n is a, c, t, g, unknown, or other
  misc_feature (503)..(503): n is a, c, t, g, unknown, or other
aagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtancagccacggcccgggcggaggacgnagtggtcnaaacggacccgcaggaggacctgcggtggtgcaagcaggcgtgcgagtggcagtacggaaaggacaccccgcggaagaggnaatgcnagagcgagtgccgcgagcggcacancaagctgacgcgggcgaggacggcgacagcgcgtgggacgctacttctcccgctcccggaggggcgagtgccngngccagtgcctgcgccggccccagggccagccgggggaaaccaagaatgcatggaggggtgccccccccggggactggccgtcaactggaccaaaaaaccgcccgcggaacaaaagccgggcaaaggcccggaaaggggcaagcgccccacccccggaaaattgggaaaaacacccttcaggc

SEQ ID NO: 18296 - protein, 157 aa, Zea mays
  misc_feature: Ceres CLONE 1384243-F
  misc_feature (24)..(24): Xaa is any aa, unknown, or other
  misc_feature (32)..(32): Xaa is any aa, unknown, or other
  misc_feature (35)..(35): Xaa is any aa, unknown, or other
  misc_feature (62)..(62): Xaa is any aa, unknown, or other
  misc_feature (64)..(64): Xaa is any aa, unknown, or other
  misc_feature (72)..(72): Xaa is any aa, unknown, or other
  misc_feature (97)..(97): Xaa is any aa, unknown, or other
MGKGSVGASWWAFLLLAGVLLVVXATARAEDXVVXTDPQEDLRWCKQACEWQYGKDTPRKRXCXSECRERHXKLTRARTATARGTLLLPLPEGRVPXPVPAPAPGPAGGNQECMEGCPPRGLAVNWTKKPPAEQKPGKGPERGKRPTPGKLGKTPFR

SEQ ID NO: 18297 - DNA, 715 bp, Zea mays
  misc_feature: Ceres CLONE 1384244-F
  misc_feature: Encodes the peptide sequence at SEQ ID NO. 18298
  misc_feature (443)..(443): n is a, c, t, g, unknown, or other
  misc_feature (534)..(534): n is a, c, t, g, unknown, or other
  misc_feature (582)..(582): n is a, c, t, g, unknown, or other
  misc_feature (620)..(620): n is a, c, t, g, unknown, or other
  misc_feature (645)..(645): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaacgattagaaacggacgaccgagaccgcctgggcggatccgagttcggacggcccatccgcccatcagagcatcagacgaccaccttcctgcccccattcgtttccgcatcggcgtatctcccggcggcaaaggcgctctcctcccgacctccctgcggtgccggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgattacacaggagatgttgtgattccnagcttggagagtcataatgtccgtcagctttatccaaagggtcccaatattgacttcaagaaggagcttaggaccctcaacagagagcttncattgcatatttttggagctggcagatatattagttgagagacatctncatatgctcgtagggtagaagatattacgctcatattncagaacttacatcatcttctcattncctttacgactcatcaggcaagggccacattngatcacatggcttgagagcaaaattcgcgacgcaggaa

SEQ ID NO: 18298 - protein, 96 aa, Zea mays
  misc_feature: Ceres CLONE 1384244-F
  misc_feature (4)..(96): Pfam Name: MED7 Pfam Description: MED7 protein
  misc_feature (85)..(85): Xaa is any aa, unknown, or other
MAMATSASYPPPPPFYRLYKKFEQDPSSAPEPPPPIDEPFKALGVDYTGDVVIPSLESHNVRQLYPKGPNIDFKKELRTLNRELXLHIFGAGRYIS

SEQ ID NO: 18299 - DNA, 665 bp, Zea mays
  misc_feature: Ceres CLONE 1384245-F
  misc_feature: Encodes the peptide sequence at SEQ ID NO. 18300
cagagctggagctccccgcggtggcggccgctctagaactagtggatcccccgggctgcaggaattcgcacgagaccattacctagaacatcctaatcgaaaacttccgaaatctcgtgcggcggccggcaagttcgcacttcgcagcgcattcaccaccagcttcactcccaactaccgctgatctcactcacgctcaccccagccggccagccccgtccccatccggctagaggttcacatcacctgcgtgacgataaacatcctcttccaaatcgtagtctagcccgtgcccaaaaccctagcgaccgccggagagctcgtccgaatcgaggccaccgaggggaaattagatcgcggcggacgatggagagccctgcgaaagaggaggccgggggagagctggcaatggagatcgagtcgtcggtcacggcggaggactggcgccgcgcgctttctcgcgtcgtgccgtccgtcgtcgtcctccgcaccactgcgccgcgcgcctttgacaccgaggtcggggggcgcagctaccgcacgggtttcgtcgttgacaagtcccgcggcataatcctcactagccgcatgtcgtccaagcaggacctggggtcgcggaggccatgttcgtgaacagggaaaaaatccctgggtaccactgaaca

SEQ ID NO: 18300 - protein, 88 aa, Zea mays
  misc_feature: Ceres CLONE 1384245-F
MESPAKEEAGGELAMEIESSVTAEDWRRALSRVVPSVVVLRTTAPRAFDTEVGGRSYRTGFVVDKSRGIILTSRMSSKQDLGSRRPCS

SEQ ID NO: 18301 - DNA, 709 bp, Zea mays
  misc_feature: Ceres CLONE 1384247-F
  misc_feature: Encodes the peptide sequence at SEQ ID NO. 18302
  misc_feature (605)..(605): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
aaagctggagctccccgcggtggcggccgctctagaactagtggatcccccgggctgcaggaattcgcacgagaccattacctagaacatcctaatcgaaaacagccctcgtccaggcgcgcggccaccgcatcgagaccgtcccagagatgcccctggtcatctccgactcggcggagtccatcgagaagacctcccaggcgctaaagatcctcaagcaggtcggcgcctacgccgacgccgagaaggccaaggactccgtcggcatccgccccggcaagggtaagatgcgcaaccgccgctacattaaccgcaagggcccgctcgtcgtctacggcacagaaggctccaaggtcgtcaaggccttccgcaacctccccggcgtggacgtcgccaacgtcgagcgcctcaacctgctcgacctcgcccccggtggccacctcgggcgctttgtgatctggaccgagagcgcgttcaagaagctcgaggaggtgtatgggagctttgacgcgccgtcgcaaaagaagaagggcttttgtctgccgaggcccagatgggccacgctgacctgggcaggattatcactctgacgaggtgcagtctgntggtaagccactcacaggannnngagcgcagggagagaggaaaaaccgctcacgacatggctgctgtgctcagctgaaccctacctcggactgcccggagatgg

SEQ ID NO: 18302 - protein, 146 aa, Zea mays
  misc_feature: Ceres CLONE 1384247-F
  misc_feature (2)..(115): Pfam Name: Ribosomal_L4 Pfam Description: Ribosomal protein L4/L1 family
MPLVISDSAESIEKTSQALKILKQVGAYADAEKAKDSVGIRPGKGKMRNRRYINRKGPLVVYGTEGSKVVKAFRNLPGVDVANVERLNLLDLAPGGHLGRFVIWTESAFKKLEEVYGSFDAPSQKKKGFCLPRPRWATLTWAGLSL

SEQ ID NO: 18303 - DNA, 721 bp, Zea mays
  misc_feature: Ceres CLONE 1384248-F
  misc_feature: Encodes the peptide sequence at SEQ ID NO. 18304
  misc_feature (564)..(564): n is a, c, t, g, unknown, or other
  misc_feature (565)..(565): n is a, c, t, g, unknown, or other
  misc_feature (567)..(567): n is a, c, t, g, unknown, or other
  misc_feature (569)..(569): n is a, c, t, g, unknown, or other
  misc_feature (584)..(584): n is a, c, t, g, unknown, or other
caaagctggagctccccgcggtggcggccgctctagaactagtggatcccccgggctgcaggaattcgcacgagaccattacctagaacatcctaatcgaaaaaaaaccgccagacttcgcagtcctcctccactaccagagcatgcgcgttgcccccgcgacccgaaccgccgccgccgctcaccctccgagcgccttcctgctcctcctcggttgcgcgtccctcgcgatcggaggagcagccatggccggccacgtcctcggcggcgtgaaggagaacccagccgcggccaacagcgccgagtccgacgggctcggccgcttcgccgtcgacgagcacaacaggcgcgagaacgcgctgctggagttcgtgcgcgtggtggagccaagggagcaggtggtggccggcacgctgcaccacctcacgctcgaggccgtcgaaggccggaaggaagaagctctacgagggccaaggtctggggtcaagccatggctcgacttcaaggagctccaggaatcagccacaaggggggacgccaccgccttcaccaacgccgactcgnngncnagggaaggtgactgnagcctgtttggcgtgaggtccccgtaaagggatcctgtggtcaagatgctgcaacacatgctgtgaatcgttcccaagagagtccaactccctgtttcctaaaaattctcgagatcttcggccatgggcaagggggt

SEQ ID NO: 18304 - protein, 155 aa, Zea mays
  misc_feature: Ceres CLONE 1384248-F
  misc_feature (41)..(130): Pfam Name: Cystatin Pfam Description: Cystatin domain
  misc_feature (141)..(141): Xaa is any aa, unknown, or other
  misc_feature (142)..(142): Xaa is any aa, unknown, or other
  misc_feature (147)..(147): Xaa is any aa, unknown, or other
MRVAPATRTAAAAHPPSAFLLLLGCASLAIGGAAMAGHVLGGVKENPAAANSAESDGLGRFAVDEHNRRENALLEFVRVVEPREQVVAGTLHHLTLEAVEGRKEEALRGPRSGVKPWLDFKELQESATRGDATAFTNADSXXREGDXSLFGVRSP

SEQ ID NO: 18305 - DNA, 686 bp, Zea mays
  misc_feature: Ceres CLONE 1384249-F
  misc_feature: Encodes the peptide sequence at SEQ ID NO. 18306
  misc_feature (373)..(373): n is a, c, t, g, unknown, or other
  misc_feature (374)..(374): n is a, c, t, g, unknown, or other
  misc_feature (385)..(385): n is a, c, t, g, unknown, or other
  misc_feature (436)..(436): n is a, c, t, g, unknown, or other
  misc_feature (439)..(439): n is a, c, t, g, unknown, or other
  misc_feature (462)..(462): n is a, c, t, g, unknown, or other
  misc_feature (510)..(510): n is a, c, t, g, unknown, or other
  misc_feature (566)..(566): n is a, c, t, g, unknown, or other
aaagctggagctccccgcggtggcggccgctctagaactagtggatcccccgggctgcaggaattcgcacgagaccattacctagaacatcctaatcgaaaaaccgtagcacacaccagtacaccacacactcgcctttccgatcccatccctctccagccaccttcctccgctcgccgtgcttctgcttcctccgccaccaccgccggcatggctgcgcgctgcccctacttcgccgtcgaggagtcctcccgcggcatccgctcgggggagtccccggccgcggcgctccgccggatcctcgcgacgcctggtgcgcaccaggcgccctgctgctacgacgcgctcggcgcgcgcctcgtcgagcgcgcgnngtttccgatcnggttcatgggcggtttctgtggttctgccgcgcgacttggcttgcctgatngtngcctcatttcctatggagaaatntagatcaagggcgtctcatcaatgaagctgtttaaatccagtgatggnggatggagacatgggtacgaaactctatgatatccagagaacctaaaggaatatcnatgctgggttgctgaaatatgcttgaggacaggtgggactaaagcatgggacctactgaaggaagaaaggctttcaggggaggaagttgctgcaataaaactgcttgaaatctaggagaa

SEQ ID NO: 18306 - protein, 83 aa, Zea mays
  misc_feature: Ceres CLONE 1384249-F
  misc_feature: SWISSPROT Homolog: EC 2.7.8.23 Carboxyvinyl-carboxyphosphonate phosphorylmutase
  misc_feature (55)..(55): Xaa is any aa, unknown, or other
  misc_feature (59)..(59): Xaa is any aa, unknown, or other
  misc_feature (76)..(76): Xaa is any aa, unknown, or other
  misc_feature (77)..(77): Xaa is any aa, unknown, or other
MAARCPYFAVEESSRGIRSGESPAAALRRILATPGAHQAPCCYDALGARLVERAXFPIXFMGGFCGSAARLGLPDXXLISYGE

SEQ ID NO: 18307 - DNA, 714 bp, Zea mays
  misc_feature: Ceres CLONE 1384253-F
  misc_feature: Encodes the peptide sequence at SEQ ID NO. 18308
  misc_feature (566)..(566): n is a, c, t, g, unknown, or other
  misc_feature (703)..(703): n is a, c, t, g, unknown, or other
aagctggagctccccgcggtggcggccgctctagaactagtggatcccccgggctgcaggaattcgcacgagaccattacctagaacatcctaatctaaaaaatcagtaatcaccccaaatcctagggttctagtcgcttctcgtcgtttcgttcgtagatcacagagacaatggtgaaggcagttgctgtcctcgccggcactgatgtcaagggcaccatcttcttttcacaggaaggggatggtccgaccaccgtgactggaagtatctctggcctcaagccaggcctccatgggttccatgtgcacgcgcttggcgacaccaccaacggctgcatgtcgactgggccacacttcaatcctgttggcaaggagcatggtgcaccggaagatgaggaccgccatgccggtgatctggggaatgtgacagcgggagaagatggtgttgttaatgtcaatattactgacagccagatacctcttgctggaccccactcgatcattggccgagctgttgttgtccatgctgatccggatgaccttggcaaaggtggacatgagcttancaagagcaccggaatgctgggcgacgtgttgcctggtgtatcattgggctccagggctaaagcgttaaactccgaggcaacaccatagaagatcgaagcgagcactcaggatggttgctgtccatttcccctggatngggcacacatt

SEQ ID NO: 18308 - protein, 160 aa, Zea mays
  misc_feature: Ceres CLONE 1384253-F
  misc_feature (1)..(143): Pfam Name: Sod_Cu Pfam Description: Copper/zinc superoxide dismutase (SODC)
  misc_feature: SWISSPROT Homolog: EC 1.15.1.1 Superoxide dismutase
  misc_feature (132)..(132): Xaa is any aa, unknown, or other
MVKAVAVLAGTDVKGTIFFSQEGDGPTTVTGSISGLKPGLHGFHVHALGDTTNGCMSTGPHFNPVGKEHGAPEDEDRHAGDLGNVTAGEDGVVNVNITDSQIPLAGPHSIIGRAVVVHADPDDLGKGGHELXKSTGMLGDVLPGVSLGSRAKALNSEATP

SEQ ID NO: 18309 - DNA, 736 bp, Zea mays
  misc_feature: Ceres CLONE 1384257-F
  misc_feature: Translation starting site: 161
  misc_feature: Pfam Name: DUF241 Pfam Description: Arabidopsis protein of unknown function
  misc_feature (492)..(492): n is a, c, t, g, unknown, or other
aagctggagctccccgcggtggcggccgctctagaactagtggatcccccgggctgcaggaattcgcacgagaccattacctagaacatcctaatcgaaacagagaaagagagacgaacgcgcacgagctagctagctagctcgctcgatcggcagagtcatggcgcccagcttcgcccgctccatctccttcccactcagcccgtccaggtcatcaacgtcgtcgtcgggcaccaagccccgcgcggcggcggcctccaccgccgcggcgtaccacgcgcgctccgtcagcctgccgtgccgctcgcacccgatcctcgcgcacctccacgcgcacatcggcgccgtgcgcgcctgggcgcaggacccgccggccacctccgccctcggcgccgccgcgggcctggcgcgcgtggacgcgctccacggcgcgctcgccgacctgctcgggctccccgaggcgcgggccgcgctgtcgctctccgcaacggngaccgacctctggacgccttcctccgcctgggcgacgcgcacggcagcttccaggaggccgtggtggagctgaaacgggacgtggccgaggcgctggccgccgcgcgccgcccagacggtgggggcctcgcgtccgcgctcaggtcgcaacggaaggcccccaaggactcgcccggctccgccgcttgcgcggaatttgggggggggaggccctcgcgcctcggactctggctcgggggggggg

SEQ ID NO: 18310 - DNA, 675 bp, Zea mays
  misc_feature: Ceres CLONE 1384261-F
  misc_feature: Encodes the peptide sequence at SEQ ID NO. 18311
  misc_feature (310)..(310): n is a, c, t, g, unknown, or other
  misc_feature (330)..(330): n is a, c, t, g, unknown, or other
  misc_feature (394)..(394): n is a, c, t, g, unknown, or other
  misc_feature (414)..(414): n is a, c, t, g, unknown, or other
  misc_feature (423)..(423): n is a, c, t, g, unknown, or other
  misc_feature (445)..(445): n is a, c, t, g, unknown, or other
  misc_feature (451)..(451): n is a, c, t, g, unknown, or other
  misc_feature (465)..(465): n is a, c, t, g, unknown, or other
aagctggagctccccgcggtggcggccgctctagaactagtggatcccccgggctgcaggaattcgcacgagaccattacctagaacatcctaatcgaaaacacttcccgtgtttctaactccggtggctccaccaccagcaacccgtgcagcgagcccaccccgaccactgccatgtcgaggcgcggcgactgggtctacgagaacaacggcgggacctgcgtggccatcgccggcgccgattactgtgtcgtcgcggcggacacccgcctctctgtcggatacagcatcctcacgcgcgaccactctnagatctgcgacctgactgancaatgtgtactagcatcttctggctttcagggtgatattaaggctctgcacaaagaactagctngcagagaattgctataccancaccagcantacaaaggatgagctggcctgncatggnacagctcctctccnataccctgtatacaagcgcttcttcccattataccgcctccatggggtccggggggcttgaaggcaagggaaaagggggtgtttcccctataaggcagaaggttcctacaaaaaaactggttaagggcttcgggaaatgggattcttttgatattccggtcccggaaaatcaaataaaaatcccaaagtccctttttggcccctggggag

SEQ ID NO: 18311 - protein, 86 aa, Zea mays
  misc_feature: Ceres CLONE 1384261-F
  misc_feature: SWISSPROT Homolog: EC 3.4.25.1 Proteasome endopeptidase complex
  misc_feature (46)..(46): Xaa is any aa, unknown, or other
  misc_feature (52)..(52): Xaa is any aa, unknown, or other
  misc_feature (74)..(74): Xaa is any aa, unknown, or other
  misc_feature (80)..(80): Xaa is any aa, unknown, or other
  misc_feature (83)..(83): Xaa is any aa, unknown, or other
MSRRGDWVYENNGGTCVAIAGADYCVVAADTRLSVGYSILTRDHSXICDLTXQCVLASSGFQGDIKALHKELAXRELLYXHQXYKG

SEQ ID NO: 18312 - DNA, 625 bp, Zea mays
  misc_feature: Ceres CLONE 1384263-F
  misc_feature: Encodes the peptide sequence at SEQ ID NO. 18313
cgctctagaactagtggatcccccgggctgcaggaattcgcacgagaccattacctagaacatcctaatcgaaaaatcacgaaaccacgcgcagatccaaacgaacccgagcccttccaaaccctaagctcgcctcccctcccccccaaacaccaccgcgcacctatggcgaagtacggcgagggcgacaagcggtggatcgtggaggagcgcgccgacggcaccaacgtccacaactggcactgggcggagcgcgactgcctggagtggtcccgcgcgcggctctcttccctgctcgcgggcctcaccatcctcgacggcgagggcggcctcagtctccgcaccggtggggggtcgacaaggcttgatggcaaggcctacgtcaacatccgcaggggcaggggcatcccggggtacgagctctcgctccaccctctccctgggagggccaaggcccgccccggagcccggaacctgggaaaggtccccgggcccggttgagggtccctaccccccccgaaagaaaacccgcaagagggacccccaacctcccgggttaccgggggggggggggaaaaaaaaaccccctttgggttttccgggcaaagggaactcctttcttctc

SEQ ID NO: 18313 - protein, 111 aa, Zea mays
  misc_feature: Ceres CLONE 1384263-F
MAKYGEGDKRWIVEERADGTNVHNWHWAERDCLEWSRARLSSLLAGLTILDGEGGLSLRTGGGSTRLDGKAYVNIRRGRGIPGYELSLHPLPGRAKARPGARNLGKVPGPG

SEQ ID NO: 18314 - DNA, 681 bp, Zea mays
  misc_feature: Ceres CLONE 1384265-F
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
aaagctggagctccccgcggtggcggccgctctagaactagtggatcccccgggctgcaggaattcgcacgagaccattacctagaacatcctaatcgaaaaacacatattattgagaccaactagcaacatagaaagcacaatagtgtaccaacaatggcagccaaaatattttgcttccttatgctccttggtctttctgcaagtgctgctaccgcaaccattttcccacaatgctcacaagctcctatagcttcctttcttcccccatacctctcaccagcggtgtcttcagtatgtgaaaacccaattcttcaaccctacaggatccaacagggcatcgcagcaggcatcttacctttatcacccttgttcctccaacaaccgtcaggcctattacagnnnnnnttaccctttgggggggnnntttttggtggcacaaaaactcaagggacaaacaactacaaaaacctggtggtaagaaaaccttggttgccaaccctgagaagaggggaggtttcttccaattcaacccaactggggtgggattgaaacccctggctggtttattttccaaaaaaaaaatcaccctttctcagccagtttggtgttttgcgctaacccccaaaaaatttctttcccatttaaacccaattggggagaaatttgaaaacctgcctt

SEQ ID NO: 18315 - DNA, 568 bp, Zea mays
  misc_feature: Ceres CLONE 1384266-F
gctcaaaactagtggatcccccgggctgaggaattcgcacgagaccattacctagaacatcctaatcgaaaaacagcgccaagggcaccaccagcaaggaccaagacagagcacagcgcagctcgtcggcctctcgacgccggttgctgcaaccaccgccttttatttgccccacgcggggccgggcgggaagaaagcaagaaaaaaaccccccaaagggggaagggcgggccccggaaaaaaattccgggggggggggggggggggttcccgcggggttttcccggggggggggggcgcccggaacagcgaagggggattggtggagaggggccccccaggggggggggggaggggggggttccagaggggtgtggggccgcccccgcggggggggcgcgcgggggaagaaaaaagaaaaggtgcgcccggagaagaccctccagaaaaaagggggggggcgcgccgcccccccgcgcctcgaggcccggaagaggagaaaaaaaagggggggtcgttcccccccgaaaagagggggcccccgagggagggcccccccaaaaaaagg

SEQ ID NO: 18316 - DNA, 685 bp, Zea mays
  misc_feature: Ceres CLONE 1384267-F
  misc_feature: Encodes the peptide sequence at SEQ ID NO. 18317
  misc_feature (487)..(487): n is a, c, t, g, unknown, or other
  misc_feature (517)..(517): n is a, c, t, g, unknown, or other
aaagctggagctccccgcggtggcggccgctctagaactagtggatcccccgggctgcaggaattccacgagaccattacctagaacatcctaatcgaaaaatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaaggacacccgcggaagagggaatgcaagagcgagtgccgcgagcggcaccagcaggctgacgcgggcgaggacggcgacagcggcgtggacgcctacgtctcccgctccggnaggggcgagtgccggcgccagtgcctgggnccgcacgaggggcagccgggggaagaccccagagtggatgaggcgggggccgccgcggcggactggccctcgacatggagcaaaaatacggtcccggcaaacaagagccgcgggcagtgcccgggaaaagttgcaaggcccacaccccggggactggtgggagaagac

SEQ ID NO: 18317 - protein, 158 aa, Zea mays
  misc_feature: Ceres CLONE 1384267-F
MGKGSVGASWWAFLLLAGVLLVVAATAGAEDGVVERDRKEDLRWCKQACEWQYGKGHPRKRECKSECRERHQQADAGEDGDSGVDAYVSRSGRGECRRQCLGPHEGQPGEDPRVDEAGAAAADWPSTWSKNTVPANKSRGQCPGKVARPTPRGLVGED

SEQ ID NO: 18318 - DNA, 690 bp, Zea mays
  misc_feature: Ceres CLONE 1384268-F
  misc_feature: Encodes the peptide sequence at SEQ ID NO. 18319
aaagctggagctccccgcggtggcggccgctctagaactagtggatcccccgggctgcaggaattcgcacgagaccattacctagaacatcctaatcgaaaaatcgcacatattatttataccaactagcaacatacaaagcacaatagtgtaccaacaatggcagccaaaatattttgcctccttatgctccttggtatttctgcaagtgctgctacggcgaccattttcccgcaatgctcacaagctcctatagcttcccttcttcccccgtacctctcaccagcggagacttcggtatgtgaaaacccaattcttcaaccctacaggatccaacaggcaatcgtagctggcatcttacctttatcacccttgtctgtccaacaatcatcagccctattacagcagttacgttatgtgcatttattggcacaaaacatcagggcacaacaactaccacaacttgtgctagcgaaacttgcttgctactctcaggaacagcaagttctttccattcaaccaactaagttgcatggaactcttgcttcttattttgaaacacacaccaattaccattccgcccggtacctgttgcctaacccccaaaatttcttcccatcaaaccaactgggaacaattgaacccccccggctttattaaggggaaaaaaaattaattctttgttggggt

SEQ ID NO: 18319 - protein, 166 aa, Zea mays
  misc_feature: Ceres CLONE 1384268-F
MAAKIFCLLMLLGISASAATATIFPQCSQAPIASLLPPYLSPAETSVCENPILQPYRIQQAIVAGILPLSPLSVQQSSALLQQLRYVHLLAQNIRAQQLPQLVLAKLACYSQEQQVLSIQPTKLHGTLASYFETHTNYHSARYLLPNPQNFFPSNQLGTIEPPRLY

SEQ ID NO: 18320 - DNA, 652 bp, Zea mays
  misc_feature: Ceres CLONE 1384273-F
  misc_feature: Translation starting site: 132
gctctagaactagtggatcccccgggctgcaggaattcgcacgagaccattacctagaacatcctaatcgaaaaatcatagtgagtttgaggacattggaccgcaccctgcagaggccaagcgtcgaacacatggcgtgcaccttcctccgccgcgcgttctccctcaccgccgccggcacccacgcgaccccccgagttgccgccgccttcgcttccacttcctcctcatcctccgtcgtcgtgcctctgcgctccccactagaccaccgtcttctccgccacctccgctccgagatcacctacctcgcggagcgccgccctccccacgtgccgccgagtagcgtgcgaggcgttcgccgtggaggaccgcccgggggagcagtgggtgcgcctcgccgcccagcgcgggtagggggaggcgaggaggtgaaggtcgaggccaccatgttcgacggcgctgcggagcctgtcccggacgacgcgcccctcttccgcccgcgtggagtcgctcgagcgcgggccccggctccacctcagcttaatcgtcgaggtccgcccgggcgaccgcgtcctcgggttcctctgctcggcctggcccgaacacctccccgtccgcacgggctcacgctcgcaagtgggggtgggaagag

SEQ ID NO: 18321 - DNA, 632 bp, Zea mays
  misc_feature: Ceres CLONE 1384274-F
  misc_feature: Encodes the peptide sequence at SEQ ID NO. 18322
  misc_feature (551)..(551): n is a, c, t, g, unknown, or other
  misc_feature (632)..(632): n is a, c, t, g, unknown, or other
aaagctggagctccccgcggtggcggccgctctagaactagtggatcccccgggctgcaggaattcgcacgagaccattacctagaacatcctaatcgaaaaatcggcctcagtcgcacatatctactatactatactctaggaagcaaggacaccaccgccatggcagccaagatgcttgcattgttcgctctcctagctctttgtgcaagcgccactagtgcgacccatattccagggcacttgccaccagtcatgccattgggtaccatgaacccatgcatgcagtactgcatgatgcaacaggggcttgccagcttgatggcgtgtccgtccctgatgctgcagcaactgttggccttaccgcttcagacgatgcccgcgatgatgccacagatgatgacgcctaacatgatgtcaccattgatgatgccgagcatgatgtcaccaatggtcttgctgagcatgatgtcgcagatgatgatgccacaatgtcactgcgacgccgtctcgcagattatgctggaacagcagttaccattcatgttcanccctatggccatgacgattccacccatgctcttacagcaaccccttttgtggtgctgcattctagatacaactattggggn

SEQ ID NO: 18322 - protein, 156 aa, Zea mays
  misc_feature: Ceres CLONE 1384274-F
  misc_feature (130)..(130): Xaa is any aa, unknown, or other
MAAKMLALFALLALCASATSATHIPGHLPPVMPLGTMNPCMQYCMMQQGLASLMACPSLMLQQLLALPLQTMPAMMPQMMTPNMMSPLMMPSMMSPMVLLSMMSQMMMPQCHCDAVSQIMLEQQLPFMFXPMAMTIPPMLLQQPLLWCCILDTTIG

SEQ ID NO: 18323 - DNA, 677 bp, Zea mays
  misc_feature: Ceres CLONE 1384277-F
  misc_feature: Encodes the peptide sequence at SEQ ID NO. 18324
  misc_feature (512)..(512): n is a, c, t, g, unknown, or other
  misc_feature (555)..(555): n is a, c, t, g, unknown, or other
  misc_feature (596)..(596): n is a, c, t, g, unknown, or other
  misc_feature (604)..(604): n is a, c, t, g, unknown, or other
  misc_feature (677)..(677): n is a, c, t, g, unknown, or other
aagctggagctccccgcggtggcggccgctctagaactagtggatcccccgggctgcaggaattcgcacgagaccattacctagaacatcctaatcgaaaaacacaaggctaggcacaagcgaaccaaacccatggcgtccgacggcagcggcgtggtgacggtgtacggcagcaacggcgcggagctgctggagccgtccaagcagcccaagtcggcgactttctccgtcaaggtggggctggcgcagatgctccggggcggggtcatcatggacgtggtgaccccggagcaggcgcgcctcgcggaggaggccggcgcgtgcgccgtgatggcgctggagcgggtccccgccgacatccgcgcgcagggcggcgtggcgcgcatgtcggacccgggcctcatccgcgacatcaagcgcgccgtcaccatcccggtcatggccaaggcccgcatcgggcacttcgtggaggcccagatcctggaggccgtgggcgtcgactacgtggacgnagagcgaggtgctgacccccgccgacgacgcgcaccacatcancaggacaacttccgcggtccccttctgctgcggtggtcgcnaactcggngaggggcttcgcagggtgcgcgaggcgcccgcatgatccgcaccaagggggaggccggcacgggcaacgtctn

SEQ ID NO: 18324 - protein, 181 aa, Zea mays
  misc_feature: Ceres CLONE 1384277-F
  misc_feature (29)..(181): Pfam Name: SOR_SNZ Pfam Description: SOR/SNZ family
  misc_feature (127)..(127): Xaa is any aa, unknown, or other
  misc_feature (141)..(141): Xaa is any aa, unknown, or other
  misc_feature (155)..(155): Xaa is any aa, unknown, or other
  misc_feature (158)..(158): Xaa is any aa, unknown, or other
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILEAVGVDYVDXERGADPRRRRAPHXQDNFRGPLLLRWSXTRXGASQGARGARMIRTKGEAGTGNV

SEQ ID NO: 18325 - DNA, 653 bp, Zea mays
  misc_feature: Ceres CLONE 1384284-F
  misc_feature: Encodes the peptide sequence at SEQ ID NO. 18326
  misc_feature (572)..(572): n is a, c, t, g, unknown, or other
aaagctggagctccccgcggtggcggccgctctagaactagtggatcccccgggctgcaggaattcgcacgaggccattacctagaacatcctaatcgaaagtccttggcgtggtgtcctcgtcctcgtgcccatctctgtcccaatcaaactgattgatccgtcgcccgcagggccacagcagccgcggcgaggtcgtccgtcggattcggaggctcagttattactgaaaagataatacagtacctatggcttctctggacgccgtgcgaggagacctcgccctgctgattctgtacctgaacaaggccgaggcgcgggacaagatctgccgagcgatccagtacgggtccaagttcatcagcaacggggagccagggcctgcgcagaacgtcgacaagtccaccagcctgggcccggaaaggtgttccggctctgataaggtcggtcaacgagctggcacgcttttgatcaggcccctcctggcaagggggaacttcccgctccccgccttgaaacctggaaaccggggggaaaacccccaaaaagaagccgggggggggggggggggngaactatttttttttttctttctcctgggggagagaaaaaagaaggggggggggtggggggggggaaaaaaaaaagaaaac

SEQ ID NO: 18326 - protein, 135 aa, Zea mays
  misc_feature: Ceres CLONE 1384284-F
MASLDAVRGDLALLILYLNKAEARDKICRAIQYGSKFISNGEPGPAQNVDKSTSLGPERCSGSDKVGQRAGTLLIRPLLARGNFPLPALKPGNRGENPQKEAGGGGGGELFFFFFLLGERKKKGGGWGGGKKKEN

SEQ ID NO: 18327 - DNA, 681 bp, Zea mays
  misc_feature: Ceres CLONE 1384289-F
  misc_feature: Encodes the peptide sequence at SEQ ID NO. 18328
aaagctggagctccccgcggtggcggccgctctagaactagtggatcccccgggctgcaggaattcgcacgagaccattacctagaacatcctaatcgaaaactgcgctactgatatgcctcactgcccgatcctccccaatggctagcgcattttctgtgcgcgctgcggccccggccaccgctccccgggacatctccggatccatgtccgcggccaggcccttgcccgtggcatacccactgacgcgaccttcaatgctggcggcccgtgcaccactatcagtgaacgcgtatgcaccatccagcacgtacgacgcgcatgaggtcttgctgtctgaacgtctcgtgaggtcttgagggatcagatgtgattcagtccaccagtgtgaagataatgagaagatatagttcatcatccaggttcttacctataccaaagcgactgagttatcaggtggaaaaccttaaagttcaggcgctccctatcgcagagaactgctgtactgacatgaaatgggcacgataaatgacagagtattggccgtcaaagaaggtttgaacataggattcctgacccttgaatatcatcgaacctcaaataggtgcgcgatgcttccttagaaatcacgggggcatgtgcaaagccccatttgctatcctgggcccacaggaggggaag

SEQ ID NO: 18328 - protein, 72 aa, Zea mays
  misc_feature: Ceres CLONE 1384289-F
MASAFSVRAAAPATAPRDISGSMSAARPLPVAYPLTRPSMLAARAPLSVNAYAPSSTYDAHEVLLSERLVRS

SEQ ID NO: 18329 - DNA, 787 bp, Zea mays
  misc_feature: Ceres CLONE 1384289-R
  misc_feature (52)..(52): n is a, c, t, g, unknown, or other
ttggttgtggtgtgttaggggtagggagtcgatcgaagaggggaatccttcntcttcaattgggtacgggccccccctcgaggtcgacggtatcgataagcttttttttttttttttttaaatgctcgaaccatcaaattcggcattgcatagcgcagatttaggaacaagaagatcgagtccgtgcagctacgaagctggattatacatcttaaaacaagaacaaaacgactataagcctacaccttaagtctccaaagaatgcttgttacagcacaaaactaacaaacggaaggctttttcatggcaacaacagtctctcaaacgtcctaggccacaatctatgcacattagttgttccacgggcggccacaatctgggcaggctgcacaacgggttgcatcctccaagagtcgcagcatattggcgtaggcacatccctgagatgacagggcccatggatgggggggggtcaaggttagccccaaaaaattgtcgaacaatgggcccgacccaagggcttggtgcccgatcccaccccgatgggcatggccaatccttccaactatcaggcacggcgggtggggcccttcctggatgggaattggcccattagtggggcagaaataaaaaggggttttcaacgaacctgaatggtccgataaaccaccggggggatgggatcccccttttttgttatgccaaggatctttttccgcagaccttaaaaaggccccgagggaaaccccgcgaagcccccaaagtacttgtccaagtttttaggccc

SEQ ID NO: 18330 - DNA, 625 bp, Zea mays
  misc_feature: Ceres CLONE 1384293-F
  misc_feature: Encodes the peptide sequence at SEQ ID NO. 18331
  misc_feature (364)..(364): n is a, c, t, g, unknown, or other
aagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggttgtggtggctgaggtcccggtgaccgaggtgcagcgggagtcccgggcggccaggtgggcgaaggggccaagggaaagaaggggcccaaggagaagaaggcgcctaaggagaagaagctttccgcggcgaagaagccgggggcgcaccctccctacnctgagatgattggagaggcgatcgctgccctcaaggagaggaaggggtcgagctcggtggccatcagcaagtacgtcgagggggaagcatggggggaagctcccccaccaacttccgcaagcagttcactgtgcacctgaaaaaactcgctgccgccgggcaagctgacgagggtgaaaaaactccttcaggctgccggccaccgacgccaagccaagggccgccaagcccagggcacccaagggcgggcccaaaccccaa

SEQ ID NO: 18331 - protein, 44 aa, Zea mays
  misc_feature: Ceres CLONE 1384293-F
MIGEAIAALKERKGSSSVAISKYVEGEAWGEAPPPTSASSSLCT

SEQ ID NO: 18332 - DNA, 687 bp, Zea mays
  misc_feature: Ceres CLONE 1384298-F
  misc_feature: Encodes the peptide sequence at SEQ ID NO. 18333
  misc_feature (643)..(643): n is a, c, t, g, unknown, or other
  misc_feature (687)..(687): n is a, c, t, g, unknown, or other
aagctggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcgggggcagtttcgtcgccgtcgcctccatgacgtccgccgccgtctccaccagggtggagaacaagaagccatttgctcctcccagggaggaggtggccagggtacacatttcatggcatctcacaagattgaaattttcaagcacttgatgattgggctagagataatatctgacacatctcaagccagtcgaagagtggtggcaggcacaggatttccctccctggaccagcatctggagggatttcctgatggagtttaaggagctcagaggacggcgccaaggagatcccggaggattatttttggttgggttggggtgggagacatgattactgggggaacttctacgancttacccagactatggctaacaacccttcgagcgggtcaaaaan

SEQ ID NO: 18333 - protein, 71 aa, Zea mays
  misc_feature: Ceres CLONE 1384298-F
MALRLHDVALCLSPPLAARRRSGGSFVAVASMTSAAVSTRVENKKPFAPPREEVARVHISWHLTRLKFSST

SEQ ID NO: 18334 - DNA, 683 bp, Zea mays
  misc_feature: Ceres CLONE 1384301-F
  misc_feature (350)..(350): n is a, c, t, g, unknown, or other
  misc_feature (416)..(416): n is a, c, t, g, unknown, or other
aaagctggagctccccgcggtggcggccgctctagaactagtggatcccccgggctgcaggaattcgcacgagaccattacctagaacatcctaatcgaaaaaaccgtttggacccagccagctcatgagctcacatgcctaggcgtgaggcgtatcgtcttcgacccttcgccttcctcgtccctttctctctcccagattctgactccgtcgggctcccccgtgtctgtgtcttggtaaacatcggtctctccccatcccacctggcagttgccatctcgcaaagtcgcaataacttgtcttctcgaatcggctgcaaccccaccccagaccccaccgccgccgccgntagggttttggggtgaggatcgccgatgtcgacggctcccaggcgtcccttccgaaggcgcggcgncatgccctcgggcaccgggtacgtccgccgcgggcccgccccaggctccgccgacgcccgccagcccctgcgcaagcccgtcttcaccaccgtcaaccagcttcgcccccagacacacgggtcacactctcacaggcccgcgtcatttgcccgtccgcaccggtccttcgacaagccctccacggaccctcgggccgcacccggggtcgcccgagtggcctccgtcggagaaaggaaccgggaaccgttccttcgtcaccggcccga

SEQ ID NO: 18335 - DNA, 635 bp, Zea mays
  misc_feature: Ceres CLONE 1384306-F
  misc_feature: Encodes the peptide sequence at SEQ ID NO. 18336
aaagctggagctccccgcggtggcggccgctctagaactagtggatcccccgggctgcaggaattcgcacgagaccattacctagaacatcctaatctaaaatattattgataccaactagcaacatacatagtgaagtacactagcaacatcttagcaccaatggcagccaagatttttgccatccttgccctccttgctctttcagcaagcgttgctaccgcgactattattccacaatgctcacaacaatacctctctccggtgacagccgcgagatttgaatacccaactatacaatcctacaggctacaagaggccatcgcagcaagcatcttacggtcgttagcattgaccgtccaacaccatatgccctattgcagcaccatccttagtaatctatatctccaagaatcgagcacacaactagcacacaggtgcttccacaatcaatcagtagttgcagcgaccttgctgcttactccagcaacaacatttcttcattcaatcactagctggggtgaccctgctgctacttgcaggacacagctactacattcaccaactggtcagagccttggtgcttctactggaggagaggtggtccattcatcaacaggtgtggaaacattggg

SEQ ID NO: 18336 - protein, 157 aa, Zea mays
  misc_feature: Ceres CLONE 1384306-F
MAAKIFAILALLALSASVATATIIPQCSQQYLSPVTAARFEYPTIQSYRLQEAIAASILRSLALTVQHHMPYCSTILSNLYLQESSTQLAHRCFHNQSVVAATLLLTPATTFLHSITSWGDPAATCRTQLLHSPTGQSLGASTGGEVVHSSTGVETL

SEQ ID NO: 18337 - DNA, 698 bp, Zea mays
  misc_feature: Ceres CLONE 1384309-F
  misc_feature: Encodes the peptide sequence at SEQ ID NO. 18338
  misc_feature (258)..(258): n is a, c, t, g, unknown, or other
  misc_feature (269)..(269): n is a, c, t, g, unknown, or other
aagctggagctccccgcggtggcggccgctctagaatagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacngggtcgcctcnggggagccgccgcgccgcaatatgttagcgctgcggcaccggcgcccgctctggagccagctgggcctccggagagcgtctcctttccgattctggtcgattgctggagtgggaacatggggttatctgtcgctgaggctggtggtctgaggggccttcacctaggccctggttcattcagcaggaaagagaaggttgaaaaaaacaatgcaagttgtgacaaacagacattcaaatatattggccctctaaaaagagaagatgttctttcatctatttggtgatgaattcccacgatggcattgtttggggactacacaaggaaccgggttctgtggaactctaaatggtgacctcttattggaaagcttggagattgcccatttgggaatgggccacaactgggtgggaaaacaaacatttttgctc

SEQ ID NO: 18338 - protein, 114 aa, Zea mays
  misc_feature: Ceres CLONE 1384309-F
  misc_feature: SWISSPROT Homolog: EC 1.3.1.26 Dihydrodipicolinate reductase
  misc_feature (17)..(17): Xaa is any aa, unknown, or other
  misc_feature (21)..(21): Xaa is any aa, unknown, or other
MLSMRPPSTTLSRRPRXGRLXGAAAPQYVSAAAPAPALEPAGPPESVSFPILVDCWSGNMGLSVAEAGGLRGLHLGPGSFSRKEKVEKNNASCDKQTFKYIGPLKREDVLSSIW

SEQ ID NO: 18339 - DNA, 653 bp, Zea mays
  misc_feature: Ceres CLONE 1384313-F
  misc_feature: SWISSPROT Homolog: EC 5.3.1.1 Triose-phosphate isomerase
  misc_feature (296)..(296): n is a, c, t, g, unknown, or other
  misc_feature (615)..(615): n is a, c, t, g, unknown, or other
aagctggactccccgcggtggcggccgctctagaatagtggatcccccgggctgcaggaattcgcacgagaccattacctagaacatcctaatcgaaaagccgtccgaagctccgcaccccaatctaatcgacacctcaccgagatgggccgcaagttcttcgtcggtggcaactggaaatgcaatgaaaccacagatcaggtcgagaagattgtcaaaaccctgaatggaggacaggtcccccttcagatgtgtcgaggtcgttgccacccctccttatccttcccttctggggncaaaaagcagtttgcgccaaaattcccatggtgttgctcacaactggctggggaaaaaaagggaggggttttcccctgggaaaaaaaaggggtgaaaagccccccaaacctggggggccccccggggttttttttgggaacccttaaaaaaaaagactcttttgtgggaaaaaaaaaaaaattttttttgaaaaaaaaagtggtaattttcccccttcccaaaaaaaaaaaacatttttttgttggtggtgggccccccccctagaaaagggggggggggcgccccccccggtggtgttttgtccccccaaaaaaaaantttttttgaaaaacaaagggggggcgcgccctttttta

SEQ ID NO: 18340 - DNA, 680 bp, Zea mays
  misc_feature: Ceres CLONE 1384314-F
  misc_feature: Encodes the peptide sequence at SEQ ID NO. 18341
  misc_feature (371)..(371): n is a, c, t, g, unknown, or other
  misc_feature (474)..(474): n is a, c, t, g, unknown, or other
  misc_feature (507)..(507): n is a, c, t, g, unknown, or other
  misc_feature (516)..(516): n is a, c, t, g, unknown, or other
  misc_feature (517)..(517): n is a, c, t, g, unknown, or other
  misc_feature (525)..(525): n is a, c, t, g, unknown, or other
  misc_feature (588)..(588): n is a, c, t, g, unknown, or other
  misc_feature (652)..(652): n is a, c, t, g, unknown, or other
aaagctggagctccccgcggtggcggccgctctagaactagtggatcccccgggctgcaggaattcgcacgagaccattacctagaacatcctaatcgaaaaaacactcccccgatctccgccactccaaaatgtggcgccgccaccacctcctccggctacttccacctccggccaccgccgccaccgccgcggccccttctcatttcctgcgccacctctctacctcaagcaccccgaccccggccgcctccctggcctcgtccctcgcgtcggcgctcaccgcgctctccacgaccccgccccccgccaccaccccggacgcttacttctccctccacttctccgacgtgcggcctaccaacgcgctncctcgctgaggcgctcgcgctctccccgcccgccacctcccgcgccgctgccgatctcttccgcttcctcgtccgccgccgctcgctccacccctccgacggngcgctcgcgcccatcgttcgccacctcgcccgncgccgcgannttccccgncgtgcgcgcgctcatcccagaagttccaaccgctctcggggccgccacgctcgacgcctatcntcagcagctcaccaggagccgggcgccaaacggacgctggtcagggtggtcgacgaattgcggnagcagctccgtaaccgcgagctcctcac

SEQ ID NO: 18341 - protein, 82 aa, Zea mays
  misc_feature: Ceres CLONE 1384314-F
MWRRHHLLRLLPPPATAATAAAPSHFLRHLSTSSTPTPAASLASSLASALTALSTTPPPATTPDAYFSLHFSDVRPTNALPR

SEQ ID NO: 18342 - DNA, 716 bp, Zea mays
  misc_feature: Ceres CLONE 1384319-F
  misc_feature: Encodes the peptide sequence at SEQ ID NO. 18343
aaagctggagctccccgcggtggcggccgctctagaactagtggatcccccgggctgcaggaattcgcacgagaccattacctagaacatcctaatcgaaaacgaaaagcggttttgcacttctcgccttctctaatctctttgcctctttggctccctccaccaccagtccaccaccactgctacccaacccttgcttccccaaaccctagccaagggacacggtggccgacgatggacggcgacggaggaggcgctggtgcgctgcaccaccacacgcgctcacccgaggacgtcttccgcgatttccgcgcgcgccgagccggcatcgtcaaggcgctcaccacggatgtggagaagttctatcaccagtgcgatccagagaaagagaacttgtgcctttatggtttgccaaatgagacttgggaggtcactcttccagctgaggaagtacctcctgagcttccagaaccagcacttgggaataaactttgcccgtgatgaaatggtcaaaaaaaacttgttgcctcaagttgcagttaatagggaggcatgccttcctgcctgttgcaatcaacttgggagttcgttttgaatttgacaagaatgccagaaaaaggctcctcacctgaataaccaaccgccccctggttatgaaagtgggaacggggttgcataaaagaaaccaaggcccccaacgggacacacaaaacccg

SEQ ID NO: 18343 - protein, 88 aa, Zea mays
  misc_feature: Ceres CLONE 1384319-F
MDGDGGGAGALHHHTRSPEDVFRDFRARRAGIVKALTTDVEKFYHQCDPEKENLCLYGLPNETWEVTLPAEEVPPELPEPALGNKLCP

SEQ ID NO: 18344 - DNA, 677 bp, Zea mays
  misc_feature: Ceres CLONE 1384322-F
  misc_feature (508)..(508): n is a, c, t, g, unknown, or other
  misc_feature (581)..(581): n is a, c, t, g, unknown, or other
aaagctggagctccccgcggtggcggccgctctagaactagtggatcccccgggctgcaggaattcgcacgagaccattacctagaacatcctaatcgaaaactccacagcacgcacgcagcacccaacaacatacacaccacagaccaaaacgaccgccgcaccttcagcagcaaagtgtccaagcggcggcatggcagcgagcaaggcgcgtgtcgcgctgttcctggcggcgctcgcggggcgagcctgctggcgctgccccgggcccgggcggcgccgcgacgacgtgcgcgccgacgcagctgaccccgtgggcgcccgccatcgtcgggaacgcggcgcccaccgcggcgtgctgggccaggctcaagggggagccggcgacctgcttctggcagtacaagaggaaccccagcatggagcgctacgtcaactcccccaacgggaagaaggttttcgccgcctgtaaggtgtccctgcccaggtgctgatgctgagtgagtcntctgctgcagtgctgccccgtcaggccgatgtcgatccatgctgctcgatcgatcgatcgaccgacctcgcgncggggatggtcctactactgaggacctttggggcagagtttattattgctcgagaacataaaagggagacgtaccactcccagacttgggaaaggg

SEQ ID NO: 18345 - DNA, 798 bp, Zea mays
  misc_feature: Ceres CLONE 1384328-F
  misc_feature: Encodes the peptide sequence at SEQ ID NO. 18346
agagctggagctccccgcggtggcggccgctctataactagtggatcccccgggctgcaggaattcgcacgagaccattacctagaacatcctaatcgaaaaattagggagttttcttctcccgtccaccttgcgtgctcgcgcgcgagctctcgtggcgcagccacaactaggcgaccgccgccgcccctacgccacgtgctcgagtctagcctcgtcgattacttccccagtttaattgatctacaagcttcagaacatgttcaagaatacatttcagtctgggttcctgtccattctttatagcctcgggaccaacccattgcagatatgggataaaggaagttgtgaatgggcacatttatatcaccccccacatgaagatatcccatcctaatgtacttgaaatttgttggaacaaattgtaccggtcaaatttaccttcacataccccggctggatcccttcctgcttactcttggggaataaaagccttccattttctcggcctattaattgggggaaaaaatcctaaaaaaaaataccttccccgcttttgaaaaaccccaatgtctcgggaatgaaaaaaaaatgggcccaaacccccattttctcaaagcattcaaaattttttcaaatttggaccacaagggggttgaaaacccatatattctctgcgcccgactgccccttgtaaacccccccacgaagggggtgggaaacaaacattccaagtttggaacctcttgtgttgatcctggaccaaaaagagggcgcccacagggcaaaaaaataacc

SEQ ID NO: 18346 - protein, 45 aa, Zea mays
  misc_feature: Ceres CLONE 1384328-F
MFKNTFQSGFLSILYSLGTNPLQIWDKGSCEWAHLYHPPHEDIPS

SEQ ID NO: 18347 - DNA, 672 bp, Zea mays
  misc_feature: Ceres CLONE 1384330-F
  misc_feature: Encodes the peptide sequence at SEQ ID NO. 18348
  misc_feature (448)..(448): n is a, c, t, g, unknown, or other
  misc_feature (511)..(511): n is a, c, t, g, unknown, or other
  misc_feature (534)..(534): n is a, c, t, g, unknown, or other
  misc_feature (569)..(569): n is a, c, t, g, unknown, or other
  misc_feature (576)..(576): n is a, c, t, g, unknown, or other
  misc_feature (639)..(639): n is a, c, t, g, unknown, or other
  misc_feature (649)..(649): n is a, c, t, g, unknown, or other
aaagctggagctccccgcggtggcggccgctctagaactagtggatcccccgggctgcaggaattcgcacgagaccattacctagaacatcctaatcgaaaaagacgccctctactaatccagcccatttcgaactctctctagacgcttcctcggtctctctgttcaccgccgccccgtaccatactcctcttcgcgccgtagaaatggcgctgccgaatcagcagggcgtggattaccccagcttcaagctcgtcatcgttggcgacggtggaactggtaaaaccacatttgtgaaaaggcatcttactggcgagtttgagaagaaatatgagcccaccattggtgttgaagttcaccctctggattttagcactagctgtggcaaaattcgcttttattgctgggacactgctgggcaagaaaagttcggtggccttagggatgnctactacattcatgggcagggtgcatcattatggtttgatggcacttctaggctggacatacnagaatgtcccacatggcacaggnatctggtgcagggtctgtgagaacatccccatggntcttgtnggaccaaggttggatggcaggacagggaagtcagggccagccaggtacattcaccggaagaangacttgcagnactatgagatttctggccagaca

SEQ ID NO: 18348 - protein, 115 aa, Zea mays
  misc_feature: Ceres CLONE 1384330-F
  misc_feature (15)..(116): Pfam Name: Ras Pfam Description: Ras family
  misc_feature (81)..(81): Xaa is any aa, unknown, or other
  misc_feature (102)..(102): Xaa is any aa, unknown, or other
  misc_feature (110)..(110): Xaa is any aa, unknown, or other
MALPNQQGVDYPSFKLVIVGDGGTGKTTFVKRHLTGEFEKKYEPTIGVEVHPLDFSTSCGKIRFYCWDTAGQEKFGGLRDXYYIHGQGASLWFDGTSRLDIXECPTWHRXLVQGL

SEQ ID NO: 18349 - DNA, 811 bp, Zea mays
  misc_feature: Ceres CLONE 1384332-F
  misc_feature: Encodes the peptide sequence at SEQ ID NO. 18350
  misc_feature (1)..(1): n is a, c, t, g, unknown, or other
  misc_feature (2)..(2): n is a, c, t, g, unknown, or other
  misc_feature (20)..(20): n is a, c, t, g, unknown, or other
  misc_feature (21)..(21): n is a, c, t, g, unknown, or other
nncccccccccccccccccnnctcgcgcgcgccgcggggggagaaaaggggagggctgggggctccccgcgggggcggccgctctagaactagtggatcccccgggctgcaggaattcgcacgagaccattacctagaacatcctaatcgaaaaaagcggcgcatctgaatccaaacgacgacgagatgacgaccgatccacaggcagaaaacgagcaagttccgatggggagagatggacgaagacgacgatctcgacttccttctccctccaaagcaagggatcggcccacacgaaaacggattgaagacggggaacgagtacaagttcaacgaagaaggggacaaggggcgggatcacgagcaggtcgcgcgggcggaaggtagcttccgcgagggtcaacaagggagccatgcaccgggagggggtgggggtagggtcggaagacccccgcggacgaggacgcctgggaggccggcgcggccgtggtctgcgacccaagaagatgcttcttggaagcggcgcgaaaagctcctggggaaccaaaggagaagggaaccagagggcgggcagggagaccaactttgggctcagggtggggtgagagcggtgggtgaaagaccccgccgggggggttggaagggaaatgagcgggggaggaaagagggggagtccgctgggaacatccaaaaagggcccctataaaagggggagcgtaagggcggggcccgagaccgatgggtggtgttgggggcggaggagaggcgcccgccgcgggggggggagaaggatgtagaggggggcgtccgg

SEQ ID NO: 18350 - protein, 156 aa, Zea mays
  misc_feature: Ceres CLONE 1384332-F
MDEDDDLDFLLPPKQGIGPHENGLKTGNEYKFNEEGDKGRDHEQVARAEGSFREGQQGSHAPGGGGGRVGRPPRTRTPGRPARPWSATQEDASWKRREKLLGNQRRREPEGGQGDQLWAQGGVRAVGERPRRGGWKGNERGRKEGESAGNIQKGPL

SEQ ID NO: 18351 - DNA, 668 bp, Zea mays
  misc_feature: Ceres CLONE 1384334-F
  misc_feature: Translation starting site: 192
  misc_feature (404)..(404): n is a, c, t, g, unknown, or other
  misc_feature (405)..(405): n is a, c, t, g, unknown, or other
  misc_feature (424)..(424): n is a, c, t, g, unknown, or other
  misc_feature (461)..(461): n is a, c, t, g, unknown, or other
  misc_feature (482)..(482): n is a, c, t, g, unknown, or other
  misc_feature (534)..(534): n is a, c, t, g, unknown, or other
  misc_feature (623)..(623): n is a, c, t, g, unknown, or other
  misc_feature (634)..(634): n is a, c, t, g, unknown, or other
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagagttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagagggtggccttgccctcaaggannaggaaggggtccagctcgntgggcatcagcaagtacgtcgaggggaagcatggcgncaagctccccaccaacttccngcagcagctcactgtgcagctgaagaagctcgctgccgccggcaagctgacnagggtgaagaactcctttcagctgccgggcaccgacgccaagcccaagggcgccaaggccaaggcacccaagggcgcgcccaagccagncctcgcccaanggcgaangccagaccgctgcgagcccccaggcgg

SEQ ID NO: 18352 - DNA, 773 bp, Zea mays
  misc_feature: Ceres CLONE 1384335-F
  misc_feature: Translation starting site: 270
  misc_feature (300)..(300): n is a, c, t, g, unknown, or other
  misc_feature (304)..(304): n is a, c, t, g, unknown, or other
aaagctggagctccccgcggtggcggccgctctagaactagtggatcccccgggctgcaggaattcgcacgagaccattacctagaacatcctaatcgaaaactcggccctccccgcggaataaaagctttttctctggcctcccttcctccgaatccatccatccatccatctattgtctcccttccaattcgatgcctttgtagcgctgctgcctcgccgcgtcgtcgcgggtccccgatttccgcttgctgctgcgcttccacaccatgggacggcggggatccggcaatgcctccngcgncagcggcggcgcatcgacgtgctgctactacgcgctccctcggatccgcaggaaccgctcccgccacgacatacgcgccgcttaaccggaggtcgcgatgaaggtgccacccggaccggggggccaggaaccccggggggcccggggaagccaatcaagggttccaggggaatccagaaggatattcctttttggcggaaaaggggaaaaaggccttgtacaaccccggttcttttaaccccctcaagaaaaaaaaaggaatttccccaaatttctaacaaaaaccttgggggttagaaaaaccggaaaaaaaaaaaaccccccccttggggaaccccaaaaaaaatggggaaaactcttaaaaggaaaccccgggggggaaaaaccccaccaggggggggccccccacaaagggtttttaaaaaaaagttttttcccccaccaacggagagggggggggggggggggg

SEQ ID NO: 18353 - DNA, 678 bp, Zea mays
  misc_feature: Ceres CLONE 1384338-F
  misc_feature: Translation starting site: 160
  misc_feature (459)..(459): n is a, c, t, g, unknown, or other
aaagctggagctccccgcggtggcggccgctctagaactagtggatcccccgggctgcaggaattcgcacgagaccattaactagaacatcctaatcgaaaaatcgcacatattattgagaccaactagcaacatagaaagcacaatagtgtaccaacaatggcagccaaaatattttgcctccttatgctccttggtctttctgcaagtgctgctacggcgaccattttcccgcaatgctcgcaagctcctatagcttcccttcttcccccgtacctctcaccagcggtgtcttcggtatgtgaaaacccaattcttcaaccctacagggatccaacaggcaatcacagctggcatcttacctttatcacccttgttcctccgacaatcatcagccctattacatcagttacctttggtgcatttattggcacaaaacatcagggcacaacaactacnacaacttgtgctagcaaagcttgctgcctactctcaggcacagcagtttcttccattcagccaactaggtgcattggactctgcttcttatttgcacaacaaacactaacattcaggcaggtacctggtgcctacccccagcaatttcttcattcagcaactggcagcattggactctcctgcttattacaggagcaacactactaccattcgccaggt

SEQ ID NO: 18354 - DNA, 720 bp, Zea mays
  misc_feature: Ceres CLONE 1384343-F
  misc_feature: Encodes the peptide sequence at SEQ ID NO. 18355
  misc_feature (521)..(521): n is a, c, t, g, unknown, or other
  misc_feature (544)..(544): n is a, c, t, g, unknown, or other
  misc_feature (545)..(545): n is a, c, t, g, unknown, or other
  misc_feature (553)..(553): n is a, c, t, g, unknown, or other
  misc_feature (595)..(595): n is a, c, t, g, unknown, or other
  misc_feature (602)..(602): n is a, c, t, g, unknown, or other
  misc_feature (618)..(618): n is a, c, t, g, unknown, or other
  misc_feature (621)..(621): n is a, c, t, g, unknown, or other
  misc_feature (623)..(623): n is a, c, t, g, unknown, or other
  misc_feature (667)..(667): n is a, c, t, g, unknown, or other
  misc_feature (668)..(668): n is a, c, t, g, unknown, or other
aaagctggagctccccgcggtggcggccgctctagaactagtggatcccccgggctgcaggaattcgcacgagaccattacctagaacatcctaatcgaaaaaacaacagcagcccccggggccacagggcgcaggcccgcagccatggaccaggaccacaagaggctagtactcccgtcgccggcgccgcagtccccgccggcatccgccgcgtcggcgtcgaccacggcctcgccgtactccgcgctacaccctctcctcttgccctccccgaacccgcacctcttcctgaagcccaagacgctaactctctccctctcgtcctcctccctcacctccatgtcctcctcctcgctgcccgcccccgtcaccgatgtcgtgggaggtcgtcacccccactgccccatctgttgaccacgtggacggcgggcttgatgactgcgccatcttcccgccgcggctgcatgaggggctgggcctggacggcgagcccgaggaggtccccgcgatgcagcagtgncgaaggaggagacgagagatggnnaaaatacnagggggaggacgatgagtgcctgtggggattggagaagtgcnacttggncgcaagcgcgcttggncgncngtggtcggatcgttcaggacgggtgtcgtgcatggcccgtgtgnntgccccgcgtgagccccgcccggggggccggtgcgtggcgttttctttgggg

SEQ ID NO: 18355 - protein, 89 aa, Zea mays
  misc_feature: Ceres CLONE 1384343-F
MDQDHKRLVLPSPAPQSPPASAASASTTASPYSALHPLLLPSPNPHLFLKPKTLTLSLSSSSLTSMSSSSLPAPVTDVVGGRHPHCPIC

SEQ ID NO: 18356 - DNA, 690 bp, Zea mays
  misc_feature: Ceres CLONE 1384344-F
  misc_feature (472)..(472): n is a, c, t, g, unknown, or other
  misc_feature (562)..(562): n is a, c, t, g, unknown, or other
  misc_feature (605)..(605): n is a, c, t, g, unknown, or other
  misc_feature (609)..(609): n is a, c, t, g, unknown, or other
  misc_feature (625)..(625): n is a, c, t, g, unknown, or other
  misc_feature (657)..(657): n is a, c, t, g, unknown, or other
aaagctggagctccccgcggtggcggccgctctagaactagtggatcccccgggctgcaggaattcgcacgagaccattacctagaacatcctaatcgaaaaaaccgtttggacccagccagctcatgagctcacatgcctaggcgtgaggcgtatcgtcttcgacccttcgccttcctcgtccctttctctctcccagattctgactccgtcgggctcccccgtgtctgtgtcttggtaaacatcggtctctccccatcccacctggcagttgccatctcgcaaagtcgcaataacttgtcttctcgaatcggctgcaaccccaccccagaccccaccgccgccgccgatagggttttggggtgaggatcgccgatgtcgagcgggctcccaggcgtccctttcggagggccgcggcgccatgccctcgtgcacctgctacgtccgcctgcggtcccgcccagggtcctgncgacgccggcaagaccctgctgcagcccgtctttaccaccggtcatcaggatcagccccagacacacgggtcgcactctcacagcccggngtcatttgccgttcggcacggtcctcgataatgccctccacgnaacntcgggccgcacctcgnggtcggcggagtggcttcgtcggaagacaggnaccgggatccgttcctccgtcaccgcgccggaa

SEQ ID NO: 18357 - DNA, 729 bp, Zea mays
  misc_feature: Ceres CLONE 1384345-F
  misc_feature: Encodes the peptide sequence at SEQ ID NO. 18358
  misc_feature (550)..(550): n is a, c, t, g, unknown, or other
  misc_feature (569)..(569): n is a, c, t, g, unknown, or other
aaagctggagctccccgcggtggcggccgctctagaactagtggatcccccgggctgcaggaattcgcacgagaccattacctagaacatcctaatcgaaaactacccctacccgcgacttcgctcagcttccgccgatcggcttgccccgtcgatttcgccaacccctcgacccgatcggctccattgatcgtacctcgtcgtccggttgtcgatggccaggacctctttcaaaatggagcacgacctcgagaaaaggcagtccgaatctgccaggatcagggataagtatcccgacagaattcctgtgattgttgagaaagctggcaaaactgatgtccccgagattgataagaagaagtaccttgtccctgctgatctcactgtcggccagtttgtctatgtggtgaggaagagaatcaagctgagcccagagaaggccatctttgtctttgtgaagaacacccttgcaccaactgcctctttgatgtctgcaatctacgaagagaacagggacgaggatggcttcctttacatgacctacagtggntgaaacaccttcggctctngctagagcaatcgcccctgccactgtaaataacgagcatgatggggctgctgctattgtaaactgtgtatatacctcagtctctagtatgctgctggccgattgcttcatggcttcaatgacacctttagctttcactgtttggttttctctgtgaattg

SEQ ID NO: 18358 - protein, 112 aa, Zea mays
  misc_feature: Ceres CLONE 1384345-F
  misc_feature (14)..(112): Pfam Name: MAP1_LC3 Pfam Description: Microtubule associated protein 1A/1B, light chain 3
MARTSFKMEHDLEKRQSESARIRDKYPDRIPVIVEKAGKTDVPEIDKKKYLVPADLTVGQFVYVVRKRIKLSPEKAIFVFVKNTLAPTASLMSAIYEENRDEDGFLYMTYSG

SEQ ID NO: 18359 - DNA, 681 bp, Zea mays
  misc_feature: Ceres CLONE 1384346-F
  misc_feature: Translation starting site: 153
  misc_feature: Pfam Name: SBF Pfam Description: Sodium Bile acid symporter family
  misc_feature (407)..(407): n is a, c, t, g, unknown, or other
aaagctggagctccccgcggtggcggccgctctagaactagtggatcccccgggctgcaggaattcgcacgagaccattacctagaacatcctaatcgaaaactcagctgctggcccgctgcctgcagccattgcccgctcctcgaggtcaaatggcccctgcccccgctctcaccgccacatccgtcctgaagcgttcccacctacccggcgtccactcgttggcctgtcgccggcagccgggggcggaccgcgtctcggtgctttctccagcgatcccgccgccccgcgtttcatggcagcaaggatctggagtggttgctaagaggctcctctgggcgagtgcgagtggttccttcgagaaagataacatcggggagggaggcggtgttgccttctcagatagncgtgaagaataaagtagattttttgaagattttagagagtggcaactccattattccccatatagtgctggggagtacaattctcgccctggtgtacccgccttcgtttacatggttcactaccaggtattatgcaccagctttggggttcttgatgtttggctgtggtgtaaactcaggtgccaaggatttattgagccataaagaggccagatgctattgctgcgggctatatcggacaggttggcatcaaggctttggttggattcttttt

SEQ ID NO: 18360 - DNA, 639 bp, Zea mays
  misc_feature: Ceres CLONE 1384348-F
  misc_feature: Encodes the peptide sequence at SEQ ID NO. 18361
  misc_feature (272)..(272): n is a, c, t, g, unknown, or other
aagctggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttgnaggcattgacaagcgtgtgatcgagaggtttgagaaggaggctgctgaaatgaataagcggtccttcaagtacgcgtgggtgctcgacaagctcaggggtgagggggagagaggtatcaccattgatattgctctgtggaagtttgagaccacaagtactactgcacggtcattgatgcccctggacaccgtgacttcatcaagaacatgatcactggtacctcccaggctggactgggctgtccttatcattgactccaccactggtgggttttgaggctggtatcctccagggatggccagacccctggaacatgctcttcctggggttcaccctttggaggggaacaaaaatgatttgctgctg

SEQ ID NO: 18361 - protein, 101 aa, Zea mays
  misc_feature: Ceres CLONE 1384348-F
  misc_feature (5)..(101): Pfam Name: GTP_EFTU Pfam Description: Elongation factor Tu GTP binding domain
  misc_feature: SWISSPROT Homolog: EC 2.7.7.4 Sulfate adenylyltransferase
  misc_feature (32)..(32): Xaa is any aa, unknown, or other
MGKEKSHINIVVIGHVDSGKSTTTGHLIYKLXGIDKRVIERFEKEAAEMNKRSFKYAWVLDKLRGEGERGITIDIALWKFETTSTTARSLMPLDTVTSSRT

SEQ ID NO: 18362 - DNA, 723 bp, Zea mays
  misc_feature: Ceres CLONE 1384351-F
  misc_feature (202)..(202): n is a, c, t, g, unknown, or other
  misc_feature (393)..(393): n is a, c, t, g, unknown, or other
  misc_feature (723)..(723): n is a, c, t, g, unknown, or other
aagctggagctccccgcggtggcggccgctctagaactagtggatcccccgggctgcaggaattcgcacgagaccattacctagaacatcctaatcgaaaagctgttagtgctgttcccctctctcttccccgtcctgcaggctccaggcgctgctgctctcgtcctccgctagcgagcgaatcgctggcccgacgccgcgncgggaggatctcgctttcgacagggatttggttgggcggcgttctccggggctatctcatttctattatcgggggctcgggttcacgggcaaattcgctgctgggtggggctttggagattggagccaattccttaaagtggcggtggcaacgtctggtggcaaccatgggggtggggggtcccgaggaancaggcccaacatagagggccggtggcttcacaggggtcgccccccgagcgccgcaccatggggaattcatggcagggaggcagggcgggtgaataaccaattcccttggtttttcctccaaactggtttttggttttgttcagggggactggacctcacaccagaaggggctcccaaatccttttggtttttggatagtccttggggaggtcttccttaaggggccacgagccctttaaaatgggaatgcccacggggccaagaagttttggttcatgggtggaaactgccaaaaaggtttttcttggggccaaaactggaggttggggn

SEQ ID NO: 18363 - DNA, 638 bp, Zea mays
  misc_feature: Ceres CLONE 1384353-F
  misc_feature: Translation starting site: 209
  misc_feature (386)..(386): n is a, c, t, g, unknown, or other
aaagctggagctccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaagggagggcatccctcctgagcagcagcggcttatcttcgccggcaagcagcttgaggacggacgcacacttgctgactancacatccagaaggagtcaacccctcactgggtgctggccccttagggggaggcaatgccagatctttggccaagactttgactgggcagacaatcacccctggagggggagtccctcaaacaccattgacatggtcaggggaagaatcccaggacaagggggggattcccccctgaacaggaagggtttaattttttgccggaaaagaattttgggggggaggggagggaccctttgggtaaaaaaaaaaac

SEQ ID NO: 18364 - DNA, 790 bp, Zea mays
  misc_feature: Ceres CLONE 1384355-F
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnccccnncccccccnnnncaccaccgccgccnnnntcttcannnnccaaagctggagctccccgcggtggcggccgctctagaactagtggatcccccgggctgcaggaattcgcacgagaccattacctagaacatcctaatcgaaaaagtctgcacaccgccactcgcccacacgcgaaggcacctagcagccgccactcgccgaactgaggaacacgccgggcgacgggatacagcagcagcgcgcccctctatccccgacgcgacggcgccctgcagctgcagataaacctgttccaatggccaaacaaaaagaggggggtggacaaaagaacttctaggaagatgatccgatctacgggaagggctgtgcaaaagagcatttacttttggagaggaacaacaaatcaaacgatctgcaagctgcgggggggtgccgaatgacatccctagggtagcatactatcacgggttgacattcagaagaacccctcacagatggggccttggtttctcaaacctgggcggcggcgtggggaaaaaacttggttgcgggaaattgggccttcccccgggggccaccatggttccaaccccgggaaagaggggggctccaaaaagtaccaggggaccaacttttggccatggagaggccaaaaggtttctttggcgcaagttacggacttccatcctaactccttaaaaagagtttggttatttaaaggttccggggctggggcgggggaggagccacttggcccatgggcaaagaggaagtggattccc

SEQ ID NO: 18365 - DNA, 767 bp, Zea mays
  misc_feature: Ceres CLONE 1384356-F
  misc_feature: Encodes the peptide sequence at SEQ ID NO. 18366
  misc_feature (295)..(295): n is a, c, t, g, unknown, or other
  misc_feature (353)..(353): n is a, c, t, g, unknown, or other
aaagctggagctccccgcggtggcggccgctctataactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcngccggcggctgtacccctacgcggagtacctgaagcagccgcagtgcagcccgctggncgcggcgccctactacgccgggtgtgggcagcccagccgcatgttccagccgctccggaaaagtgttggcagcaccatatgaggatgatggacgtgcatcccgcccgcaaaaacttgaaatgatgatggaatttgaggtgccccttgccccaaaaaaaacctggaaaaacccattttttttggaaaaaaaaaaaaagtttgtgggaacccagggtccacccccccgtggccttgttgaggggcgaaaaaaatgcccgccctggggggggatttaaacaaaaaaagtgggcccattataccccccaaccccgggggggggcccccggttgtctttcccccccaaatttggttttttgtaattattgggaaaaccccccctaaacccctccctctaaattaaaaaaaaaaaaaaaa

SEQ ID NO: 18366 - protein, 91 aa, Zea mays
  misc_feature: Ceres CLONE 1384356-F
  misc_feature (46)..(46): Xaa is any aa, unknown, or other
  misc_feature (65)..(65): Xaa is any aa, unknown, or other
MKMVIVLVVCLALSAASASAMQMPCPCAGLQGLYGAGAGLTTMMGXRRLYPYAEYLKQPQCSPLXAAPYYAGCGQPSRMFQPLRKSVGSTI

SEQ ID NO: 18367 - DNA, 674 bp, Zea mays
  misc_feature: Ceres CLONE 1384357-F
  misc_feature: Translation starting site: 160
  misc_feature (428)..(428): n is a, c, t, g, unknown, or other
aagctggagctccccgcggtggcggccgctctagaactagtggatcccccgggctgcaggaattcgcacgagaccattacctagaacatcctaatcgaaaaatcgcacatattattcgagaccaactagcaacatacaaagcacaatagcgtaccaacaatggcagccaaaatattttgcttcctgatgctccttggtctttctgcaagtgttgctaccgcgaccattttcccacaatgctcacaagctcctatagattcacttcttcccccatacctatcaccagcggtgtcttcagtatatgaaaacccaattgttcaaccctacaggatccatcaggcaatcgcaacagggcatcttaccattatcacccttgttgctgcaacaaccgtcagccctattacagcagttacctttggtgcatttgntggcaccaaaacatcagggcacaacaactacaacaacttgtgctagcaaaccttgctgcatactctcagcaacatcaggttcttccattcaaccaactggctgcattagactctgctgcttatttgcaacaacaactaccattcagcccggtagctgctgcctacccccaggaatttcttccattcaaccaactagcagtatttgacctctgctgcttaattaccggaggaacaactactaccatt

SEQ ID NO: 18368 - DNA, 715 bp, Zea mays
  misc_feature: Ceres CLONE 1384359-F
  misc_feature: Encodes the peptide sequence at SEQ ID NO. 18369
  misc_feature (529)..(529): n is a, c, t, g, unknown, or other
  misc_feature (715)..(715): n is a, c, t, g, unknown, or other
catagctggagctccccgcggtggcggccgctctagaactagtggatcccccgggctgcaggaattcgcacgagaccattacctagaacatcctaatcgaaaagttcccctttccctcctgcgcacccgtcttctcctccccgcgtcaaaccccagcacaaaaagcaaccgcccgccgcctcctcgctcctctcccgaatcagccgtcgcggtgcctaatccggccgatcccccctccgatccgcgggtgcccgccgcagaggcggcgcctccgggcctcccccgatgtatagcaacttcaaggagcaggcgatcgagtacgtcaagcaggcggtccaggaggacaatgccggcaactacgtcaaggcgttccctctctacatgaacgcgctcgagtacttcaaaacccacctcaagtacgagaagaaccccaagatcaaggaggccatcaccgccaagttcaccgagtacctccgccgcgccgaggagatccgggcggtcctcgatgaggggtggcgcagggcctggnccccaacggtggcgacgcagctgtcgccacgcgccccagaccaggggcaagggacgggacggaggcaacgtaggtgatgactccgagcagtccaagctgagggcggggctcaactccgccatcatcaccgagaagccaacattaaggtggaacgacgttgccgggctcgagagcgcaagcaggcan

SEQ ID NO: 18369 - protein, 106 aa, Zea mays
  misc_feature: Ceres CLONE 1384359-F
  misc_feature (5)..(73): Pfam Name: MIT Pfam Description: MIT (microtubule interacting and transport) domain
  misc_feature: SWISSPROT Homolog: EC 2.7.11.1 Non-specific serine/threonine protein kinase
  misc_feature (82)..(82): Xaa is any aa, unknown, or other
MYSNFKEQAIEYVKQAVQEDNAGNYVKAFPLYMNALEYFKTHLKYEKNPKIKEAITAKFTEYLRRAEEIRAVLDEGWRRAWXPTVATQLSPRAPDQGQGTGRRQRR

SEQ ID NO: 18370 - DNA, 720 bp, Zea mays
  misc_feature: Ceres CLONE 1384360-F
  misc_feature: Encodes the peptide sequence at SEQ ID NO. 18371
atagctggagctccccgcggtggcggccgctctattactagtggatcccccgggctgcaggaattcgcacgagaccattacctagaacatcctaatcgaaaaatcttgctctgaacgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggtcgtcctggagtacctcgccgctgaggtcctggagctcgccggcaacgctgccaaggacaacaagaagacgcgcatcgtcccgcgccacgtgctgctggcgatccgcaacgacgaggagctcgggaagctgctgaccggcgtgaccatcgcccacgggggggtgttgcccaacatcaacccggtcctgctgcccaagaagacgggggataaagcgtccagccgcgggagcaaggaggccaagtccgccaaaaaaggcggccaggcccccaaaaaggcataagggttggaaggcgaatccgatggtggcctggggtagggttggaagccgggcaatgcgatgggctgggaat

SEQ ID NO: 18371 - protein, 159 aa, Zea mays
  misc_feature: Ceres CLONE 1384360-F
  misc_feature (31)..(104): Pfam Name: Histone Pfam Description: Core histone H2A/H2B/H3/H4
MDATGTGAGGKAKKGAAGRKAGGPRKKSVTRSVKAGLQFPVGRIGRYLKKGRYAQRVGSGAPVYLAVVLEYLAAEVLELAGNAAKDNKKTRIVPRHVLLAIRNDEELGKLLTGVTIAHGGVLPNINPVLLPKKTGDKASSRGSKEAKSAKKGGQAPKKA

SEQ ID NO: 18372 - DNA, 697 bp, Zea mays
  misc_feature: Ceres CLONE 1384361-F
  misc_feature: Encodes the peptide sequence at SEQ ID NO. 18373
  misc_feature (385)..(385): n is a, c, t, g, unknown, or other
  misc_feature (389)..(389): n is a, c, t, g, unknown, or other
aagctggagctccccgcggtggcggccgctctagaatagtggatcccccgggctgcaggaattcgcacgagaccattacctagaacatcctaatcgaaaatcgcacatattattgagacaactagcaacatagaaggcacaatagggtaccaacatggcagccaaaatatttttgctccttatgctccttgggctttctggaagtggtgctacccccaccattttcccacaatggtcaccagctcctatagcttcccttcttcccccatacctatcaccaggggtgtcttcagtatatgaaaacccaattgttcaaccctaccggatccaaccaggaatcgcaacagggatcttaccatcaccccccttgggggggggggaaccntcanccctaatacagcaattaccctttggggcatttgggggcacaaaacatccagggcacaacaactacaacaactttgggctagcaaaccttttgttgatactcccagcaaacataagtttcttccattcaacccaactgggtgcatttaaactcttcttgcttaatttgcaaaaccaactaccatttcggccaggttaggtgcttgccaaccccccaaaaaatttcttcccctttcacccaaataacgagcatttgaacccctgctggtttaattaacggggggaaacaaattaattacctttgcagccg

SEQ ID NO: 18373 - protein, 143 aa, Zea mays
  misc_feature: Ceres CLONE 1384361-F
  misc_feature (79)..(79): Xaa is any aa, unknown, or other
MAAKIFLLLMLLGLSGSGATPTIFPQWSPAPIASLLPPYLSPGVSSVYENPIVQPYRIQPGIATGILPSPPLGGGEPSXLIQQLPFGAFGGTKHPGHNNYNNFGLANLLLILPANISFFHSTQLGAFKLFLLNLQNQLPFRPG

SEQ ID NO: 18374 - DNA, 732 bp, Zea mays
  misc_feature: Ceres CLONE 1384363-F
  misc_feature: Translation starting site: 345
  misc_feature (511)..(511): n is a, c, t, g, unknown, or other
  misc_feature (557)..(557): n is a, c, t, g, unknown, or other
  misc_feature (632)..(632): n is a, c, t, g, unknown, or other
  misc_feature (651)..(651): n is a, c, t, g, unknown, or other
  misc_feature (702)..(702): n is a, c, t, g, unknown, or other
  misc_feature (710)..(710): n is a, c, t, g, unknown, or other
  misc_feature (719)..(719): n is a, c, t, g, unknown, or other
caaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaccccggcgtggccggcaacggcgcgacgttctactttcctggtgntcgccatcctgggccggcgtggtggggcgcggcgtccaagcttggncggcgtgcaccacgtgcgcgcctggcgccacgacagcctggccaccaacgccgcgtcgtcgctcatcgcctgggncatcacggcgctcgccttncggctggccctgcaggagatcacatcgcggaccaccgcgctggcccctgcncgtgctgnaaggcttcntcatcatcctcgc

SEQ ID NO: 18375 - DNA, 696 bp, Zea mays
  misc_feature: Ceres CLONE 1384364-F
  misc_feature: Translation starting site: 344
  misc_feature (312)..(312): n is a, c, t, g, unknown, or other
  misc_feature (360)..(360): n is a, c, t, g, unknown, or other
  misc_feature (481)..(481): n is a, c, t, g, unknown, or other
  misc_feature (487)..(487): n is a, c, t, g, unknown, or other
  misc_feature (527)..(527): n is a, c, t, g, unknown, or other
  misc_feature (532)..(532): n is a, c, t, g, unknown, or other
  misc_feature (541)..(541): n is a, c, t, g, unknown, or other
  misc_feature (542)..(542): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggngggctagctagctgagctcgtgcgacgaagaatggccggaattggcangaacatggtggcgccgctcctggtgctcaacctcatcatgtacatcatcgtcatcggcttcgcgagctggaacctgaaccacttcatcaacgggcagaacaactacccccggcgtggccgncaacgncgcgacgttctacttccctgtggtcgccatcctggcccgncgtgnggggcccgnnctccaagctggcgggcgtgaacacgtgcgcgcctggcgccacgacagcctggccaccacggccgggtcgtcgctcatcgccgtgggcatcacggggctccccttcgggttgccctggaaggaatcccaaatgggggaacccggggttggtcccg

SEQ ID NO: 18376 - DNA, 700 bp, Zea mays
  misc_feature: Ceres CLONE 1384366-F
  misc_feature: Encodes the peptide sequence at SEQ ID NO. 18377
gctcaataactagtggatcccccgggctgcaggaattcgcacgagaccattacctagaacatcctaatcgaaaaatttccatccactccgacaccaatcctccgctccgaccaccgccggagaaatggggcggcgccgccggttcgcgcagctggacgatgacgacgacgacgacgaagacgtgcccatcaatttcaagccctcgggtggcgcctcctcctcggacgccaaacccaggaagccccagccgccgccgcagcagcgccgcggagtctccgatgacgacgacgaggacgtggaggaagtggaacttgaggaggaggaggacgacgagaaggatctcgaggcaatgcgacggggcgaggaggaggagcgccccgagcacgaggccgagacgattactcgccgccgccggggacggccccagcgccgcccaaacccggggagcgaggatgaggagcccgaggagctaaagctgcaaaacgaggaaccccgtgaggcagaaaatcacggaaggcggtgcccgaaactggagggggacccggtccaaaaaccctgcgcaagggggaaaaaagccaaaaaaagaacctatggcttcccttccagagacaagggggcaaacaccctttccaaacttggaagacaccccgtggctttctcctcccccttggaggggcaagcgaattccagatacccccct

SEQ ID NO: 18377 - protein, 192 aa, Zea mays
  misc_feature: Ceres CLONE 1384366-F
MGRRRRFAQLDDDDDDDEDVPINFKPSGGASSSDAKPRKPQPPPQQRRGVSDDDDEDVEEVELEEEEDDEKDLEAMRRGEEEERPEHEAETITRRRRGRPQRRPNPGSEDEEPEELKLQNEEPREAENHGRRCPKLEGDPVQKPCARGKKAKKRTYGFPSRDKGANTLSKLGRHPVAFSSPLEGQANSRYPP

SEQ ID NO: 18378 - DNA, 757 bp, Zea mays
  misc_feature: Ceres CLONE 1384373-F
  misc_feature: Encodes the peptide sequence at SEQ ID NO. 18379
  misc_feature (392)..(392): n is a, c, t, g, unknown, or other
  misc_feature (405)..(405): n is a, c, t, g, unknown, or other
  misc_feature (406)..(406): n is a, c, t, g, unknown, or other
  misc_feature (490)..(490): n is a, c, t, g, unknown, or other
  misc_feature (583)..(583): n is a, c, t, g, unknown, or other
  misc_feature (702)..(702): n is a, c, t, g, unknown, or other
  misc_feature (708)..(708): n is a, c, t, g, unknown, or other
  misc_feature (709)..(709): n is a, c, t, g, unknown, or other
  misc_feature (710)..(710): n is a, c, t, g, unknown, or other
  misc_feature (711)..(711): n is a, c, t, g, unknown, or other
  misc_feature (712)..(712): n is a, c, t, g, unknown, or other
  misc_feature (713)..(713): n is a, c, t, g, unknown, or other
  misc_feature (714)..(714): n is a, c, t, g, unknown, or other
  misc_feature (717)..(717): n is a, c, t, g, unknown, or other
  misc_feature (718)..(718): n is a, c, t, g, unknown, or other
  misc_feature (728)..(728): n is a, c, t, g, unknown, or other
  misc_feature (729)..(729): n is a, c, t, g, unknown, or other
  misc_feature (730)..(730): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (735)..(735): n is a, c, t, g, unknown, or other
  misc_feature (736)..(736): n is a, c, t, g, unknown, or other
  misc_feature (737)..(737): n is a, c, t, g, unknown, or other
  misc_feature (739)..(739): n is a, c, t, g, unknown, or other
  misc_feature (741)..(741): n is a, c, t, g, unknown, or other
catagctggagctccccgcggtggcggccgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagagggaatgcnnagagcgagtgccgcgagcggcaccagcaagctgacgcgggcgaggacggcgacagcggcgtggacgcctacgtctccgctccgnaaaggggcgagtgccggcgccagtgcctgcgcccgcacgagggcccagccgtggaggaccccagagtgcatgaggcggtgccgccggcgcggnactgggcgtcgacatggagccaagagtacggtcgcggcagcgagagcgcggcaagtgccccgggagaagtgcgagcgccacaccgcggggacttgggtgggaaagcagcctgctggtgnaaaaannnnnnnggnngggggggggnnnnnnnnnngncnacggggccccccccct

SEQ ID NO: 18379 - protein, 74 aa, Zea mays
  misc_feature: Ceres CLONE 1384373-F
  misc_feature (64)..(64): Xaa is any aa, unknown, or other
MGKGSVGASWWAFLLLAGVLLVVAATAGAEDGVVERDRKEDLRWCKQACEWQYGKDTPRKRECXERVPRAAPAS

SEQ ID NO: 18380 - DNA, 728 bp, Zea mays
  misc_feature: Ceres CLONE 1384375-F
  misc_feature: Encodes the peptide sequence at SEQ ID NO. 18381
  misc_feature (641)..(641): n is a, c, t, g, unknown, or other
aaagctggagctccccgcggtggcggccgctctagaactagtggatcccccgggctgcaggaattcgcacgagaccattacctagaacatcctaatcgaaaaacactgggtgaccatcatcatcagtaactaataattactttagattagaagcaaagggaagcgaagcaagaatcgatcgagtcgagaagatggtgcagttcggcaagtggctgaggaggcagatcgagcggagcctcccggagtggcaggaccagttcctgcgctacaaggagctgaagcggtgcgtcaaggcccgctccggcggctgcccgccgttgcccgcggaggaggccgagttcgtggccgagatcgacgcggagaccgagaaagatcacgccttcttccctcgacaggaggaggagttcatcatccgccaccgggagctgcagaaccacatcgagcgcgcgctgggcccgcgcaggccggcgccggcgccggcgctgcacgaagccgaggtcgccgccatccgcagggagatcgtccacttccacggcgtcatggtgctgctccctcactacagcagcatcaactacataggtaggacttaggagctctagctctagctagctagctgtacggaggttgattgaaagcctgcnagtctgtcctttttgccatggatgtctcctctccatgcatgatgattctaaccaatcccggttcatccctcatgtctggctggctgt

SEQ ID NO: 18381 - protein, 132 aa, Zea mays
  misc_feature: Ceres CLONE 1384375-F
  misc_feature (2)..(133): Pfam Name: SPX Pfam Description: SPX domain
MVQFGKWLRRQIERSLPEWQDQFLRYKELKRCVKARSGGCPPLPAEEAEFVAEIDAETEKDHAFFPRQEEEFIIRHRELQNHIERALGPRRPAPAPALHEAEVAAIRREIVHFHGVMVLLPHYSSINYIGRT

SEQ ID NO: 18382 - DNA, 725 bp, Zea mays
  misc_feature: Ceres CLONE 1384376-F
  misc_feature (350)..(350): n is a, c, t, g, unknown, or other
  misc_feature (361)..(361): n is a, c, t, g, unknown, or other
  misc_feature (369)..(369): n is a, c, t, g, unknown, or other
  misc_feature (373)..(373): n is a, c, t, g, unknown, or other
  misc_feature (394)..(394): n is a, c, t, g, unknown, or other
  misc_feature (524)..(524): n is a, c, t, g, unknown, or other
  misc_feature (630)..(630): n is a, c, t, g, unknown, or other
aaagctggagctccccgcggtggcggccgctctagaactagtggatcccccgggctgcaggaattcgcacgagaccattacctagaacatcctaatcgaaaacccgtcctcggtcctccatcagtagtaaccactcctcgtcgtctctctcgcggtctcgcctcctgcagctagcgctcgccagaaagggaaaccgcatctgctccagcctcccgtcccgtctcggcgccgccgcctgatcgaccagagcccagcgcggggcgtcgaggccgtccggggcgggtccggcgctcagatctgaggcgagtagcaagcgaagaacatgcagatgcaggtcggaggaggcgcgnccgacagcccnggcgctgncgcngcgggcgggcgcgaagccccnccccgagccgctacgagtcgcagaagcggcgggactggcacacgttcgggcagtacctgcgcaaccaccggccgccgctggagctggcgcggtgcaacgccgcgcacgtgctcgagttcctgcgctaccntcgacagttcgggaagacccagggccacgcgccggggttgccccttcttcggccacccgtcgccgcccgggccgtgcccgtgcccgctgcggaaggcctggggaancctcaacgcggtcatcgggcgcctgggcccggccttcaaggaacacggggggccggcccaagggcaaccccttcgggggcccggggcctggggcc

SEQ ID NO: 18383 - DNA, 738 bp, Zea mays
  misc_feature: Ceres CLONE 1384377-F
  misc_feature: Encodes the peptide sequence at SEQ ID NO. 18384
  misc_feature (384)..(384): n is a, c, t, g, unknown, or other
  misc_feature (510)..(510): n is a, c, t, g, unknown, or other
  misc_feature (526)..(526): n is a, c, t, g, unknown, or other
  misc_feature (546)..(546): n is a, c, t, g, unknown, or other
  misc_feature (574)..(574): n is a, c, t, g, unknown, or other
aaagctggagctccccgcggtggcggccgctctagaactagtggatcccccgggctgcaggaattcgcacgagaccattacctagaacatcctaatcgaaaagctggccttttccctcacacaagtcacacgcacacccgctagcccccgtcccccgtcccgcccgtaccttcctccgccgcctccgtcctcgttccaaccgtgggcagcaggcaggcccaagtatctgcagtagattggtggagaggaagaagacggcaggcacccacgcagatcaaacgtgctccgccacccttggtttcggcgaatcggcgccgtacgccgtaaatcgagccgtctccgagcagatcgacgcgctgcatagcaattcgacccgtctccggncaaatcgacgtccagagctgcaaattgacccatctccgcgctgacctccgcttgtgcctgccgagggagcgcgaaagtacgcccttctcgtgaagacatccttgataaacctgatggctatcgcgnagagctgtgttgatgncgtggtcatggagatggtgnctgtctactgcggtggcctctatgccgncaaagcagagcttgctgccccgcgcattgaggcgcatcgctttcagggttggcaccagctctctgagagatatacatggagcgtccacgattagtgatcatcttgaagcatcaaatttatctgcaaagacttctggtcagagctgttcaaaaaacagattgaca

SEQ ID NO: 18384 - protein, 56 aa, Zea mays
  misc_feature: Ceres CLONE 1384377-F
  misc_feature (5)..(5): Xaa is any aa, unknown, or other
  misc_feature (10)..(10): Xaa is any aa, unknown, or other
  misc_feature (17)..(17): Xaa is any aa, unknown, or other
  misc_feature (26)..(26): Xaa is any aa, unknown, or other
MAIAXSCVDXVVMEMVXVYCGGLYAXKAELAAPRIEAHRFQGWHQLSERYTWSVHD

SEQ ID NO: 18385 - DNA, 720 bp, Zea mays
  misc_feature: Ceres CLONE 1384378-F
  misc_feature: Translation starting site: 186
  misc_feature (387)..(387): n is a, c, t, g, unknown, or other
  misc_feature (395)..(395): n is a, c, t, g, unknown, or other
  misc_feature (428)..(428): n is a, c, t, g, unknown, or other
  misc_feature (445)..(445): n is a, c, t, g, unknown, or other
  misc_feature (446)..(446): n is a, c, t, g, unknown, or other
  misc_feature (452)..(452): n is a, c, t, g, unknown, or other
  misc_feature (462)..(462): n is a, c, t, g, unknown, or other
  misc_feature (464)..(464): n is a, c, t, g, unknown, or other
  misc_feature (563)..(563): n is a, c, t, g, unknown, or other
aaagctggagctccccgcggtggcggccgctctagaactagtggatcccccgggctgcaggaattcgcacgagaccattacctagaacatcctaatcgaaaacttagccgcgcggacgcccaccagcagctgccccttgctgtcgccgcctctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgtgggcgccgcttctccacatcgtctgcaagaaggcgacatcgacatgaacaagagggccgtgagctgacgcctgaaaagctggagcgcctgatgancgtcgtgnccaaccctaagcagttcaaggtgccggactggntcccctcacagaagaanngatacnaggatggaangntctcacaggtcgtgtccacgccctcgacatgaagctccaggacgacctcgagagggctcagaagatcagaaccaccgtggtctgcgtcactactggggncctcggtgtcgtggacagcacaccaagaccactgggaggcggtgaaaaaactgttggtgtctccaagaggcggatagctacatatctatcgacaaatctcaaaggaactaagggtgggtcatggtccaaactgccttgatgaaggtttcctggtgga

SEQ ID NO: 18386 - DNA, 727 bp, Zea mays
  misc_feature: Ceres CLONE 1384381-F
  misc_feature (412)..(412): n is a, c, t, g, unknown, or other
cataagctggagctccccgcggtggcggccgctctagaactagtggatcccccgggctgcaggaattcgcacgagaccattacctagaacatcctaatcgaaaagtccccttcctccccttccgtctcgcaacaggcgaggcgagagaactcgtcgtcgaagcgaaatatagccagcgcaccaatcccaattcccaacccgacgcaacgcaacgcaacgcaacgcacctcatcccggttgcttgcgccaacgtaggggatcgcctcgccgcgccccgccccgccccgccccgcttcgcgctcctccttcctgcctgccgtaaccgcgccgtgcagctgtgcaaggttcagtaggttgttgagtctacataccagatgatggacgtgtcacgacttcagtgctggcagctaangcttacaaaatacaaggagaatcactggttaaggagtacctccttgcaaattcgtatgtttcatacactgctggacttggggggaatcctgatgtgcaagatgtcttaatgcataaccaggctaatccgcttcttggaataaaagggttatggttcctttaaaaaaacccaaaagttgggtgggaaaaacggggaattgcccctttcctggggaattccttcccgggggggcggggaccctgggtttctttcccaccctatttctgggggggtgggggggaaaaaaacttttcgggggtcaaacttacccatttt

SEQ ID NO: 18387 - DNA, 594 bp, Zea mays
  misc_feature: Ceres CLONE 1384385-F
  misc_feature: Encodes the peptide sequence at SEQ ID NO. 18388
tggagctcaccgcggtggcggccgctctagaactagtggatcccccgggctgcaggaattcgcacgagaccattacctagaacatcctaatcgaaaaacaccaagaaaccatacaccatccgccacgaccacgactccacgagagagcggaggaggagggggagcaatgtgatagtcggggcagcagttgctgcggtctgtcgtggaggtggcagcgggctcgcacttccctatccatgacctgtccttccgggtcctccggcggcggtggtcgccaacgtaggatccgctccccccgggtgacatgggagatttggggatcgaactccgcaccgtcggcgaagcgggtctcttcgacgtggccgcgctctccggggtgccgtgggtgcaacaagagacgctcaacatggtcttggggatgtgtccaccgcctggatggaaggtcgcgccaagctaaaaaaatcctctctcacgaacaggcagtcttgcgtggaaactagccctgagggataaatggcttattccatgagtgtatcgagatggttctacaatcgaggatgaaggtaaccgatttctttggtcgggggacatgca

SEQ ID NO: 18388 - protein, 50 aa, Zea mays
  misc_feature: Ceres CLONE 1384385-F
MGDLGIELRTVGEAGLFDVAALSGVPWVQQETLNMVLGMCPPPGWKVAPS

SEQ ID NO: 18389 - DNA, 641 bp, Zea mays
  misc_feature: Ceres CLONE 1384386-F
  misc_feature: Encodes the peptide sequence at SEQ ID NO. 18390
gctggagctccccgcggtggcggccgctctagaactagaggatcccccggactgcaggaattcctgcgagagcattacctagcaacatgcctaatcgaaaaacgacaggtaccacctgaccagctgccgagggaggaaaggaaccctaatgaaacactgtgcaggtgacggcggcgcgctaccggtgacgaggcatacggcggcatcgtccccctcgtgccctgcctaccatccccagtgtgacatgaccagcatgctagctgcagatggatcgcaaggatagcctctcctgatcctactcaacagctacagagatgccagtcatcactggcgagcatagctgcttcgacctcaaagacaaagcacaggatccaaccagcggatgctcgcaacgtcccagcaagaccatcacaacctattaacctttcaaatgatacagaaaggctgcagcacatcagttcaattaggagatctcctgttgaagcacagatcacgattgtcatcgaacttctttacgagacaagacaagcttttactgcagagcagataagtgaagcaactgatgttgatattcacggtaataaagctgtctttgacagcttgagaaactgccccaaagtaagatatgacggcacgcgtct

SEQ ID NO: 18390 - protein, 35 aa, Zea mays
  misc_feature: Ceres CLONE 1384386-F
MPVITGEHSCFDLKDKAQDPTSGCSQRPSKTITTY

SEQ ID NO: 18391 - DNA, 611 bp, Zea mays
  misc_feature: Ceres CLONE 1384388-F
  misc_feature (384)..(384): n is a, c, t, g, unknown, or other
  misc_feature (385)..(385): n is a, c, t, g, unknown, or other
  misc_feature (511)..(511): n is a, c, t, g, unknown, or other
  misc_feature (514)..(514): n is a, c, t, g, unknown, or other
aagctggagctccccgcggtggcggccgctctagaactagtggatcccccgggctgcaggaattcgcacgagaccattacctagaacatcctaatcgaaaaaagatgttgttcgaggcgttcccctcctccacgcaaccttctcccctccagatccaggattgccgggctccttgactcgttacctcgcgcgccctcggtgagctactttgtttcgatttagcgacaaatcagtttgcttcatgttgcgcaggcttagatctgaatgccggattcttcgtcttacggcttgaatcgagctgggaggctgtggatctgagcacgggaggtacaacaaatccgcgtgtatgacgagttggatcggcaccggttagtctctgaccgnncagatttgttgttgtgttgggctgatctggcgcgttgttttgcttcagggtctagagctagcgaaatcgccaggctatttagggtccttttcggagcgcgtctgaagcgatgatggctgaaatcgncgntggggatcgggatcttctctggcctggtccaatcgggatgatgaatctgctgcgctgataataatggatggatttcgaaaatattagatcttagaga

SEQ ID NO: 18392 - DNA, 612 bp, Zea mays
  misc_feature: Ceres CLONE 1384394-F
  misc_feature (573)..(573): n is a, c, t, g, unknown, or other
gctggagctcaccgcggtggcggccgctctataactagtggatcccccgggctgcaggaattcgcacgagaccattacctagaacatcctaatcgaaaatccatccccgcgacgacccaccacccacccctgaagtctgcagcatccccttccccactcccggctggtctgctgcggacacccctgcgacgaaccacctccgctgcttcctgcctcattatattcgcccgcctcgtcgcctccgaccccgccacagaaggacttccagaaccctccaacccctcaactccgctccgactcgttcctctctcctcctcccgagccagccgactccgatggacgtacacgaggccgccgtagtcgaccacgccgcgccgtcggtgaaataggaggaacggcgagcggtctactgccgatggcgccaactgaagccgagctcgttacagagtatctggataacctgtacttgttcctcaagcccatgagcaactagcataggacattatgatcatctcagaggaggatgttacgccaatagcgatatcgcccaagacaacacatgcacgatgcagntagaaatataagtacctgctgaaacattgcttgtggaag

SEQ ID NO: 18393 - DNA, 655 bp, Zea mays
  misc_feature: Ceres CLONE 1384400-F
  misc_feature: SWISSPROT Homolog: EC 1.3.1.26 Dihydrodipicolinate reductase
  misc_feature (467)..(467): n is a, c, t, g, unknown, or other
  misc_feature (488)..(488): n is a, c, t, g, unknown, or other
  misc_feature (501)..(501): n is a, c, t, g, unknown, or other
aaagctggagctccccgcggtggcggccgctctagaactagtggatcccccgggctgcaggaattcgcacgagaccattacctagaacatcctaatcgaaaaaaaccgttcgtctagcttggctgttggttcgtccctgtccggtacccttctctcaactctcaagccgcgcagttgtcgaagtcgaaactatccgctgctgtagtagagatgctctcgatgcggccacccagcaccaccttgtcccgccggccgagacggggtcgcctcgggggagccgccgcgccgcaatatgttagcgctgcggcaccggcgcccgctctggagccagctgcgcctccggagagcgtctcctttccgattctggtgaatggctgcactggtaacatggggttatctgtcgctgaggctgctgctctgaggggccttcacctagtccctgtttcattcagcagtagagagaaggntgaaaaacaatgcaagttggnacaacagacattncaatatatggtccttctaaaagagaagatgtctttcatctattgctgatgatttcccagatgtcattgttgtggactacacaggaccccggtctggggactctaatgctgaactctatgcaagcttggattgccatttgggatgggcaacacgg

SEQ ID NO: 18394 - DNA, 659 bp, Zea mays
  misc_feature: Ceres CLONE 1384407-F
  misc_feature (189)..(189): n is a, c, t, g, unknown, or other
  misc_feature (202)..(202): n is a, c, t, g, unknown, or other
  misc_feature (285)..(285): n is a, c, t, g, unknown, or other
aaagctggagctccccgcggtggcggccgctctagaactagtggatcccccgggctgcaggaattcgcacgagaccattacctagaacatcctaatcgaaaactgcacacattccgcgcacaccccggcagccgcaaacgccttcgccgtcgcgtcccgctcctccgccccgccgacgcgacccctaangactggagagagnaggtcgcatggctgccgcagtggtcgacgacgctggtatggacgccgtcagaaaccgctcatggtcaaagacaatgcattttngtggacaaacaggaaaaggtggttggccatgatcaaggacaactgccctttggaggaaaaattggtttgggaaacggtcaaaagggtttccggggggcccttttcacccaaaaaaggggcggactcccaaaaaggcccggaaaagggcaccttcttttattggaaaaaaagtggggcgcccccctttggggggggggggggattataaaaaaaaaattttggggggaaaagacgcccaaaaaactttttggggtgtgtgtctcccaaaaaaaagaaggcgggaaacccccccccccccgggaagggttttttcaccccccccccggggggggggggggggtctttcctctccctcccccccccagagggaaaaa

SEQ ID NO: 18395 - DNA, 744 bp, Zea mays
  misc_feature: Ceres CLONE 1384408-F
tacccgcggtggcggccgctctagaactagtggatcccccgggctgcaggaattcgcacgagaccattacctagaacatcctaatcgaaaaagaccgtgacaagttcatcatccagccccgcttgcgcttgaccccttcaagtccaagcattccattccatccagtaccttccttgtcaccttgaccttccccctcccttcctagtcccctactcgccagtccacaggacctcgaccccgctaagcaagctccaagagcgatcgccgcagaagatcccgcgatgcaggccccgccggcgccctcctccgtcgacctgccgctggcggtggcgccgccgccggtgaaggcgccgaccccgcggcccccgcccccggcctcgctgcaccccgaggtcccgggggtcttcttctccgccgccgccgccgccgcgcccctgggcaccgaccaccgccgcatcggcatcgccgtcgacctctccgacgagtccgccttacgccggaggctgaaccgacttcaattaactccgcccccggggaagccgggaaccctggtccacgtgggaccccaactccgtgctcataaagctccgaacggagccgccgtcgaatgttaccctgccccaacctaatggcccccccccgccctcccgaggaaagcaaaatgaggaatgtccaaaacccgccccttgccttggggaaagaaacggaagctacgcactcactgacccccttaagaggaggcgc

SEQ ID NO: 18396 - DNA, 651 bp, Zea mays
  misc_feature: Ceres CLONE 1384432-F
  misc_feature: Encodes the peptide sequence at SEQ ID NO. 18397
  misc_feature (568)..(568): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
aagctggagctccccgcggtggcggccgctctagaactagtggatcccccgggctgcaggaattcgcacgagaccattacctagaacatcataatcgaaaactttcctagggtttcgtcgcttccagccgccgccgcgtccgcctcgccaagcgcagcagccgccgcagcacatcgctctcttgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcggggcgctactccaagaagcggttccgcaaggcgcagtgcccgatcgttgagcgccttacaaactccctcatgatgcacgggcgcaacaacggcaagaaggtcatggctgtccgcatcatcaagcataccctggagatcattcacctgctcaccgatgccaaccccatcccaggtcgtccgtcgacgcgatcatcaacagtggccccccgtgaggatgcaaccccgtattgnttccccccctggtgttgnnngaaaaagccagggcccgtggatatctcaccccccggggagggagggggtgaaccaggccatct

SEQ ID NO: 18397 - protein, 152 aa, Zea mays
  misc_feature: Ceres CLONE 1384432-F
  misc_feature (44)..(120): Pfam Name: Ribosomal_S7 Pfam Description: Ribosomal protein S7p/S5e
  misc_feature (125)..(125): Xaa is any aa, unknown, or other
  misc_feature (131)..(131): Xaa is any aa, unknown, or other
  misc_feature (132)..(132): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIPGRPSTRSSTVAPREDATPYXFPPWCXXKKPGPVDISPPGEGGGEPGH

SEQ ID NO: 18398 - DNA, 628 bp, Zea mays
  misc_feature: Ceres CLONE 1384433-F
  misc_feature: Translation starting site: 364
  misc_feature (370)..(370): n is a, c, t, g, unknown, or other
  misc_feature (389)..(389): n is a, c, t, g, unknown, or other
  misc_feature (523)..(523): n is a, c, t, g, unknown, or other
  misc_feature (524)..(524): n is a, c, t, g, unknown, or other
  misc_feature (617)..(617): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggtcggaatttgacagaacatggtgncgccgctcctggtgctcancctcatcatgtacatcatcgtcatcggcttcgcgagctggaaactgaacccacttcatcacgggcagaccaactaccccggcgtggccggaacgacgcgacgttctacttcctggatgtcgcccatctggccgnngtgatgggcgccgcgtccaagctagcgggcgtgcaccacgtgcgcgcctgccgcacgacagcctggccaccaacgccgcgtcgtcgctcatcngctgggccatc

SEQ ID NO: 18399 - DNA, 625 bp, Zea mays
  misc_feature: Ceres CLONE 1384437-F
  misc_feature: SWISSPROT Homolog: EC 4.1.2.13 Fructose-bisphosphate aldolase
  misc_feature (254)..(254): n is a, c, t, g, unknown, or other
  misc_feature (302)..(302): n is a, c, t, g, unknown, or other
  misc_feature (374)..(374): n is a, c, t, g, unknown, or other
  misc_feature (375)..(375): n is a, c, t, g, unknown, or other
  misc_feature (392)..(392): n is a, c, t, g, unknown, or other
  misc_feature (400)..(400): n is a, c, t, g, unknown, or other
  misc_feature (411)..(411): n is a, c, t, g, unknown, or other
  misc_feature (526)..(526): n is a, c, t, g, unknown, or other
  misc_feature (532)..(532): n is a, c, t, g, unknown, or other
aaagctggagctccccgcggtggcggccgctctagaactagtggatcccccgggctgcaggaattcgcacgagaccattacctagaacatcctaatcgaaaaccatcatctgccaggagaacggtctggtgccaattgttgagcctgagatccttgttgatggccctcatgacattgatcgctgcgcttacgtcactgagacagtccttgctgcctgctacaaggctctcaacgagcaccatggtcctcctggnaggtaccctccctgaaagcccacatggtgactcctggctccgactctnagaaggtgacaccctgaggtgatcgcccagtacaccgtccgtaccctccagaggaccgtccctgctgctggnncttgctggtgtcttccntctcccgnggacagagcgnaaggagaaggccaccctgaatctcaatggcatgaacaagctcagcaccaagaagccatggggccctgtcctctcccccttcgggcgtgcccctccaggcgggcaccctcaagggnctggcnttgggcagagtggaaaaaaagggggggaaaaaggtttaagagcgccctttcctcgcccaggtgcaagcccaaactccaaggctaccctcgacc

SEQ ID NO: 18400 - DNA, 650 bp, Zea mays
  misc_feature: Ceres CLONE 1384445-F
  misc_feature (438)..(438): n is a, c, t, g, unknown, or other
  misc_feature (439)..(439): n is a, c, t, g, unknown, or other
  misc_feature (455)..(455): n is a, c, t, g, unknown, or other
  misc_feature (456)..(456): n is a, c, t, g, unknown, or other
  misc_feature (502)..(502): n is a, c, t, g, unknown, or other
  misc_feature (540)..(540): n is a, c, t, g, unknown, or other
caaagctggagctccccgcggtggcggccgctctagaactagtggatcccccgggctgcaggaattcgcacgagaccattacctagaacatcctaatcgaaaaagaatcatcgtcacccggagcctctccttcccggtctcctccgcccgttgccttcgtcccctccatctccggctgcgtcgccggcgagcccgacaccgcgaatcggatccgccgacaaggcgagagggaagagatggggctcacgttcaccaagctgttcagccggctgttcgccaagaaggagatggcggatcctgatggtgggactcgacgccgccggaaagaccaccatcctctacaagctgaagcctcggcgagatcgtcaccaccatccccaccatcggattcaatgttgaaaactgtggagtacaagaaatcagcttcctgggtctggnntaggtcgggggccagnnacaagatcaggcccactggtggaggcattacttccagaacacccanggtctcaatcttttgttgtggacagcaaggataggggnacccgtggttgttgaaagcaagggatgagcttcaccgaatgctggaatggaggatgagtaacgtgaatggttgggtttgctttgtgtttgctaacaagcaagatcttcct

SEQ ID NO: 18401 - DNA, 646 bp, Zea mays
  misc_feature: Ceres CLONE 1384452-F
  misc_feature: Encodes the peptide sequence at SEQ ID NO. 18402
  misc_feature (538)..(538): n is a, c, t, g, unknown, or other
  misc_feature (632)..(632): n is a, c, t, g, unknown, or other
aagctggagctccccgcggtggcggccgctctagaactagtggatcccccgggctgcaggaattcgcacgagaccattacctagaacatcctaatcgaaaacccatttcgaagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgtgcccggaccccagcgaggggggtggcggcgatctccnaagggggggaaagggtagggccgaaccggtgcagcgctgcaaaggaaagaggggttggacttacgggattcaaactgtggcggtggttgggaancttggtactggcgc

SEQ ID NO: 18402 - protein, 111 aa, Zea mays
  misc_feature: Ceres CLONE 1384452-F
  misc_feature (14)..(38): Pfam Name: zf-A20 Pfam Description: A20-like zinc finger
MEHKEAGCQAPEGPILCINNCGFFGSAATMNMCSKCHKEMITKQDQAKLAASSIDSIVNGSDAVMEPVVAGSNTVVAVAQVELQTMNVQQPADVPGPQRGGWRRSPKGGKG

SEQ ID NO: 18403 - DNA, 655 bp, Zea mays
  misc_feature: Ceres CLONE 1384457-F
  misc_feature: Encodes the peptide sequence at SEQ ID NO. 18404
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (486)..(486): n is a, c, t, g, unknown, or other
  misc_feature (498)..(498): n is a, c, t, g, unknown, or other
  misc_feature (530)..(530): n is a, c, t, g, unknown, or other
  misc_feature (541)..(541): n is a, c, t, g, unknown, or other
  misc_feature (620)..(620): n is a, c, t, g, unknown, or other
aagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccactaccccgggcgtggcggaannnggncgcgacgtcacnttttccctggtgtccgcatccgggcccccccnttgtgggggcncccccccgtcccaacttttgggggggggggcccccccgtggcggcgccggggggcccccggccggccttggcccaccanccgcccgcggtcgtcgcctcaatccgcctggggct

SEQ ID NO: 18404 - protein, 104 aa, Zea mays
  misc_feature: Ceres CLONE 1384457-F
  misc_feature (47)..(47): Xaa is any aa, unknown, or other
  misc_feature (63)..(63): Xaa is any aa, unknown, or other
  misc_feature (67)..(67): Xaa is any aa, unknown, or other
  misc_feature (93)..(93): Xaa is any aa, unknown, or other
MAGIGRNMVAPLLVLNLIMYIIVIGFASWNLNHFINGQTTTPGVAEXGRDVTFSLVSASGPPXCGGXPPSQLLGGGAPPWRRRGAPGRPWPTXRPRSSPQSAWG

SEQ ID NO: 18405 - DNA, 673 bp, Zea mays
  misc_feature: Ceres CLONE 1384473-F
  misc_feature: Encodes the peptide sequence at SEQ ID NO. 18406
  misc_feature (639)..(639): n is a, c, t, g, unknown, or other
aagctggagctccccgcggtggcggccgctctagaactagtggatcccccgggctgcaggaattcgcacgagaccatacctagaacatcctaatcgaaaagtctcaggttgcggccgaaccagagccccgtcccaactccaccacctctcttctctacggcgcgagcaagggcggcgccggccgcggcgtcggcgggaaccgggcctcgctctccccatctctccgatcacttctgtcctgtgaaaatggcggatgaactacgctcaacgtctgtgggtcagaagttccatgggcagtccgtgctgttgagcagaatctcttcctattccgccatgaacaaccctgtattcaacaatgcctattctgcttacaatgtgccccagaggtcatatcatgggatgaatgcaactgctggactctcatctgtcatggcaccatctcctgtctttgcttctgccccaaaagagaaaggcttttctgggatttatgatcgactttatgaatggggtgggagttttctgctgctgtctccaagacagctgcagctcccgattgagcggtgtcaaggcttttgattcagaaaccaggatggaatggctcaaagactggcaggctttctgacccgtacaaaagggggnaattggggggactggctttggcgacataaaaaaa

SEQ ID NO: 18406 - protein, 109 aa, Zea mays
  misc_feature: Ceres CLONE 1384473-F
MADELRSTSVGQKFHGQSVLLSRISSYSAMNNPVFNNAYSAYNVPQRSYHGMNATAGLSSVMAPSPVFASAPKEKGFSGIYDRLYEWGGSFLLLSPRQLQLPIERCQGF

SEQ ID NO: 18407 - DNA, 629 bp, Zea mays
  misc_feature: Ceres CLONE 1384475-F
  misc_feature: Encodes the peptide sequence at SEQ ID NO. 18408
  misc_feature (558)..(558): n is a, c, t, g, unknown, or other
  misc_feature (611)..(611): n is a, c, t, g, unknown, or other
tccccgcggtggcggccgctctagaactagtggatcccccgggctgcaggaattcgcacgagaccattacctagaacatcctaatcgaaaaatcatcatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactaacgccgggtgtgggcagccgagcgccatgttccagccgctccggcaacagtgctgccacagcagatggaggaatgatggacgtgcagtccgtcgcgcagcagctgcagaatgatgatgcagcttgagcgtgccgctgccgccagcagcagcctgtacgagccagctctgatgcagcagcagcagcagctgctggncagcccagggtctcaacccttggcccatgatggatggcgcagaaatgcccggnccatggggtggactctac

SEQ ID NO: 18408 - protein, 69 aa, Zea mays; identical to SEQ ID NO: 13934
  misc_feature: Ceres CLONE 1384475-F

SEQ ID NO: 18409 - DNA, 647 bp, Zea mays
  misc_feature: Ceres CLONE 1384476-F
  misc_feature: Encodes the peptide sequence at SEQ ID NO. 18410
  misc_feature (525)..(525): n is a, c, t, g, unknown, or other
  misc_feature (647)..(647): n is a, c, t, g, unknown, or other
ggagctccccgcggtggcggccgctctagaactagtggatcccccgggctgcaggaattcgcacgagaccattacctagaacatcctaatcgaaaaaagcattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctccagtacatcagcggtgtgatcctcttcgaggagaccctctaccagaagaccaaggatggcaagctttttgtcgatgtcctcaagggagggaggcgtcctccctggcatcaaggtcgacagggcacccatttgaggttgttggcaccgacnaggagaccaccacccagggccacgataacctcggcagcgctgcgtaagtactaccgagccggtgccgctgggcccaggggggcggtgctggtcctcaagatggcccccaacgagcccgcacn

SEQ ID NO: 18410 - protein, 156 aa, Zea mays
  misc_feature: Ceres CLONE 1384476-F
  misc_feature (11)..(153): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYADELIKNAAYIGTPGKGILAADESTGTIGKRLSSINVENVEENRRALRELLFCCPGALQYISGVILFEETLYQKTKDGKLFVDVLKGGRRPPWHQGRQGTHLRLLAPTRRPPPRATITSAALRKYYRAGAAGPRGAVLVLKMAPNEPA

SEQ ID NO: 18411 - DNA, 613 bp, Zea mays
  misc_feature: Ceres CLONE 1384487-F
  misc_feature: Encodes the peptide sequence at SEQ ID NO. 18412
  misc_feature (387)..(387): n is a, c, t, g, unknown, or other
  misc_feature (390)..(390): n is a, c, t, g, unknown, or other
  misc_feature (391)..(391): n is a, c, t, g, unknown, or other
  misc_feature (405)..(405): n is a, c, t, g, unknown, or other
  misc_feature (423)..(423): n is a, c, t, g, unknown, or other
tggagctccccgcggtggcggccgctctagaactagtggatcccccgggctgcaggaattcgcacgagaccattacctagaacatcctaatcgaaaaatcaatcaaatactcacaagcatggggcaccaggcgcagcacgccacggacgacaccgaggagctgctggcagcgcaccgcgagctgtggtgccatgccctgggctacgtcaagtccatggcgctcaaatgcgccttggacctgcgcatccccgacaccatccaacgctgcggcggaagcgccaccctaggccagctgctcgccgccagcgaggtcccggcgtccaacctcggctacctccgacgggtcatgcgcacgctgacagcatcgcatttttttcccggggcggnggnncccgggtcccgccngggcccggcgacgctggngaacgacgcggaccggccgtcttctaccgggttcccccccggggtcccggccgggttcgcccccggggacgaacaacgacgaggccccgaaaaaaaatcgggaggaaaaattcccaaaatttccccgccaggtccgggcaaaaaaaagttcccccccccggttcccactggccccagaagggaaaaaaac

SEQ ID NO: 18412 - protein, 165 aa, Zea mays
  misc_feature: Ceres CLONE 1384487-F
  misc_feature (33)..(81): Pfam Name: Dimerisation Pfam Description: Dimerisation domain
  misc_feature: SWISSPROT Homolog: EC 2.1.1.146 (Iso)eugenol O-methyltransferase
  misc_feature (90)..(90): Xaa is any aa, unknown, or other
  misc_feature (91)..(91): Xaa is any aa, unknown, or other
  misc_feature (96)..(96): Xaa is any aa, unknown, or other
  misc_feature (102)..(102): Xaa is any aa, unknown, or other
MGHQAQHATDDTEELLAAHRELWCHALGYVKSMALKCALDLRIPDTIQRCGGSATLGQLLAASEVPASNLGYLRRVMRTLTASHFFPGAXXPGSRXGPATLXNDADRPSSTGFPPGVPAGFAPGDEQRRGPEKKSGGKIPKISPPGPGKKKFPPPVPTGPRREKN

SEQ ID NO: 18413 - DNA, 656 bp, Zea mays
  misc_feature: Ceres CLONE 1384495-F
  misc_feature: Encodes the peptide sequence at SEQ ID NO. 18414
  misc_feature (505)..(505): n is a, c, t, g, unknown, or other
  misc_feature (628)..(628): n is a, c, t, g, unknown, or other
  misc_feature (629)..(629): n is a, c, t, g, unknown, or other
  misc_feature (635)..(635): n is a, c, t, g, unknown, or other
  misc_feature (636)..(636): n is a, c, t, g, unknown, or other
aagctggagctccccgcggtggcggccgctctagaactagtggatcccccgggctgcaggaattcgcacgagaccattacctagaacatcctaatcgaaaaactcacaaagaagccggggacggagagcagagagcttcagcgcaactgtgctcaatcgtttcttcgtctttagttggtgcttggtctccctccgtcctctgtttcccaaacagaggtgtctcagctgactcttttgcttgctagcaaaatagcacactctctctctagagctgagcaccaccttgctgaaggcagctagctagcgacgaccatggtctcctcggacaccatccgcacggccatcggcgtcatcggtgggtagtagtcaatacctgcttagcaatgggaccgccctagtgctcttcctctccccggtgcctacgttcatccgatctggaagaaaggggtcggtggagcagtactcgccgatcccgtacgtggcgacgctgtgaatgcttggaagntgggggggggttgtacgggcttggccgctggtgcacccgcacagccaatgctgggtgatcaccatcaaacgggcaccgggcatgcttcatcccagctggaccctaacgtggcgctcttctcgnntaaatnncccggggggggggggcggcg

SEQ ID NO: 18414 - protein, 54 aa, Zea mays
  misc_feature: Ceres CLONE 1384495-F
  misc_feature (4)..(4): Xaa is any aa, unknown, or other
  misc_feature (46)..(46): Xaa is any aa, unknown, or other
  misc_feature (48)..(48): Xaa is any aa, unknown, or other
MLGXWGGVVRAWPLVHPHSQCWVITIKRAPGMLHPSWTLTWRSSRXNXPGGGGG

SEQ ID NO: 18415 - DNA, 634 bp, Zea mays
  misc_feature: Ceres CLONE 1384514-F
  misc_feature: Encodes the peptide sequence at SEQ ID NO. 18416
  misc_feature (552)..(552): n is a, c, t, g, unknown, or other
  misc_feature (567)..(567): n is a, c, t, g, unknown, or other
tggagctccccgcggtggcggccgctctagaactagtggatcccccgggctgcaggaattcgcacgagaccattacctagaacatcctaatcgaaaaactcatctgatgccgtaacacaaggctgaatttttgttcggtctagccgacccgacgatggcgtccagcgacgggaaaccactgccaaccccggcctctgtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctccatcggcgtggagtacatcgtggtcgaggaagatcttcgactcgctgccggcggaggagcagcggctgtggcactcgcacgcgcacgggatcaagtcaggnctgtggacgagccgncacgtggcggggctggctggagaaggcggagctggacacatggccgcacggtcgggaaagtctgtgg

SEQ ID NO: 18416 - protein, 160 aa, Zea mays
  misc_feature: Ceres CLONE 1384514-F
  misc_feature (26)..(133): Pfam Name: DUF1264 Pfam Description: Protein of unknown function (DUF1264)
  misc_feature (133)..(133): Xaa is any aa, unknown, or other
  misc_feature (138)..(138): Xaa is any aa, unknown, or other
MASSDGKPLPTPASVGGGGGSSTAPPGQPTTVASKVLDMGAAAMQSLRPVKQAKQHMCTFALYAHDPKRQVETHHYVSRLNQDFLQCAVYDSDKADARLHRRGVHRGRGRSSTRCRRRSSGCGTRTRTGSSQXCGRAXTWRGWLEKAELDTWPHGRESLW

SEQ ID NO: 18417 - DNA, 631 bp, Zea mays
  misc_feature: Ceres CLONE 1384516-F
  misc_feature: Encodes the peptide sequence at SEQ ID NO. 18418
  misc_feature (394)..(394): n is a, c, t, g, unknown, or other
  misc_feature (468)..(468): n is a, c, t, g, unknown, or other
  misc_feature (487)..(487): n is a, c, t, g, unknown, or other
  misc_feature (497)..(497): n is a, c, t, g, unknown, or other
  misc_feature (575)..(575): n is a, c, t, g, unknown, or other
  misc_feature (631)..(631): n is a, c, t, g, unknown, or other
tggagctccccgcggtggcggccgctctagaactagtggatcccccgggctgcaggaattcgcacgagaccattacctagaacatcctaatcgaaaaattttgttgagacctagatacgggcccttgctctcctcggcccaccgatccacgccccgcacgcacacgacccgcagaccgcaccctgtcggcgagctcgctcccgttcccgtccgctgctctccgctcgacgccgccgtcttccgcgcagctagtgtctacactcccggcgacgatggcggaggacttggttttggacacggcgatccgagactgggtcctgatcccgctctccgtggttatggtcctcatcggcgtgctccgctactttgtctccaagctcatgcgctccccggngacctctccgtctcccgaccccaagctcgttaaggaagggcaggtggtcatcagggcgaggaaccctgagaccnacgcacagttcatcccggncaaggctttncaggcacgcaagttttattacaccaacgaggaaaatggattacttcatgttccaaaggaagacgcgcagaaggctcangcagccatgttttctgatccaacatggccatggacatgatgaagaagaactaatcn

SEQ ID NO: 18418 - protein, 113 aa, Zea mays
  misc_feature: Ceres CLONE 1384516-F
  misc_feature (2)..(114): Pfam Name: DUF850 Pfam Description: Eukaryotic protein of unknown function (DUF850)
  misc_feature (41)..(41): Xaa is any aa, unknown, or other
  misc_feature (66)..(66): Xaa is any aa, unknown, or other
  misc_feature (72)..(72): Xaa is any aa, unknown, or other
  misc_feature (75)..(75): Xaa is any aa, unknown, or other
  misc_feature (101)..(101): Xaa is any aa, unknown, or other
MAEDLVLDTAIRDWVLIPLSVVMVLIGVLRYFVSKLMRSPXTSPSPDPKLVKEGQVVIRARNPETXAQFIPXKAXQARKFYYTNEENGLLHVPKEDAQKAXAAMFSDPTWPWT

SEQ ID NO: 18419 - DNA, 635 bp, Zea mays
  misc_feature: Ceres CLONE 1384518-F
  misc_feature: Encodes the peptide sequence at SEQ ID NO. 18420
aaagctggagctccccgcggtggcggccgctctatacctagtggatcccccgggctgcaggaattcccacgagaccattacctagaacatcctaatcgaaaaaaaaacacctccgatacgtccccgatcatcgcaccacctgaagcccacctcgctcacaagtctcgagccagacgacgagatggtcgcggtggatctgacctcatggacgtccaagaaggtctacggcggcgacggcggcgcctactacgagtggagccccgccgacctgtctatgctcgccgtcgcctccatcggcggcgccaagatctcgctcgccgccggaggactctacctccccagctactccgactccgccaaggtcgactactgtcctacaaggtgtatgtacctgcggcctcgtcctctccgatgcgacgaatgagaaggtggtgcagacgaatgaggaagacgcaatgacgctggccttcggcgcactgacgagttgctactacggtcccgtcgcgcaggccgacatcacagtgctcttcatcagtgacacctccaggtgcacaaacggatgctgttcatctacttccagctcacgaggcctgcggacatcttctggggctgaccaccgagttcggggtctgccg

SEQ ID NO: 18420 - protein, 80 aa, Zea mays
  misc_feature: Ceres CLONE 1384518-F
MVAVDLTSWTSKKVYGGDGGAYYEWSPADLSMLAVASIGGAKISLAAGGLYLPSYSDSAKVDYCPTRCMYLRPRPLRCDE

SEQ ID NO: 18421 - DNA, 645 bp, Zea mays
  misc_feature: Ceres CLONE 1384521-F
  misc_feature: Encodes the peptide sequence at SEQ ID NO. 18422
atagctggagctccccgcggtggcggccgctctattactagtggatcccccgggctgcaggaattcgcacgagaccattacctagaacatcctaatcgaaaaagttaggcccataagcgtgcccgttctttttcgcgtttcacggcggcgcggacagagagccatcggcggcgcaccgaccgccggcgaagggtacagagatgaagacggttagcctcggcgcctctaggccttccactgtcaacttccgcatgccgacgagggacaacctcgtggctatacgcgtcgacgtcgaggtggacggccagcgctacagggacgccttcacctggaacccgcgagatcccgactcggagataatcagcttcgctaagcggacggccaaggacctcaagctgccggccaattttcgtcccccagatgctccagtccatccaggggcaacttgccgagttccgttcctacgaggggcaggagatgcaactcaagagaagattgtgcctctgaagattgaccttcgagggaacaccactgtaattaggggaccaattcttatgggatatcggcaacctttgatagcgaccctggagaaatttgccaggacactggggggatggattgaaaattacagaacccggaagttgg

SEQ ID NO: 18422 - protein, 148 aa, Zea mays
  misc_feature: Ceres CLONE 1384521-F
MKTVSLGASRPSTVNFRMPTRDNLVAIRVDVEVDGQRYRDAFTWNPRDPDSEIISFAKRTAKDLKLPANFRPPDAPVHPGATCRVPFLRGAGDATQEKIVPLKIDLRGNTTVIRGPILMGYRQPLIATLEKFARTLGGWIENYRTRKL

SEQ ID NO: 18423 - DNA, 642 bp, Zea mays
  misc_feature: Ceres CLONE 1384526-F
  misc_feature: Encodes the peptide sequence at SEQ ID NO. 18424
  misc_feature (221)..(221): n is a, c, t, g, unknown, or other
  misc_feature (422)..(422): n is a, c, t, g, unknown, or other
  misc_feature (467)..(467): n is a, c, t, g, unknown, or other
  misc_feature (531)..(531): n is a, c, t, g, unknown, or other
  misc_feature (545)..(545): n is a, c, t, g, unknown, or other
  misc_feature (609)..(609): n is a, c, t, g, unknown, or other
  misc_feature (631)..(631): n is a, c, t, g, unknown, or other
aagctggagctccccgcggtggcggccgctctagaactagtggatcccccgggctgcaggaattcgcacgagaccattacctagaacatcctaatcgaaaggtacccaatctaatcgacacccggccgagatgggccgcaagttcttcgttggtggcaactggaaatgcaatggaaccacagatcaggttgagaagattgtcaaaaccctgaatgaagganatgttccctcttcagatgttgttgaggtcgttgtcagtcctccttatgtgttcctcccggtggtcaagagccagctgcgccaagagttccaagttgctgctcagaactgctgggtgaagaagggaggtgcattcaccggtgaaattagtgctgagatgctcgtcaaccttggcgttccctgggtcattcttggacactctngaaggagagctctgctgggagaatcaaatgagtttgttggagacnaggttgcttttgctctgtctcagggactaaaggtcattgcatgtgtggaaaaaccccttgaagnagagggaagctggntcaaacatgggatggttgttgctgcacaaacaaaagcaattggctgagaaagatcaggactggnagcaacgtttgtcttgcctatngaacagtctgg

SEQ ID NO: 18424 - protein, 153 aa, Zea mays
  misc_feature: Ceres CLONE 1384526-F
  misc_feature (5)..(154): Pfam Name: TIM Pfam Description: Triosephosphate isomerase
  misc_feature: SWISSPROT Homolog: EC 5.3.1.1 Triose-phosphate isomerase
  misc_feature (31)..(31): Xaa is any aa, unknown, or other
  misc_feature (98)..(98): Xaa is any aa, unknown, or other
  misc_feature (113)..(113): Xaa is any aa, unknown, or other
  misc_feature (134)..(134): Xaa is any aa, unknown, or other
  misc_feature (139)..(139): Xaa is any aa, unknown, or other
MGRKFFVGGNWKCNGTTDQVEKIVKTLNEGXVPSSDVVEVVVSPPYVFLPVVKSQLRQEFQVAAQNCWVKKGGAFTGEISAEMLVNLGVPWVILGHSXRRALLGESNEFVGDXVAFALSQGLKVIACVEKPLEXEGSWXKHGMVVAAQTKAIG

SEQ ID NO: 18425 - DNA, 616 bp, Zea mays
  misc_feature: Ceres CLONE 1384530-F
  misc_feature: Encodes the peptide sequence at SEQ ID NO. 18426
  misc_feature (226)..(226): n is a, c, t, g, unknown, or other
  misc_feature (229)..(229): n is a, c, t, g, unknown, or other
aagctggagctccccgcggtggcggccgctctattctagtggatcccccgggctgcaggaattcgcacgagaccattacctagaacatcctaatcgaaaaatgatcgctccccaacaccacggtcgcccacgcccacatgatcgcgcgcgctttgcggtacgtctcgcggccaaagctgtcgtcccccgtcggttcctcttggcgccgcgcatcatgcgcgccggntgntatataatatataagcgatcgagcagcacgccagcggctttctgcaccgcaccggtgagaccaagtgtccgagagttcgagcgcgcgtggtcgtctgcggatcgagttcgaggtggtgggatcgatggcaggaggcggcggcaggggcgctgcggctgcggctgcgagcgctctagcgctggcggctctggtgtgctcgctgtcctgcggcctcgcgcagggccgcgtgtcgaggaagagcctcggcatcggcctgagcggcggcggtggcgctgaatgcgacgggctgcgcctcgggcttgaactgggcctcggcgtcggcgcaggtaccggaggagtgtcggagtctgggcctggctctgggtctgagccggcgcctgtgttgcg

SEQ ID NO: 18426 - protein, 87 aa, Zea mays
  misc_feature: Ceres CLONE 1384530-F
MAGGGGRGAAAAAASALALAALVCSLSCGLAQGRVSRKSLGIGLSGGGGAECDGLRLGLELGLGVGAGTGGVSESGPGSGSEPAPVL

SEQ ID NO: 18427 - DNA, 642 bp, Zea mays
  misc_feature: Ceres CLONE 1384549-F
  misc_feature: Encodes the peptide sequence at SEQ ID NO. 18428
aagctggagctccccgcggtggcggccgctctagaactagtggatcccccgggctgcaggaattcgcacgagaccattacctagaacatcctaatcgaaaagccacgcgacaaccgacaatccttcgcagtcccgcaccgcaccgccgcaccgcaccaccgcaccgcggccaaggccaatagcctcgcctagcgctcactcgctcgccccactaccaccgcaccacgcgctcccgtttccgccgatccgagcgcgcagatcgcggaagcccagcggctcagagtccagggggagggagctcgcggcggctgaggaaggcgttcaccaccgtcgcggatttcattgaggaagagatggggctctcctttgggaagctgttcagccgcctcttcgccaagaaggagatgaggattctcatggtcgggctcgatgccgccggtaagaccaccatcctctataagctcaagctcggcgagatcgtcaccaccatccccaccattggattcaatgttgaaactgttgagtacaagaacattagcttcaccgtttgggatgttggtggccaggacaagatcaggcccctgtggaggcactactttcagaacacgcagggacttatttttgttgtagacagcaatgata

SEQ ID NO: 18428 - protein, 96 aa, Zea mays
  misc_feature: Ceres CLONE 1384549-F
  misc_feature (1)..(96): Pfam Name: Arf Pfam Description: ADP-ribosylation factor family
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSND

SEQ ID NO: 18429 - DNA, 641 bp, Zea mays
  misc_feature: Ceres CLONE 1384550-F
  misc_feature: Encodes the peptide sequence at SEQ ID NO. 18430
  misc_feature (223)..(223): n is a, c, t, g, unknown, or other
ggagctccccgcggtggcggccgctctatactagtggatcccccgggctgcaggaattcgcacgagaccattacctagaacatcctaatcgaaaaatcaaccatattattgagaccaacaaggaacatagaaaggggaatccagtagcaacaatagagcaacaatggcgaccaagatcttttccctccttatgcgccttgctctttctacaggggttgataangcgaaaattttccctcaatgctcacaagctcctatagcttcccttcttcccccataccttccatcaattatagcttcaatatgtgaaaacccagctcttcaaccatataggcttcaacaagcaatcgcagcaagcaacatacctttatcgcccttgttgcttcaacaatcgccagccatatctttggtgcagtcattggtacaaaccatcagggcacaacagctgcagaaactcgtgctacctctgatccaccaagaagctctgggaaacctttctccctactctcagaaacaacaatttcttccattcaaccaaatgcctacactggaacccttgctgcttaatttgcaggaaacaaataataaccattttagccaagttaggttactggcctactcctcaaaaaaaaacaactttc

SEQ ID NO: 18430 - protein, 159 aa, Zea mays
  misc_feature: Ceres CLONE 1384550-F
  misc_feature (20)..(20): Xaa is any aa, unknown, or other
MATKIFSLLMRLALSTGVDXAKIFPQCSQAPIASLLPPYLPSIIASICENPALQPYRLQQAIAASNIPLSPLLLQQSPAISLVQSLVQTIRAQQLQKLVLPLIHQEALGNLSPYSQKQQFLPFNQMPTLEPLLLNLQETNNNHFSQVRLLAYSSKKNNF

SEQ ID NO: 18431 - DNA, 644 bp, Zea mays
  misc_feature: Ceres CLONE 1384553-F
  misc_feature (570)..(570): n is a, c, t, g, unknown, or other
aaagctggagctccccgcggtggcggccgctctagaactagtggatcccccgggctgcaggaattcgcacgagaccattacctagaacatcctaatcgaaaaatagcatctgcctacctgcactggactcaaaaacatgcctgccgtaggatcctgagatgtgtccattcgcgagttgagtcagaggcttgtgaaggcatccgacccctccctccagccgcacgtcgtcaccttctcaaacctagatctctacccggacaacgtgcaggcctccatagtgtgactctaccccaagctgtcaacaaagtccgggccggacggcgacttcaacgccgtcttctccaccttcgaggccgtcctgccgaccttgcttaaccacttctaccctctcgccggtcacattgtcgtcaacccaagctccggcgtccccgagctccactgccacaaccagggcgcggagctcgtgctgctagaggtcgccgtccccttgggcagactgcattacggtcttgccgaggagtccctgaagaagatcatgatgccgtacccctgaggacgtcacgctctcgntgcagctgctggccttcgcgtgcggcggctccctccggcgtgtggggcaacaacacctcctcagcgacgggaag

SEQ ID NO: 18432 - DNA, 653 bp, Zea mays
  misc_feature: Ceres CLONE 1384554-F
  misc_feature: Encodes the peptide sequence at SEQ ID NO. 18433
  misc_feature (653)..(653): n is a, c, t, g, unknown, or other
aaagctggagctccccgcggtggcggccgctctagaactagtggatcccccgggctgcaggaattcgcacgagaccattacctagaacatcctaatcgaaaaaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgagaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctgcctgccgtgttatagccagattaaagaaggaaagagatgacgctagagcacttttggctcaagctgagagacagattcctgcgtcagttgcaggagctgctcctgcagctgttgtttccatggaaaaagan

SEQ ID NO: 18433 - protein, 107 aa, Zea mays
  misc_feature: Ceres CLONE 1384554-F
  misc_feature (18)..(87): Pfam Name: Prp19 Pfam Description: Prp19/Pso4-like
MDDIVPVKTNTIVKPRPLQAASIPGLLGIFQNEWDALMLSNFALEQQLHTARQELSHALYQHDAACRVIARLKKERDDARALLAQAERQIPASVAGAAPAAVVSMEK

SEQ ID NO: 18434 - DNA, 645 bp, Zea mays
  misc_feature: Ceres CLONE 1384556-F
  misc_feature: Encodes the peptide sequence at SEQ ID NO. 18435
  misc_feature (583)..(583): n is a, c, t, g, unknown, or other
aaagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctgtcggggctggcgctgacggcctccgtggtggggctgggcgtggccacgccggtgttcctgatcttcagccccgtgctcgtccccgccgcgctgctcatcgggacggccgtcatggggtccctcacgtcgggcgcgctgggggctcggggggcctgtccctcgctcacgtgcctcgccaacacgggngcggcaggcgtcccagcgcacccgggactaccgtggaggaggcgcaccgcagggatgggcgg

SEQ ID NO: 18435 - protein, 146 aa, Zea mays
  misc_feature: Ceres CLONE 1384556-F
  misc_feature (44)..(145): Pfam Name: Oleosin Pfam Description: Oleosin
MADRDRSGIYGGAHATYGQQQQQGGGGRPMGEQVKGMLHDKGPTASQALTVVTLFPLGGLLLVLSGLALTASVVGLGVATPVFLIFSPVLVPAALLIGTAVMGSLTSGALGARGACPSLTCLANTGAAGVPAHPGLPWRRRTAGMG

SEQ ID NO: 18436 - DNA, 621 bp, Zea mays
  misc_feature: Ceres CLONE 1384560-F
  misc_feature: Encodes the peptide sequence at SEQ ID NO. 18437
  misc_feature (343)..(343): n is a, c, t, g, unknown, or other
  misc_feature (389)..(389): n is a, c, t, g, unknown, or other
  misc_feature (395)..(395): n is a, c, t, g, unknown, or other
  misc_feature (396)..(396): n is a, c, t, g, unknown, or other
aaagctggagctccccgcggtggcggccgctctataactagtggatcccccgggctgcaggaattcgcacgagaccattacctagaacatcctaatcgaaaaagatcttgtgaccctccctcagccgcgtcgcgtcgcatcctacgatccaaagctctctctgctcgcaggtcgcagccatggcgaagaactacccgaccgtgagcgccgagtacagcgaggctgtggacaaggccaggcgcaagctccgagccctcatcgccgagaagagctgcgccccgctcatgctccgcctcgcgtggcactccgcggggacgttcgacgtgtcgtcgaggaccggcgntcatttcgcacgatgaagcatcagtcggaattggctcacggcgctnacgcgnngctggacaatcgcgggccggctgctcgaggcccttaaggaaggagttcccaattccttccttaaagcgattttctaccagttcccgggaaatttggggcccggggaaggtccaccggggggcccctggaaatttcccctccccccccccgggagggggggggaaaaaaacccccagcccccccccccttggggggggcccgccccttccctgggggcgccaaaag

SEQ ID NO: 18437 - protein, 59 aa, Zea mays
  misc_feature: Ceres CLONE 1384560-F
  misc_feature: SWISSPROT Homolog: EC 1.11.1.11 L-ascorbate peroxidase
  misc_feature (55)..(55): Xaa is any aa, unknown, or other
MAKNYPTVSAEYSEAVDKARRKLRALIAEKSCAPLMLRLAWHSAGTFDVSSRTGXHFAR

SEQ ID NO: 18438 - DNA, 569 bp, Zea mays
  misc_feature: Ceres CLONE 1384562-F
  misc_feature: Encodes the peptide sequence at SEQ ID NO. 18439
  misc_feature (433)..(433): n is a, c, t, g, unknown, or other
  misc_feature (434)..(434): n is a, c, t, g, unknown, or other
aaagctggagctccccgcggtggcggccgctctagaactagtggatcccccgggctgcaggaattcgcacgagaccattacctagaacatcctaatcgaaaactttcctagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaaacggcnnagaaggtcatgggctgtcccgcattcatctaaggaataccctgggaaaaaaatttttcccccggggggttccccccggggtgcccccccccccccctgggggggggggggggggggtttttaaaggggggggccc

SEQ ID NO: 18439 - protein, 120 aa, Zea mays
  misc_feature: Ceres CLONE 1384562-F
  misc_feature (80)..(80): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNKRXRRSWAVPHSSKEYPGKKIFPPGGSPRGAPPPPWGGGGGGF

SEQ ID NO: 18440 - DNA, 665 bp, Zea mays
  misc_feature: Ceres CLONE 1384565-F
  misc_feature: Encodes the peptide sequence at SEQ ID NO. 18441
  misc_feature (590)..(590): n is a, c, t, g, unknown, or other
  misc_feature (608)..(608): n is a, c, t, g, unknown, or other
  misc_feature (628)..(628): n is a, c, t, g, unknown, or other
  misc_feature (629)..(629): n is a, c, t, g, unknown, or other
aagctggagctccccgcggtggcggccgctctagaactagtggatcccccgggctgcaggaattcgcacgagaccattacctagaacatcctaatcgaaaaaactactccgtcactttgtttgcaaagctcctcctcgatccatcgatcactgcaccggccggcggcaccgcgctcgcaggggctagccaacgagacggcagcaatggcggaccgtgaccgcagcgggatctacggcggcgcccacgccacctacgggcagcagcagcagcagggaggaggcgggcgcccgatgggtgagcaggcgaagggcatgctccacgacaaggggccgacggcgtcgcaggcgctgacggaggcgacgctgttcccgctggacgatctgctgctggagctgtcgggactggcgctaacggctccggggtggggactgcgcggagccactgcgcagacctggaaccataattccccgaagtctcaaggaaggactaaagatatgttcaggcgatgatagagacggaagctgagaagatatgggacttcacttttggaaatggacccgagaatctccccacaagtatgatgatgaanacctgagtatgtccgggnacaagtattacaacgagagnncccatggaggattacacactggctaccacacttctg

SEQ ID NO: 18441 - protein, 101 aa, Zea mays
  misc_feature: Ceres CLONE 1384565-F
MADRDRSGIYGGAHATYGQQQQQGGGGRPMGEQAKGMLHDKGPTASQALTEATLFPLDDLLLELSGLALTAPGWGLRGATAQTWNHNSPKSQGRTKDMFRR

SEQ ID NO: 18442 - DNA, 674 bp, Zea mays
  misc_feature: Ceres CLONE 1384566-F
  misc_feature: Encodes the peptide sequence at SEQ ID NO. 18443
  misc_feature (560)..(560): n is a, c, t, g, unknown, or other
  misc_feature (674)..(674): n is a, c, t, g, unknown, or other
aagctggagctccccgcggtggcggccgctctagaactagtggatcccccgggctgcaggaattcgcacgagaccattacctagaacatcctaatcgaaaaagacttcgcagtcctcctccccactaccagagcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaggccaaggagcaggtggtggccggcacgctgcaccacctcacgctcgaggccgtcgaggccgggaggaagaagctctacgaggccaaggtctgggtccagccatgattcgacttcaaggagctccagtgattcagccacaagggggacgccgccgtcttcaccaacgacgacctcggngacaagcaaggtgcaatggagcctgcctgaacgtgaggctcccggataggagcctgtgaccaaagacggtggaccccgtgctgcggaatcaacccctaagaggccccacttccn

SEQ ID NO: 18443 - protein, 117 aa, Zea mays
  misc_feature: Ceres CLONE 1384566-F
  misc_feature (43)..(118): Pfam Name: Cystatin Pfam Description: Cystatin domain
MRVAATRAAAAAHPPSAFLLLLLLLGCASLAIGGAAMAGHVLGGVKENPAAANSAESDGLGRFAVDEHNRRENALLEFVRVVEAKEQVVAGTLHHLTLEAVEAGRKKLYEAKVWVQP

SEQ ID NO: 18444 - DNA, 665 bp, Zea mays
  misc_feature: Ceres CLONE 1384571-F
  misc_feature: Translation starting site: 231
  misc_feature: SWISSPROT Homolog: EC 2.5.1.67 Chrysanthemyl diphosphate synthase
  misc_feature (578)..(578): n is a, c, t, g, unknown, or other
tggagctccccgcggtggcggccgctctagaactagtggatcccccgggctgcaggaattcgcacgagaccattacctagaacatcctaatcgaaaaaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcgacagctacaagctgctcaagggcgctgatgctctgggcgaggaggaaacgtccttttgctgcaccctcgctggtgcattgaatgccttcaggctttcttttctgggcctgatgatatcatggatgactctcacactcgtcgcgggcagccttgctggnttcaggtgcctcaagtttggtttaattgctgggaaaggagggaataattctttccaaacccaaattcacgggatcccttggggggcc

SEQ ID NO: 18445 - DNA, 677 bp, Zea mays
  misc_feature: Ceres CLONE 1384576-F
  misc_feature: Encodes the peptide sequence at SEQ ID NO. 18446
  misc_feature (542)..(542): n is a, c, t, g, unknown, or other
  misc_feature (552)..(552): n is a, c, t, g, unknown, or other
aagctggagctccccgcggtggcggccgctctagaactagtggatcccccgggctgcaggaattcgcacgagaccattacctagaacatcctaatcgaaaaaaaccctacccacagccaccgccgccgccgccgctccctgacccctagtgtccggatttaacttcaaacatggcggacgtcgatgtcgagccggaggtcgccgccggtgctcccaagaagaggacgttccgcaagtacagctaccgcggcgtcgacctcgatgcgctgcttgacatgtccaccgacgacctcgttcagctcttcccagcgcgcgccaggagaagggtccagaggggtttgaagaggaagcccatggcggtcatccagaaactgcgcaaggggaaaaaggatgctcctgtcggcgagaagccagagccagtggagacccatctccgcaacatgatcattgtccccgagatgattggcagcagttgttggtgcctactatgcgaagagcttcaatccagtgtgagatcaagccctgagatgattgggcactantctgtgcagnagatctccatttcctacaagccggacttagcacggcaggtgccggatattgcgtgccactaacatcctcgcgcgatatcactctggaaatgggttgtgacccatatctgtagagttcgccagggg

SEQ ID NO: 18446 - protein, 147 aa, Zea mays
  misc_feature: Ceres CLONE 1384576-F
  misc_feature (55)..(133): Pfam Name: Ribosomal_S19 Pfam Description: Ribosomal protein S19
  misc_feature (124)..(124): Xaa is any aa, unknown, or other
  misc_feature (128)..(128): Xaa is any aa, unknown, or other
MADVDVEPEVAAGAPKKRTFRKYSYRGVDLDALLDMSTDDLVQLFPARARRRVQRGLKRKPMAVIQKLRKGKKDAPVGEKPEPVETHLRNMIIVPEMIGSSCWCLLCEELQSSVRSSPEMIGHXSVQXISISYKPDLARQVPDIACH

SEQ ID NO: 18447 - DNA, 686 bp, Zea mays
  misc_feature: Ceres CLONE 1384578-F
  misc_feature: Translation starting site: 235
  misc_feature: SWISSPROT Homolog: EC 2.5.1.67 Chrysanthemyl diphosphate synthase
  misc_feature (329)..(329): n is a, c, t, g, unknown, or other
  misc_feature (374)..(374): n is a, c, t, g, unknown, or other
  misc_feature (382)..(382): n is a, c, t, g, unknown, or other
  misc_feature (497)..(497): n is a, c, t, g, unknown, or other
aagctggagctccccgcggtggcggccgctctagaactagtggatcccccgggctgcaggaattcgcacgagaccattacctagaacatcctaatcgaaaaaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggncttcgagttcaccgaggagtcacgccagtggatcgaccgcatggntgactacnatgtactcggagggcaagtgtaaccgtgggctctctgtggtcgacagctaccagctgctccaggccgctgatgctctgggcggagaagaaaacgttccttgcttgcacccctggnttggggaaatgaaaggcttcaggttttcttcccttgggttgggaggaaacagggagaatctcaaactcggcgggccaaacttggggggcagggggccccagggtgggttaaattggggaaagggggggaattcttttaaaaaaaattcccggggactttggggcgcccttttagggaacccttatttgt

SEQ ID NO: 18448 - DNA, 721 bp, Zea mays
  misc_feature: Ceres CLONE 1384581-F
  misc_feature: Encodes the peptide sequence at SEQ ID NO. 18449
  misc_feature (629)..(629): n is a, c, t, g, unknown, or other
  misc_feature (643)..(643): n is a, c, t, g, unknown, or other
  misc_feature (668)..(668): n is a, c, t, g, unknown, or other
  misc_feature (711)..(711): n is a, c, t, g, unknown, or other
tggagctcaccgcggtggcggccgctctagaactagtggatcccccgggctgcaggaattcgcacgagaccattacctagaacatcctaatcgaaaaatcgatcgtccttcctgtcgtttcgttttctcgccggcagggcactgggtacgccgccgccgcctcaacgccaccacgctgccgccgcgccagttcgtcaccgcgagacacaagacacgtgcctcgcttccctcgggccggttggccgtggccggccgtcgctgttctgttcctatttcttggcaactccgcccgtttcacctccggaggaccgacagcgacggcgccagtagatagatgcactactgacgccactggccacctcgagttcgagtgccaagggacgccacgagaccaaccgtgaggacaggacaacggtcgcctttgcccgcggatccgcggatttcgtcttcttgggtgccatggatccagtcgccggcacggcggagcatcggggcccgttggaagtgcgcgcccgcgcgcccggcaagatcatcctcgcgggcgagcacgccgtcgtccacggttccgccgccgtcgccgctgccatcgatctctacaccaactcctccctcctctcccgccccgaggncccaagaagatggntggcggcgctggcctccggcgccgntggagctggacctcagggactcgggcctcacctttctcgtggncgtgctcgcg

SEQ ID NO: 18449 - protein, 87 aa, Zea mays
  misc_feature: Ceres CLONE 1384581-F
  misc_feature (57)..(57): Xaa is any aa, unknown, or other
  misc_feature (62)..(62): Xaa is any aa, unknown, or other
  misc_feature (70)..(70): Xaa is any aa, unknown, or other
MDPVAGTAEHRGPLEVRARAPGKIILAGEHAVVHGSAAVAAAIDLYTNSSLLSRPEXPRRWXAALASGAXGAGPQGLGPHLSRGRAR

SEQ ID NO: 18450 - DNA, 673 bp, Zea mays
  misc_feature: Ceres CLONE 1384585-F
  misc_feature: Encodes the peptide sequence at SEQ ID NO. 18451
  misc_feature (578)..(578): n is a, c, t, g, unknown, or other
  misc_feature (585)..(585): n is a, c, t, g, unknown, or other
  misc_feature (586)..(586): n is a, c, t, g, unknown, or other
  misc_feature (635)..(635): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
aagctggagctccccgcggtggcggccgctctagaactagtggatcccccgggctgcaggaattcgcacgagaccattacctagaacatcctaatcgaaaaaaatccgacacccggcgacccgggccgcaccacgctgtgagtgactcggtcgcatcttccccattctccatcgacgcaccggcggcggcgcaagtgaagcgaagaggaaaggaagctacgagatgtcggcgaccactgcagcggtgcccttctggcgggcggcggggatgacctacatcggctactccaacatctgcgctgcgctggtccggaactgcctcaaggagcccttcaagtctgaggccgcgtcccgcgagaaggttcatttctccatttccaagtggacggatggcaagcaggagaagccaactgtccgcacagaatcggatgactaagggctggcgccatggcgacatagtccttcctacagatgatttgaagcgtcgttgcaagtttctgggacttgtttatttagttggcttgatttgtaatcaatgctgaagaataaatactttttgcgacaatggctttttacantgggccnnggttgttttcgttgctaattgcacttgccctaccctaatcaagcatggnactatggnnnaagggttttcgagttttgtgcaaaaaaa

SEQ ID NO: 18451 - protein, 70 aa, Zea mays; identical to SEQ ID NO: 4918
  misc_feature: Ceres CLONE 1384585-F
  misc_feature (9)..(57): Pfam Name: ATP-synt_Eps Pfam Description: Mitochondrial ATP synthase epsilon chain

SEQ ID NO: 18452 - DNA, 576 bp, Zea mays
  misc_feature: Ceres CLONE 1384586-F
  misc_feature (335)..(335): n is a, c, t, g, unknown, or other
  misc_feature (576)..(576): n is a, c, t, g, unknown, or other
aaagctggagctccccgcggtggcggccgctctagaactagtggatcccccgggctgcaggaattcgcacgagaccattacctagaacatcctaatcgaaaaatcacacatattattgagaccaactagcaacatagaaagcacaatagtgtaccaacaatggcagccaaaatattttgcctccttatgctccttggtctttctgcaagtgctgctacggcgaccattttcccacaatgctcacaagctcctatagcttcccttcttccctcgtacctctcaccagcggtgtcttcggtatgtgaaaaaccaattcttcaaccctacaggatccnacagggcaatgcagctggcatcctacctttatcaccctggtcctcccaaaatcatcagccctattacggcagttacctttgggggatttatgggcacaaaacaataggggacaacaaattaacaaaacttggggtaaaaaaacctggttgccaaccctcaaaaaaattaagtttttttcctttcacccaacatagtgggattggaacccggccttcttaattttcaaacaaaacaaaactn

SEQ ID NO: 18453 - DNA, 721 bp, Zea mays
  misc_feature: Ceres CLONE 1384587-F
gctggagctccccgcggtggcggccgctctagaactagtggatcccccgggctgcaggaattcgcacgagaccattacctagaacatcctaatcgaaaaatctcgtcgctcggcttccgtaccgcattccaatctcccatctcctgcgttctcgtgtctcgcggagatcacacgcgccaccgacggtagatggatgcctcctaccgtcgtgcccggtgctcgaaagcggttctgctccccgctccgacgaggacatctacaaggactaccgcggccgccgctccgtcgacctccgcgccctcacccacgacgtcgaggagttctacgcgctgtgcgatccagagaaggagaatctgcgcctatacgggtacgaacacccacgcgcgggacgtggccgctgcccgcggaggacgtgaccacggatctgctcggacactgcgctcgggatcaacttcgcgcgtggaggcatgaaccgtcgcgactgcgtcgtgctcgtcgctcgaccactctcgagtcgtggctcatatccgacgcattctactacggcgcgagtgtcaccctatatgatcgtcgatatccgaatggtgccaacccatctaaggagaggtacagatccgcgactgacaacagtgactgtaaataaactgctcactaagcacatcatcgcgcctcgtcctatatcatagtgccagggagactgacgaggtctacgatgaagacg

SEQ ID NO: 18454 - DNA, 680 bp, Zea mays
  misc_feature: Ceres CLONE 1384597-F
  misc_feature: Encodes the peptide sequence at SEQ ID NO. 18455
  misc_feature (540)..(540): n is a, c, t, g, unknown, or other
  misc_feature (574)..(574): n is a, c, t, g, unknown, or other
  misc_feature (576)..(576): n is a, c, t, g, unknown, or other
  misc_feature (584)..(584): n is a, c, t, g, unknown, or other
aagctggagctccccgcggtggcggccgctctagaactagtggatcccccgggctgcaggaattcgcacgagaccattacctagaacatcctaatcgaaaaaagcacatcgacaacacacggtccaagcacatcgacacacacgagcacagaagagaaacgggcacacgcaactgatcaaggcaaccaatattcaccgtcggcaatgggcgacctgatccctgggctgccggatgaagtggccagggagtgcctcgtccgggtgggcttcgaccagctgccggtggtgcgccgcatctcgcgccagtggaagtcggaggtggagtcgccggactaccaccgccagcgccgggcggaggggctggcgcgcccggtgctcgcgctggtccaggcgcagccgacagcgccgccggatgacgacgacgacgccggccccgcgcacaagcgctcgacggcggccaactcgtaccggctggtgctgctggaaccggccgaagggacggtggacgccgctgccgcccccgcctgggccaagccaagncctgcctctgttctgccaggtgggcgcccgccgngnaagcccgncgcccaggcccacgcaccgccccctggcgcgggcccgccccccgcgccccccacccccccgcccacaacccagcacccaacccaccccccagcacc

SEQ ID NO: 18455 - protein, 158 aa, Zea mays
  misc_feature: Ceres CLONE 1384597-F
  misc_feature (3)..(50): Pfam Name: F-box Pfam Description: F-box domain
  misc_feature (112)..(112): Xaa is any aa, unknown, or other
  misc_feature (124)..(124): Xaa is any aa, unknown, or other
  misc_feature (127)..(127): Xaa is any aa, unknown, or other
MGDLIPGLPDEVARECLVRVGFDQLPVVRRISRQWKSEVESPDYHRQRRAEGLARPVLALVQAQPTAPPDDDDDAGPAHKRSTAANSYRLVLLEPAEGTVDAAAAPAWAKPXPASVLPGGRPPXKPXAQAHAPPPGAGPPPAPPTPPPTTQHPTHPPA

SEQ ID NO: 18456 - DNA, 713 bp, Zea mays
  misc_feature: Ceres CLONE 1384600-F
  misc_feature: Encodes the peptide sequence at SEQ ID NO. 18457
tggagctccccgcggtggcggccgctctagaactagtggatcccccgggctgcaggaattcgcacgagaccattacctagaacatcctaatcgaaaattaactactccgtcactttgtttgcaaagctcctcctcgatccatcgatcactgcaccggccggcggcaccgcgctcgcaggggctagccaacgagacggcagcaatggcggaccgtgaccgcagcggcatctacggcggcgcccacgccacctacgggcagcagcagcagcagggaggaggcgggcgcccgatgggtgagcaggtgaagggcatgctccacgacaaggggccgacggcgtcgcaggcgctgacggtggtgacgctgttcccgctgggcgggctgctgctggtgctggtcggggctggcgctgacggcctccgtgggtggggctggccgtggccaccgccggtgatccctgatcttcaaccccagtggtcgtccccggacgcgatgctcacccaacaggcccggactgggcgaccctccaagcgccagaatgccagatgattctctgtggcaaaatcgaaccaccgtaaggcccccccccaaacacccctactccccaaacttcgtcccccccgcactccatctctcacttcccaggtctgacagtgcgcgaaggtagaaacaaaacaaccacaaccacacacacacccactgtggtcatacaacg

SEQ ID NO: 18457 - protein, 114 aa, Zea mays
  misc_feature: Ceres CLONE 1384600-F
MADRDRSGIYGGAHATYGQQQQQGGGGRPMGEQVKGMLHDKGPTASQALTVVTLFPLGGLLLVLVGAGADGLRGWGWPWPPPVIPDLQPQWSSPDAMLTQQARTGRPSKRQNAR

SEQ ID NO: 18458 - DNA, 739 bp, Zea mays
  misc_feature: Ceres CLONE 1384603-F
  misc_feature: Encodes the peptide sequence at SEQ ID NO. 18459
  misc_feature (404)..(404): n is a, c, t, g, unknown, or other
  misc_feature (436)..(436): n is a, c, t, g, unknown, or other
  misc_feature (440)..(440): n is a, c, t, g, unknown, or other
  misc_feature (441)..(441): n is a, c, t, g, unknown, or other
  misc_feature (444)..(444): n is a, c, t, g, unknown, or other
  misc_feature (451)..(451): n is a, c, t, g, unknown, or other
  misc_feature (452)..(452): n is a, c, t, g, unknown, or other
  misc_feature (573)..(573): n is a, c, t, g, unknown, or other
  misc_feature (574)..(574): n is a, c, t, g, unknown, or other
tggagctccccgcggtggcggccgctctagaactagtggatcccccgggctgcaggaattcgcacgagaccattacctagaacatcctaatccaaaacttccgtaaaccctagccgcctgtcttgctgaagctgaactgctgatccgtcttccaagctgtggtgtcatccctgcgttctgatccaagatgtatctccagtattacatcaacgagaagggtgacaaggtctacaccaccaagaaggagtcgcctcttggggtgccgacgcagtctgctcacccagctcgcttctcaccagatgacaagtactctcgccagcggtacctgttgaagaagagatttggacttctgccaacgcagaagccagcactgaagtactgaagctttcactttccaaccatgnatgtgcagtttgtgtcactgcttaaatgctgntggnntgnaatgtannaaatagtatctgagggaacatatcaaacactgctaggcactactatgacatctcagcgcattcagccactatatgtaatgctatgggtttgacaaggcctggtccctattatgtacctggnngggggggccaaaaaaaaaaaaaaaaaagctatcgaacccgccgaccccagagggggggcccggaacccaattcccccaaaagggagcccaattacgcccccccctggggccgccgtttaaaagcgccggggtgggaaaaaccctgggggttaccacaattaaccc

SEQ ID NO: 18459 - protein, 64 aa, Zea mays
  misc_feature: Ceres CLONE 1384603-F
  misc_feature (3)..(53): Pfam Name: Nop10p Pfam Description: Nucleolar RNA-binding protein, Nop10p family
MYLQYYINEKGDKVYTTKKESPLGVPTQSAHPARFSPDDKYSRQRYLLKKRFGLLPTQKPALKY

SEQ ID NO: 18460 - DNA, 730 bp, Zea mays
  misc_feature: Ceres CLONE 1384607-F
  misc_feature: Translation starting site: 260
  misc_feature (531)..(531): n is a, c, t, g, unknown, or other
  misc_feature (543)..(543): n is a, c, t, g, unknown, or other
  misc_feature (559)..(559): n is a, c, t, g, unknown, or other
tccccgcggtggcggccgctctagaactagtggatcccccgggctgcaggaattcgcacgagaccattacctagaacatcctaatcgaaaaatctgatgccgtaacacaaggctgaatttttgttcggtctagccgacccgacgatggcgtccagcgacgggaaaccactgccaaccccggcctctggtgggcggcggcggcggcagcagcaccgcgccgcccgggcagccgaccacggtagcgtccaaggtgctggacatgggcgcggcggcgatgcagtcgttgcgccccgtgaagcaggcgaagcagcacatgtgcacgttcgcgctgtacgcgcacgacccgaagcggcaggtggagacgcaccactacgtctcccgcctcaaccaggacttcctccagtgcgccgtctatgactccgacaaagccgacgcgcgtctccatcggcgtggagtacatcgtggtcgaggaagatcttcgactcgctgccggcggaggagcagcggctgtggcactcgcacgcgcacganatcaagtcaggncctgtggacgagccgncacgttggcggggctggctggagaaagcggagctggaccacatggccgcaccgttccgggttagttctgtggccaccctggcaggtgggaccgcggcgacggcctggccgctggaggccccgaggcttatgatggtacccgtaagcccgacgccgccgcagccgtgagcct

SEQ ID NO: 18461 - DNA, 748 bp, Zea mays
  misc_feature: Ceres CLONE 1384611-F
  misc_feature: Translation starting site: 322
  misc_feature: SWISSPROT Homolog: EC 3.4.25.1 Proteasome endopeptidase complex
  misc_feature (705)..(705): n is a, c, t, g, unknown, or other
  misc_feature (733)..(733): n is a, c, t, g, unknown, or other
aagctggagctccccgcggtggcggccgctctagaactagtggatcccccgggctgcaggaattcgcacgagaccattacctagaacatcctaatcgaaaagcggttgttctcctgttcatcacccgtgcgtggtctctctctctctctctctctctctcgtgcggcaactgcaagggcgccgacgcccgacggcagggtcgcccaggccttcttcggtcccatcgcgaggccatagttgcatcattcgtctgagacgactgcccagaatcaggactgatctcctcactaggggcgcagaggcgaagagaagaacttgactatgagcagtatagggacaggttactatctgtctgtcaccaccttctccccagatggtcgcggcttccagggcgaatatgctaccagggacgtcaacaacagcgggactgttgttgggatcaagtgcaaagatgccattgtcctgtgtgttgagaagctgctcaacctcagagatgatgctggaaggctcaaaccggatgatccattcagtgcaccggcactctgacttggctgttgctgacttagcagcagatggcaggcaaattgtttcacggcagaagtcagaagctgacaattatgaaaaggtctatgtggaacccattcctgttaaggaattgactgatcgacgtgacaagttatgatactcttatgccgctgtactggnggatcacggcttatgtgtgcggcgtcantcttcggagctatga

SEQ ID NO: 18462 - DNA, 651 bp, Zea mays
  misc_feature: Ceres CLONE 1384619-F
  misc_feature: Encodes the peptide sequence at SEQ ID NO. 18463
tggagctccccgcggtggcggccgctctagaactagtggatcccccgggctgcaggaattcgcacgagaccattacctagaacatcctaatcgaaaactgccttaaccattcctcccaacaccacctcgcctgcgatcttcgtagcctccgtcgcgtcgagcatcgatcatgtcggcctactgcggaaagtacaaggatgagctcatcaagaatgctgcctacattggcacccccggcaagggtatccttgctgctgatgagtccactggcaccattggcaagcgcctttccagcatcaatgtcgagaacgttgaggagaaccgccgtgccctccgtgagctcctattctgctgccctggtgctctccagtacatcagcggtgtgatcctcttcgaggagaccctgtaccagaagaccaaggatggcaagccttttgttgatgtcctcaaggaggggagcgtcctccctggcatcaaagttgaccaggggcaccattggagggtggtgggccctgtaaaggggaaccccccccccaggggcattggggaacctttgggaaaggggggggccccaaaaaaaaaaaaggaaagggggcccccctttttttcaaaaaggggggggggggttttttccaaaaaaaagagaacact

SEQ ID NO: 18463 - protein, 160 aa, Zea mays
  misc_feature: Ceres CLONE 1384619-F
  misc_feature (11)..(160): Pfam Name: Glycolytic Pfam Description: Fructose-bisphosphate aldolase class-I
  misc_feature: SWISSPROT Homolog: EC 4.1.2.13 Fructose-bisphosphate aldolase
MSAYCGKYKDELIKNAAYIGTPGKGILAADESTGTIGKRLSSINVENVEENRRALRELLFCCPGALQYISGVILFEETLYQKTKDGKPFVDVLKEGSVLPGIKVDQGHHWRVVGPVKGNPPPRGIGEPLGKGGAPKKKKERGPPFFSKRGGGVFSKKKRT

SEQ ID NO: 18464 - DNA, 740 bp, Zea mays
  misc_feature: Ceres CLONE 1384620-F
  misc_feature: Encodes the peptide sequence at SEQ ID NO. 18465
  misc_feature (500)..(500): n is a, c, t, g, unknown, or other
  misc_feature (527)..(527): n is a, c, t, g, unknown, or other
  misc_feature (528)..(528): n is a, c, t, g, unknown, or other
  misc_feature (537)..(537): n is a, c, t, g, unknown, or other
  misc_feature (661)..(661): n is a, c, t, g, unknown, or other
  misc_feature (662)..(662): n is a, c, t, g, unknown, or other
  misc_feature (685)..(685): n is a, c, t, g, unknown, or other
aaagctggagctccccgcggtggcggccgctctagaactagtggatcccccgggctgcaggaattcgcacgagaccattacctagaacatcctaatcgaaaaatcgatcgtcaatgcaagtttgtccattcgcattggtctgaatactgtagctactagcgcgagtgccactgtgccgcagctgcctgctcgccattactgcaagctgtgttcaatcaaagcttaattaggctccctctacatctgatccagctaagtagctagccagcactacagaagggcgtggcaagaatcaggagagagatagcaggggggctagctagctgagctcgtgcgacgaagaatggccggaattggcaggaacatggtggcgccgctcctggtgctcaacctcatcatgtacatcatcgtcatcggcttcgcgagctggaacctgaaccacttcatcaacgggcagaccaactaaccccggcgtggccggaaccggcgcgacgtctacnttcctggtgttcccatcctggcccccnntgggggggnccgcggcgtcaaagctttggcgggcgtgcaccacgtgcgcgcctggcgccacgacagcctgccacaaaaggccgcgtcgtcgctcatcgcctgggccatcacgggctcggcctttcggctgggnngtgggaaagagacccacatcggngaaaaccccgggcgggggcccctggcccccgttgttgaaaggcctttcgtcatcc

SEQ ID NO: 18465 - protein, 40 aa, Zea mays
  misc_feature: Ceres CLONE 1384620-F
MAGIGRNMVAPLLVLNLIMYIIVIGFASWNLNHFINGQTN

SEQ ID NO: 18466 - DNA, 745 bp, Zea mays
  misc_feature: Ceres CLONE 1384621-F
  misc_feature: Encodes the peptide sequence at SEQ ID NO. 18467
  misc_feature (724)..(724): n is a, c, t, g, unknown, or other
aaaactggagctccccgcggtggcggccgctctagaactagtggatcccccgggctgcaggaattcgcacgagaccattacctagaacatcctaatcgaaaactccccaactcgccgtctgccttctgcgcctccatttcggcctctgtcccttgcaagttcaatctcacctccaaccatgggtaaagagaagtcccacatcaacattgtggttattggccatgtcgactctggcaagtcgaccaccacaggacaccttatctacaagcttggaggcattgacaagcgtgtgatcgagaggtttgagaaggaggctgctgaaatgaataagcggtccttcaagtacgcgtgggtgctcgacaagctcaaggctgagcgtgagagaggtatcaccattgatattgctctgtggaagtttgagaccaccaagtactactgcacggtcattgatgcccctggacaccgtgacttcatcaagaacatgatcactggtacctcccagggctgactgtgctgtccttatcattgactccaccactggtgggttttgaggctggtatctccaaggatggccagacccgtgaacatgctctccttgcgttcaacccttgggagtgaaagcagatgatttgctgctgcaacaagatggatgcaaccactcccaaatactccaagcacgttaaatgaaagagattttgtgaaggaagtctcatcctacctcaanggaaagttggtacaccccctg

SEQ ID NO: 18467 - protein, 109 aa, Zea mays
  misc_feature: Ceres CLONE 1384621-F
  misc_feature (5)..(110): Pfam Name: GTP_EFTU Pfam Description: Elongation factor Tu GTP binding domain
  misc_feature: SWISSPROT Homolog: EC 2.7.7.4 Sulfate adenylyltransferase
MGKEKSHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQG

SEQ ID NO: 18468 - DNA, 687 bp, Zea mays
  misc_feature: Ceres CLONE 1384622-F
  misc_feature: Encodes the peptide sequence at SEQ ID NO. 18469
  misc_feature (380)..(380): n is a, c, t, g, unknown, or other
  misc_feature (411)..(411): n is a, c, t, g, unknown, or other
  misc_feature (417)..(417): n is a, c, t, g, unknown, or other
  misc_feature (477)..(477): n is a, c, t, g, unknown, or other
  misc_feature (485)..(485): n is a, c, t, g, unknown, or other
  misc_feature (497)..(497): n is a, c, t, g, unknown, or other
  misc_feature (507)..(507): n is a, c, t, g, unknown, or other
tggagctccccgcggtggcggccgctctagaactagtggatcccccgggctgcaggaattcgcacgagaccattacctagaacatcctaatcgaaaattgtccgaaaaaatctcagagctccgctgcaatggaggtcactgcgaacgaaccagatatgagaagctccaaatcctctccgagagtaacgataccgaacttcttcgtgtcgctctcctcggcatttacgcaaacaccttccgtgcgtacgaacaagcccagtttgcggcttctaccaccagcttcagactccgtcaagttgattcaagacttccatcgttctctactctccgcgaccgagaaattcgcaggcttcttccactcgctcgccgctgagaacccntctgttcaggaagcggttcgcttgtcctcgnagtttncgcggtggttgcgacgagattcgtttgaggacactaccaggggtaggcttgccatgcggnatcacggnttttgcagcggntctgcctggnagattcatttgcaggaaatgggggttggctaagggtttgataaaatccctcaaatttaaaaaaccggaacttggtggcccgtctaaaaactccccggggttccccagggtcccccttgggaattggtaaacccccccccccctttgggggggccaaaactggaaaaattcccggggggag

SEQ ID NO: 18469 - protein, 136 aa, Zea mays
  misc_feature: Ceres CLONE 1384622-F
  misc_feature (95)..(95): Xaa is any aa, unknown, or other
  misc_feature (97)..(97): Xaa is any aa, unknown, or other
  misc_feature (117)..(117): Xaa is any aa, unknown, or other
  misc_feature (127)..(127): Xaa is any aa, unknown, or other
MEVTANEPDMRSSKSSPRVTIPNFFVSLSSAFTQTPSVRTNKPSLRLLPPASDSVKLIQDFHRSLLSATEKFAGFFHSLAAENPSVQEAVRLSSXFXRWLRRDSFEDTTRGRLAMRXHGFCSGSAWXIHLQEMGVG

SEQ ID NO: 18470 - DNA, 742 bp, Zea mays
  misc_feature: Ceres CLONE 1384630-F
  misc_feature: Translation starting site: 188
  misc_feature (447)..(447): n is a, c, t, g, unknown, or other
  misc_feature (598)..(598): n is a, c, t, g, unknown, or other
  misc_feature (724)..(724): n is a, c, t, g, unknown, or other
  misc_feature (725)..(725): n is a, c, t, g, unknown, or other
  misc_feature (726)..(726): n is a, c, t, g, unknown, or other
aagctggagctccccgcggtggcggccgctctagaactagtggatcccccgggctgcaggaattcgcacgagaccattacctagaacatcctaatcgaaaacttcccttctgtcgctgctcccacctctagcccgacaggtgaagccgccgccgctgcagtgtccatagccaccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaggtgatatggttcttgcttctgcttactcgcatgagttgccacgatnatggtcttgaagttggtctgaccaactatgcagctgcctactgcactggccttctgttggctcgccgtgtgctcaaagacccgtggtttagataaggaatatgagggcaatgttgaggcactgggtgaggatttctctgttgagccagtgnatgagaggaaggcctttccgggttctctctttggatgttggccttattaggactacgactgggaaaccggtgtctttggtgccctcaagaagcttttttggaatgggtggcctggatttctcaggnnnagaaaaaaaaaatttt

SEQ ID NO: 18471 - DNA, 718 bp, Zea mays
  misc_feature: Ceres CLONE 1384631-F
tggagctccccgcggtggcggccgctctagaactagtggatcccccgggctgcaggaattcgcacgagaccattacctagaacatcctaatcgaaaaattcccttctgtcgctgctcccacctctagcccgacaggtgaagccgccgccgctgcagtgtccatagccaccgcaggagactgagatgtgggtgtttgtctagacccacaagagcaatgcgtacttcaagcgtttccaggcgaagtgcaagagaaggcgcgctggagagatggactacggggacagcataacggtgattaccctggactaaaacaagtacaatactcccaactacagagttgttgcgcgatttaccagcaagggcatcaccgctcaaatcatctctgctaggatagcaagcgatatggttcttgctcccgctgactcgaatgagctgaccctatatggtcttgaagatgatctgaccttctatgcaactgatctactgtactgagactacagtcgccacgctgcgtgcccacgactcgccctgcttacgaggcatataaggtgatcgtggcagccttggccagagatttctctggtcaaacacgtggagataggatgtctttccgtgctctccggcaggttcatctgactatgcatacaactcgttcactgtgatgttggagctttgaaggtatgtatatttaacgttgcttgtattcctgacgcaaagg

SEQ ID NO: 18472 - DNA, 671 bp, Zea mays
  misc_feature: Ceres CLONE 1384633-F
  misc_feature: Translation starting site: 516
  misc_feature: Pfam Name: Prp19 Pfam Description: Prp19/Pso4-like
aagctggagctccccgcggtggcggccgctctagaactagtggatcccccgggctgcaggaattcgcacgagaccattacctagaacatcctaatcgaaaaaaaatgacacctctcaaataaccctaacggcaaaacctttgctccgtcccgccggctgctgctccacatcccgccgccggcgctgacacccgcatctgccaagggcctcgccgccgagaaagctgctctgcgtcgtccgctctctcccgcgcccaaacatggacctcccctcctccatgatctgcgcgagaccatgctaagtgatgcgccaccaacgaggacctcaccatggatgatgatctgccgtgccaagacaaacactatggcgaagtccactgatttgcaggctgaaaacattccagaactccttgttattgttcagaacgaggggtatggtctcatgatctctaataatgctatgtagcacaagctacacacagcaaaagaagaacttaggcatgcactctaccagtcatgacgctgatctgccgtgtgatagccagattaaagaaggaaagagatgacggtagagcacttttggctcaagctgagagacagatacctgcgtcagttgcaggagctgctcctgcagatgttgtttccatggaaccagagtaaatgaagatgaaa

SEQ ID NO: 18473 - DNA, 726 bp, Zea mays
  misc_feature: Ceres CLONE 1384634-F
  misc_feature: Encodes the peptide sequence at SEQ ID NO. 18474
  misc_feature (642)..(642): n is a, c, t, g, unknown, or other
  misc_feature (682)..(682): n is a, c, t, g, unknown, or other
tccccgcggtggcggccgctctagaactagtggatcccccgggctgcaggaattcgcacgagaccattacctagaacatcctaatcgaaaaatctcatcttcgtctgtgttcttgggcgtacgcggacacagccccgatccgaatcgtcgtccttgcgagcctcgccgatcccccactcccctcccctcgcttcaagatgcagatctttgtgaagaccctcaccggcaagactatcaccctcgaggtggagtcttctgacaccattgacaatgtcaaggctaagatccaggacaaggagggcatccctcctgaccagcagcggcttatcttcgccggcaagcagcttgaggacggacgcacacttgctgactacaacatccagaaggagtcaaccctccacttggtgctgcgccttaggggaggcatgcagatctttgtcaagaccttgactggcaagacaatcacccttgaggtggagtcctcagacaccattgacaatgtcaaggcaaagatccaggacaaggagggcatcccacctgaccagcaacgtctcatctttgccggcaagcagttggaggatgggaggacccttgctgactacaacatccagaaggagagcaccctccacttggtgctgcgtnctaggggtggtatgcagatctttgtgaaacccttactggncagacatcactcttggagtggagtcttcagatacattgacatgt

SEQ ID NO: 18474 - protein, 176 aa, Zea mays
  misc_feature: Ceres CLONE 1384634-F
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (149)..(149): Xaa is any aa, unknown, or other
  misc_feature (162)..(162): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGIPPDQQRLIFAGKQLEDGRTLADYNIQKESTLHLVLRXRGGMQIFVKPLLXRHHSWSGVFRYIDM

SEQ ID NO: 18475 - DNA, 795 bp, Zea mays
  misc_feature: Ceres CLONE 1384635-F
  misc_feature: Translation starting site: 238
  misc_feature: SWISSPROT Homolog: EC 1.1.1.184 Carbonyl reductase (NADPH)
  misc_feature: SWISSPROT Homolog: EC 1.1.1.5 Acetoin dehydrogenase
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (795)..(795): n is a, c, t, g, unknown, or other
actctaccccccctcccctcttcccgatctcacannnggggnnnnnnnaaaagctggagctccccgcggtggcggccgctctagaactagtggatcccccgggctgcaggaattcgcacgagaccattacctagaacatcctaatcgaaaaaattctattactagctgcataagggcgtgttcgagactagcggaccgaccttgaagatgaagttgaaaaggacggcctgcgcggcgatggatgtcaagtgccggcgtctggaggggaaggtggccatcgtgacggcgtccacgatggggatcggcctcgccatcgccgagcgcctcggtctggagggcgccgccgtcgtcatctcctcccgcaagcagaagaacgtgaacgaggcggtggaggggctcagggccaagggtatcaccgcggttggtgccgtctgccacgtctccgacgcacagcagcgcacacagcctcatcgagacggccgtcaagagctttgggcacatagatattcttgtctccaatgctgccgcaaatccttctgtagatagcatacttgacatgaaagagtctgttctcgataagttgggcgaaattaacgtcaagggcttctatccttcttacccaggatgctgctcctcacctacgggaaggggccatcctgggactattattttcttccatggccgggttacaatccacaaacaaggaattggacaatcgaatggttgcccacaaagacctggctcctcttttggccctcccaaaagggccccttggcttgggggggaaggggaacn

SEQ ID NO: 18476 - DNA, 714 bp, Zea mays
  misc_feature: Ceres CLONE 1384638-F
  misc_feature: Encodes the peptide sequence at SEQ ID NO. 18477
tggagctcaccgcgggggcggccgctctagaactagtgggatcccccgggctggaggaattcgcacgagaccattacctagaacatcctaatcgaaaaaatgccaatgctgctccgccctgctcgaggtgcagaccagatcgccgtcggaggcaagcgctcacagcgtgttgcctggtccgtctcccggtgggcaatgctgatgccggactggttatccgaaggaatagatgctacggggggtctgctcccggtcagggttcctggcgcgccgcctcggggcccagccccagccccagcccggcgtgagtctgagccgccggcacaaccacactcgccggcgcgcggtgaaggttcttgaagaggacgacgcggggccttcttcacctgcgacggacgcctccgagcagtcccggcggttggaggaggcgatcgacagcgccatggcgcggatggccgagcccgactgggcgcccttccggcccgggacatcctacttcgctccgccccggcccgccggcgcgggcccttgggggttctcgcgcttatcggccacgctaggcgggttcatgggctcctcggcagcgccgaggcggggactctctgccgacgaggcccgcgccgtcgcaccttcctcccgcggttacccgtgctcgactaatttcatcgaaggctgctttccaaagggaagtggagatcccaaatatggatgcca

SEQ ID NO: 18477 - protein, 161 aa, Zea mays
  misc_feature: Ceres CLONE 1384638-F
MLRGVCSRSGFLARRLGAQPQPQPGVSLSRRHNHTRRRAVKVLEEDDAGPSSPATDASEQSRRLEEAIDSAMARMAEPDWAPFRPGTSYFAPPRPAGAGPWGFSRLSATLGGFMGSSAAPRRGLSADEARAVAPSSRGYPCSTNFIEGCFPKGSGDPKYGC

SEQ ID NO: 18478 - DNA, 454 bp, Zea mays
  misc_feature: Ceres CLONE 1384642-F
  misc_feature (191)..(191): n is a, c, t, g, unknown, or other
aagctggagtccccgcggtggcggccgctctagaatagtggatcccccgggctgcaggaatcgcacgagaccattacctagaacatcctaatcgaaaccaattcgtctactgctcctcagctcctcgctgcgccgccggtcgccgcccgacaccgccgaagaagagcagacgcccgagtcccaggacgtcngccgcggggctcggggaacgcgtggttgcatcgcgaggaaggtcggaaagttccttggtccgccgcgcgggattgggaaccggcccccaacccgcccaggggaaacggcgcccccccgggggtccccgaccccgggaaatttccccaagggggggcccccccgggcttttctcgccccgttaaaaaaaggaaaaaaaggggggttttaaaaaaacccccgggggttttttggggagaatttgtttcaaaaaggcggggggaga

SEQ ID NO: 18479 - DNA, 744 bp, Zea mays
  misc_feature: Ceres CLONE 1384644-F
  misc_feature: Encodes the peptide sequence at SEQ ID NO. 18480
  misc_feature (386)..(386): n is a, c, t, g, unknown, or other
  misc_feature (509)..(509): n is a, c, t, g, unknown, or other
aagctggagctccccgcggtggcggccgctctagaactagtggatcccccgggctgcaggaattcgcacgagaccattacctagaacatcctaatcgaaaaaccaataaaaaggtagagaatacaagaaaccgtcacgaccgcctccgcggtgctctaccatccgttccatggcgccgccgctcgccctgtttcttctcgccgccatcgtgctctcgcgggccgtctcccacgcccacggcggcggcggcggcttctacgacccggcgagcgtcactcagctctcctcgcgccccagggcgttcctgtacagcggcttcctctcggacaccgagtgcgaccacctcgtcagcctggcgaaaggcagcatggagaagtcgatggtgncggataacgactccgggaagagtgtggcgagctaggcgcgcaccagctccggcacctttcttgccaagcgcgaggatgagatcgtgtctgcgattgagaaacgcgtagctgcttggaaatttnctccggaggaaaacgcgaatcactccaggtcctgggctacgaacccggccagaagtatgacgccccctttgaactatttccccgaaggaaacaaactgaaactccgcggccaagggagttggacccgccttatgtccctccccaaattctcaaaaaagggggaaaaacttttatttccaaaccgtgggggagaacttttaacgaaaaagggaaaaattttggggcggaggggttt

SEQ ID NO: 18480 - protein, 83 aa, Zea mays
  misc_feature: Ceres CLONE 1384644-F
  misc_feature (73)..(73): Xaa is any aa, unknown, or other
MAPPLALFLLAAIVLSRAVSHAHGGGGGFYDPASVTQLSSRPRAFLYSGFLSDTECDHLVSLAKGSMEKSMVXDNDSGKSVAS

SEQ ID NO: 18481 - DNA, 666 bp, Zea mays
  misc_feature: Ceres CLONE 1384648-F
  misc_feature: Encodes the peptide sequence at SEQ ID NO. 18482
  misc_feature (464)..(464): n is a, c, t, g, unknown, or other
tggagctccccgcggtggcggccgctctagaactagtggatcccccgggctgcaggaattcgcacgagaccattacctagaacatcctaatcgaaaaattgtggctcctcacttccgcgccgccacccctacaggtaaggaagaggaggagggcaggatgtcgcaccgtaagttcgagcacccgaggcacggctccctcggcttccttcccaggaagcgctcctcccgtcaccgcggcaaggtgaagtcattccctagggatgaccccaagaagccttgccatctcactgccttccttggctacaaggctggcatgactcacattgtccgtgaggttgagaagccaggatccaaactccataagaaggaaacttgtgaggctgttaccatcattgaaacccctcctcttgtcattgttgggctcgtggcatatgtgaagactcctcgtggcctccgcacactcnaactctgtttgggcccacatcttagcgaaaagtggaggagaaggttctacaagaactggtgcaagagcaagaagaaggctttcacaaagtatgctctcaaatatgaaaatgatgctggcaagaaggaaaatcagctgcagcttggagaagatgaagaattatgctttctggtatcccgtgtcattgctcataccaagattag

SEQ ID NO: 18482 - protein, 169 aa, Zea mays
  misc_feature: Ceres CLONE 1384648-F
  misc_feature (50)..(169): Pfam Name: Ribosomal_L3 Pfam Description: Ribosomal protein L3
  misc_feature (103)..(103): Xaa is any aa, unknown, or other
MSHRKFEHPRHGSLGFLPRKRSSRHRGKVKSFPRDDPKKPCHLTAFLGYKAGMTHIVREVEKPGSKLHKKETCEAVTIIETPPLVIVGLVAYVKTPRGLRTLXLCLGPHLSEKWRRRFYKNWCKSKKKAFTKYALKYENDAGKKENQLQLGEDEELCFLVSRVIAHTKI

SEQ ID NO: 18483 - DNA, 656 bp, Zea mays
  misc_feature: Ceres CLONE 1384654-F
  misc_feature: Translation starting site: 191
aagctggagctccccgcggtggcggccgctctagaactagtggatcccccgggctgcaggaattcgcacgagaccattacctagaacatcctaatcgaaaaatcagtcatcacccaccgcctccgccgccgacaacagcgtagtgtagtgtagttccggagagggttggggagagtagtagtgatccgcaatgtcgacggaggaggctgttgtggctgaggtcccggtgaccgaggtgccagcggaggtcccggcggcccaggtggccgaggcgcccaaggcgaagaaggcgcccaaggagaagaaggcgcctaaggagaagaagctttccgcggcgaagaagccggcggcgcaccctccctacgctgagatgattgtagaggcgatgcctgccctcataggagaggaaggggtcgagctcggtgggcatcagcaagtacgtcgaggggaagcatggcggcaagctccccaccaacttccgtaagcagctcactgtgcagctgaagaagctcgctgtcgccggacagctgacgagggtgaaagaactccttttagctggccggccaccgagggccatgcttcaggcgcgccaaaggcgagggtaccccaaggccggggctaaagtcgtgagcccttttgccgtatgcgcgaaggcc

SEQ ID NO: 18484 - DNA, 674 bp, Zea mays
  misc_feature: Ceres CLONE 1384657-F
  misc_feature: Translation starting site: 172
  misc_feature (550)..(550): n is a, c, t, g, unknown, or other
  misc_feature (554)..(554): n is a, c, t, g, unknown, or other
aagctggagctccccgcggtggcggccgctctagaactagtggatcccccgggctgcaggaattcgcacgagaccattacctagaacatcctaatcgaaaaatcaccaccactgggtcttcagaccattagctttatctactccagagcgcacaagaacccgatcgacaccatgagggtgttgctcgttgccctcgctctcctggctctcgctgcgagcgccacctccacgcatacaagcggcggctgcggctgccagccaccgccgacgtttcatctaccgccgccggtgcatctgccacctccgtttcacctgccacctccgtggcatctcccaccgccggtccacctgccgccgccggtccacctgccaccgacggtccatgtgccgccgacggttcatctgccgccgccaccatgccactaccctactcaaccgccccgggctcagcctcatccccagccacacccatgcccgtgccaacagccgcatccaagcccgtgccagctgcagggaaacctgcggcgttggcagcaccccgatcctgggncagntgcgtcgagttcctgaggcatcagtgcagcccgacggcgacgccctactgctcgcctcagtgccagtcgttgcgggcagcagtgttgccagcagctccaggcaggtggagccgcagcacg

SEQ ID NO: 18485 - DNA, 709 bp, Zea mays
  misc_feature: Ceres CLONE 1384659-F
  misc_feature: Encodes the peptide sequence at SEQ ID NO. 18486
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
tggagctccccgcggtggcggccgctctagaactagtggatcccccgggctgcaggaattcgcacgagaccattacctagaacatcctaatcgaaaaattttttttgtttggttgttcctctcgctcgccagtcgccaccaggcagcaggcatcccaatctcgcgagagccagtagcggcggcggcgcttccggcttcccttcccattggcctccgggatggcgctccgcctccacgacgtcgcgctctgcctctccccgccgctcgccgcccgccgccgcagcggcggcagtttcgtcgccgtcgcctccatgacgtccgccgccgtctccaccaggggggagaacaagaagccattttgcttcctccgagggagggaacattggccaggttaacccatttcaagggggccctccccccaaaaannnnaaaattttccccccccgggggggggggaaaaaaaattttggcaccccccccccccaaaaaagggggggccaacagttttcccccccccccccccttgaaggtttttgcggagaaaaaaggggcccaaaaaaggggggggggggaccccccggggattatttttttttgggggggggggggggaattttttggggggggtcccccccccccaccccaccttgtgtttttttccccccccccgccgcccagagaaaaaaaaaaaaaagacggccccccccca

SEQ ID NO: 18486 - protein, 58 aa, Zea mays
  misc_feature: Ceres CLONE 1384659-F
MALRLHDVALCLSPPLAARRRSGGSFVAVASMTSAAVSTRGENKKPFCFLRGREHWPG

SEQ ID NO: 18487 - DNA, 799 bp, Zea mays
  misc_feature: Ceres CLONE 1384660-F
  misc_feature: Encodes the peptide sequence at SEQ ID NO. 18488
  misc_feature (476)..(476): n is a, c, t, g, unknown, or other
  misc_feature (553)..(553): n is a, c, t, g, unknown, or other
  misc_feature (799)..(799): n is a, c, t, g, unknown, or other
tacccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatcaagctgcggtgaccgccgcgccgcagtcgacgcgaggcgctctncgggttttttgcgacggcggagccgaagcagggcgcgaccatggtggcgccatcgtccccgcagggcgttcccgggnttcgcggtcgtgcccagggcccaggggggtcgagaacatagcgccccccgcgtcccgaggccccttccccggggttttgcgtgacgcccgggctcggccacacaaggtggtttcccggtgagccgccccccccgcaggtggacacccatgatgggctccgcaacagcagcatttcgcgcctggcggatggtgctggctcccagccaaggttatgcagatggctcctcaagcccctcaagcccaagn

SEQ ID NO: 18488 - protein, 103 aa, Zea mays
  misc_feature: Ceres CLONE 1384660-F
  misc_feature (64)..(64): Xaa is any aa, unknown, or other
MTYVNPDPQPLAAATADDSATQHQAAVTAAPQSTRGALRVFCDGGAEAGRDHGGAIVPAGRSRXSRSCPGPRGVENIAPPASRGPFPGVLRDARARPHKVVSR

SEQ ID NO: 18489 - DNA, 1111 bp, Zea mays
  misc_feature: Ceres CLONE 1384671-F
  misc_feature (1)..(1): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (25)..(25): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (816)..(816): n is a, c, t, g, unknown, or other
nttcccccccccccccccnnnnaancaataatgtnnnggccgcccccacaaagctggagctccaccgcggtggcggccgctctagactagtggatcccccgggctgcaggaattcgcacgagaccattacctagaacatcctaatcgaaaaaaaacacctccgatccgtccccgatcatcgcaccacctgtagcccacctcgctctcgagtctcgacccagcgacgagatggccgcggcggatctgaccccagggacgcccaagaaggcctacggcggggagcggggggcctacaacgagtggagccccgccgacctgcctatgctcgccgccccctccatcggggcccgccaacttctcggtcgccggcgggggggcctcccctccgccggatactccgaattccgccagggtccccccccggccagggaggggggggggaacctggcgcccctctaacctcccccgaagctgacaaacggaaaaacgtggaaggaggggggacgggaagggccacccccccctggccgcctggccccttcccggccccgggcgagctcccgggtgggccccaaacgggccccccggcaccgcgccaaggagtcctgaacccccctcgggggggtttgttctcccgtcggtgaggacaccggtcaccaatgggggacccacaaccacggggagcgggtcagaggttactaccctctacgccctccaccgccgcttcaacggccgcctccctccccccggcgccctccctccttacgcacgcgcgccccccgactgcccacccacgacgcttctcggctcgcggcncgtgcgccgccgcgccggatatagcatcggcggggacgcaccacggctccccgcccgcggggcggccgggcgccccaacaaccgacagagcggcgagaccacggagcaggcccacaccaaatcggcatgaaccgaccatcacacccacccgcacggcccgcgccgcgccggtggaggcaggcctccgcacgccgagaggaggcgacggggcagaggtggggggggaagatctcgtggagcgttggctcgcgcccccatcctgcgaggtgcgcggctcttacacgccgcacgcggg

SEQ ID NO: 18490 - DNA, 1073 bp, Zea mays
  misc_feature: Ceres CLONE 1384673-F
  misc_feature: SWISSPROT Homolog: EC 2.7.1.4 Fructokinase
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (15)..(15): n is a, c, t, g, unknown, or other
  misc_feature (42)..(42): n is a, c, t, g, unknown, or other
nnccccccccncccncccccccccccccccccccccacgggncggccccgcaacactggagctccccgcggtggcggccgctctagaactagtggatcccccgggctgcaggaattcgcacgagaccattacctagaacatcctaatcgaaaaaacaccaccgcagccgcagcacaatcgcctcgccttcccttccccaccagcccccgtctctctctctctctctctgtctctctctcgaaggcgcgtccatctcgcagcaggaagcaagcgcgaccaaatggcgcctctaggatacgggggaactgttggcgggggcggggtccaacaacctgggggggccgttcggggggatgctggatgaactcgcccccgacgcggccggtctgtcgctggccgaggcggggggtttcgtcaaggcccccggggggcggggccgccaacggtggctgggggcatcggcacagctcggggggctccccccgcccttgcgccggcagggtccgccggaccgacagagttgcggggaaccatggggggcggaacatcccctcgaaacccaaaacccacccgtgaaaccccccgaagggcgcggcccctggtccgggaagaagggagccggggggaatcgggggcgctgggaccctttgggggggaaccccctccaagggccacgaggaagaggggcggcccgccaggacgcgcctccatgtggtcccacacccggcgaaaccccccccgaaggggcgggggcacaccttcggctgtcattaccacaaagaaacagtgcggagaaatgtgtcaacactgggggcctaccttatggatcgcctgccccaccaccacagacgttgtctctccctcaccacaggcgggtgcccccatgcgcggggtgtcattcgcgccgaaaaaccctgcgtgccgcctctgggtggtggaaataggggggcggccgcaaggggtcggggaaaacctagggcggcccgggaccgcgccggggcatcgtgggccgcgaaaacacacccaaagcggggcgccctcccgcccttcgcgtggggggcgccccaagggcg

SEQ ID NO: 18491 - DNA, 665 bp, Zea mays
  misc_feature: Ceres CLONE 1384678-F
  misc_feature (303)..(303): n is a, c, t, g, unknown, or other
  misc_feature (304)..(304): n is a, c, t, g, unknown, or other
tccccgcggtggcggccgctctagaactagtggatcccccgggctgcaggaattcgcacgagaccattacctagaacatcctaatcgaaaaacctttagcgttagcacagacacacacaggtaaggagagcgagaggtgggttgggtttgatcggagacagggacgaggcagagcatgggtagggggccatcaacagaattcccaatttgatttctgtttgctcgctcacaaaatggagggactcacccacaacacactcaggcgttgggtgctccctcccctgcactggcctcttccctggnntctccacggtctcccattccaactatccccctccctttctctcctccccggaaggggttttgggtaaaatttttttttccgggatttcttttctcccaggaaaaaagcccccacaccaaaaatttgggctgggctttttgtccccccaaataataaataaaacccccggggggccccccgggaaaaagggggttaaaccaaaatttctttttgggaaggggggggggggggggaaaaaaacccccccccccccttttttttttttatccctcttttttcgggggaggattaaacacccccccccccccataaaaaaaaaagccgccccccccccccccgccccgggtgttgggcgggggcg

SEQ ID NO: 18492 - DNA, 807 bp, Zea mays
  misc_feature: Ceres CLONE 1384680-F
  misc_feature: Encodes the peptide sequence at SEQ ID NO. 18493
  misc_feature (421)..(421): n is a, c, t, g, unknown, or other
  misc_feature (656)..(656): n is a, c, t, g, unknown, or other
  misc_feature (807)..(807): n is a, c, t, g, unknown, or other
tccccgcggtggcggccgctctagaactagtggatcccccgggctgcaggaattcgcacgagaccattacctagaacatcctaatcgaaaaacgatcacacaccactccacagcagtagcaagagggatagagcaaggccacacacacacacacaccactagtaggctagcctagccttttagtcgtcgaggaggagcaagaagggcgcgcacgcaagcaggcaagcaagaagagagccgatcgaccgagagctagcacgcgatggcgaggtcttccaagatgatggtggcggcagctctgctggacttggccctggccgtgtcgaccgccgaggagaggaacatcaagaccacgaccaccgataagaaggacgacgcggtgttgcagccgcagaccttctcgcccttcgaccgcctcggnggaggcgcgtccccggagttcggcggtctccccggcggcagcattcctggcagcagcattcgcgggttcagcatgcccggcagcggcagcagcctacccgggttcagcttgcccggcagcggcagatgccctcctttcggcggcggatccccggggcttcagcggcatacggcggaatgccccgggtcgccgaccggcggctccgtccccgagcacgccacaagccctgaacgcnacaagcgtgggtaatagagtggcgctactgttactggaaaaacgtcggcatatcctggactcccaagtggttaaggggttttcccctgcgtcataccaagcaacaactgggcccttgcaaccgggccgaacggctagctagttttattatn

SEQ ID NO: 18493 - protein, 135 aa, Zea mays
  misc_feature: Ceres CLONE 1384680-F
  misc_feature (132)..(132): Xaa is any aa, unknown, or other
MARSSKMMVAAALLDLALAVSTAEERNIKTTTTDKKDDAVLQPQTFSPFDRLGGGASPEFGGLPGGSIPGSSIRGFSMPGSGSSLPGFSLPGSGRCPPFGGGSPGLQRHTAECPGSPTGGSVPEHATSPERXKRG

SEQ ID NO: 18494 - DNA, 757 bp, Zea mays
  misc_feature: Ceres CLONE 1384681-F
  misc_feature: Encodes the peptide sequence at SEQ ID NO. 18495
  misc_feature (364)..(364): n is a, c, t, g, unknown, or other
  misc_feature (376)..(376): n is a, c, t, g, unknown, or other
  misc_feature (377)..(377): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (478)..(478): n is a, c, t, g, unknown, or other
  misc_feature (504)..(504): n is a, c, t, g, unknown, or other
  misc_feature (505)..(505): n is a, c, t, g, unknown, or other
  misc_feature (529)..(529): n is a, c, t, g, unknown, or other
  misc_feature (553)..(553): n is a, c, t, g, unknown, or other
  misc_feature (724)..(724): n is a, c, t, g, unknown, or other
  misc_feature (725)..(725): n is a, c, t, g, unknown, or other
  misc_feature (731)..(731): n is a, c, t, g, unknown, or other
  misc_feature (732)..(732): n is a, c, t, g, unknown, or other
  misc_feature (733)..(733): n is a, c, t, g, unknown, or other
  misc_feature (734)..(734): n is a, c, t, g, unknown, or other
  misc_feature (741)..(741): n is a, c, t, g, unknown, or other
  misc_feature (749)..(749): n is a, c, t, g, unknown, or other
  misc_feature (750)..(750): n is a, c, t, g, unknown, or other
cgctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcgnaagagggatgcnnagagcgagtgccgcgagcggcaccagcaagctgacgcgggcgagggacggcgacagcgcgtggacgcctactctccgctcgnnnaagggggcgagtgccgncgccagtgcctgcgccgcacgaaggnncagccgtggaaaacccagagggcnatgaggcggtgcccgccgcgcggnactgcccgtcaactggaagcaaagagtacggtccgggaagcaagaacggcgggcaaggtcccccgggaaaaggggcaagggccccccccggggggaattggggggggaaaaggaaaccctttccctggaggtgtggtgaaaaacccgcgggggggggggggaaaaaagagnntccggnnnngcggggncccctccnnctggagg

SEQ ID NO: 18495 - protein, 190 aa, Zea mays
  misc_feature: Ceres CLONE 1384681-F
  misc_feature (64)..(64): Xaa is any aa, unknown, or other
  misc_feature (91)..(91): Xaa is any aa, unknown, or other
  misc_feature (92)..(92): Xaa is any aa, unknown, or other
  misc_feature (106)..(106): Xaa is any aa, unknown, or other
  misc_feature (179)..(179): Xaa is any aa, unknown, or other
  misc_feature (180)..(180): Xaa is any aa, unknown, or other
  misc_feature (182)..(182): Xaa is any aa, unknown, or other
  misc_feature (183)..(183): Xaa is any aa, unknown, or other
  misc_feature (185)..(185): Xaa is any aa, unknown, or other
  misc_feature (188)..(188): Xaa is any aa, unknown, or other
MGKGSVGASWWAFLLLAGVLLVVAATAGAEDGVVERDRKEDLRWCKQACEWQYGKDTPRKRDAXSECRERHQQADAGEGRRQRVDAYSPLXXGGECRRQCLRRTKXQPWKTQRAMRRCPPRGTARQLEAKSTVREARTAGKVPREKGQGPPPGGIGGGKGNPFPGGVVKNPRGGGGKKXXRXXGXPSXWR

SEQ ID NO: 18496 - DNA, 779 bp, Zea mays
  misc_feature: Ceres CLONE 1384689-F
  misc_feature: SWISSPROT Homolog: EC 2.1.3.3 Ornithine carbamoyltransferase
  misc_feature (245)..(245): n is a, c, t, g, unknown, or other
  misc_feature (369)..(369): n is a, c, t, g, unknown, or other
  misc_feature (372)..(372): n is a, c, t, g, unknown, or other
  misc_feature (397)..(397): n is a, c, t, g, unknown, or other
  misc_feature (406)..(406): n is a, c, t, g, unknown, or other
  misc_feature (415)..(415): n is a, c, t, g, unknown, or other
  misc_feature (422)..(422): n is a, c, t, g, unknown, or other
  misc_feature (488)..(488): n is a, c, t, g, unknown, or other
  misc_feature (494)..(494): n is a, c, t, g, unknown, or other
  misc_feature (522)..(522): n is a, c, t, g, unknown, or other
  misc_feature (532)..(532): n is a, c, t, g, unknown, or other
  misc_feature (533)..(533): n is a, c, t, g, unknown, or other
  misc_feature (546)..(546): n is a, c, t, g, unknown, or other
  misc_feature (566)..(566): n is a, c, t, g, unknown, or other
  misc_feature (598)..(598): n is a, c, t, g, unknown, or other
  misc_feature (599)..(599): n is a, c, t, g, unknown, or other
  misc_feature (611)..(611): n is a, c, t, g, unknown, or other
  misc_feature (652)..(652): n is a, c, t, g, unknown, or other
ggagctccccgcggtggcggccgctctagaactagtggatcccccgggctgcaggaattcgcacgagaccattacctagaacatcctaatccaaaaaggccctagcaacaaatccgtatcccgagtccggcgacggcagtatccgagctcgcactcgcgcacccgtccatcgcatcgcatctgtcctcccatcccctcagcgccaccgcaccgcaatcacacgcgcgccacccgcgatgacgccnggcggcggcgatctccggctccagcagccacgtcgtcgtctcctccgcccgcctcaggcagccgttcacgctccctccgcgcaccgcttgcccaatcgccgccgccgcctcgcccgtgacccgncgngggggtcgcggtcgccgccgtgtcnagcccccgntgtgtccgncgccgcngggggaggatgccaaacaggctccctagggatttcctttcaatcatttgatttttgacaggatacnattaantgaagattcttaatcgagccatcgaggntaaggcaatnnggataagtctggnagaccagagcttccaaccgntcaaaggggaaacatggcccatgattttttgnncagcatcatganggacccgtgtttcatttgagaacgggattctttttactggntggcatgctatttaatttggggtcagatgatatccagatggcaaacgtgagaaaactctgatggttgctagagtacttccgggctatatgactcatatagggctagggtctttgctcacaagaaaat

SEQ ID NO: 18497 - DNA, 800 bp, Zea mays
  misc_feature: Ceres CLONE 1384690-F
  misc_feature (587)..(587): n is a, c, t, g, unknown, or other
  misc_feature (685)..(685): n is a, c, t, g, unknown, or other
  misc_feature (798)..(798): n is a, c, t, g, unknown, or other
tggagctccccgcggtggcggccgctctagaactagtggatcccccgggctgcaggaattcgcacgagaccattacctagaacatcctaatcgaaaaacctagcgcagcgaagccggcacaatgccagccgccgccgtagtctcccctctcctcctctcgctctcctcgtcctcctcccccttcctctcttcctcatccacctcctttttcccaccctcctccgctgccgtcactccacacgccgccgtcaggacgagggcggctgtctccgtcctccgcgcgctgcgcgccgaggcggccaccctccccgtgctctcattcaccggagagaaggtcggggaggtaaccctcgacctcaaatccgcgccaccctccaccgcgcgcgctgtcgtgcaccgcgctatcatcaccgaccgccagaacgcgcgccgaggcacggtctccacgctcacccgcggagaggtcagaggcggagggaggaagccctatcagcacaagaagacggtgaaggcgcggcggaggtcgcagcgtaccccgcttcgtcccggtgggggcgtcgtgttcggcccaagccccgcgactgggntcatcagtatcatccgcaggagaagcgccttggcatctccactggcatcgtgagcgccgccaggacgccttcgttgtcgaggagttcgagcaggcttncgcgtcggtgccaaggaccagggatttcgtgccgctttgcagggggtggggcttgacccgagacagaagccatgttctttgcacggacttcgacgacatgtggggctcagggnag

SEQ ID NO: 18498 - DNA, 817 bp, Zea mays
  misc_feature: Ceres CLONE 1384692-F
  misc_feature: Encodes the peptide sequence at SEQ ID NO. 18499
  misc_feature (527)..(527): n is a, c, t, g, unknown, or other
  misc_feature (534)..(534): n is a, c, t, g, unknown, or other
  misc_feature (576)..(576): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (586)..(586): n is a, c, t, g, unknown, or other
  misc_feature (587)..(587): n is a, c, t, g, unknown, or other
  misc_feature (596)..(596): n is a, c, t, g, unknown, or other
  misc_feature (643)..(643): n is a, c, t, g, unknown, or other
  misc_feature (647)..(647): n is a, c, t, g, unknown, or other
  misc_feature (689)..(689): n is a, c, t, g, unknown, or other
  misc_feature (699)..(699): n is a, c, t, g, unknown, or other
  misc_feature (732)..(732): n is a, c, t, g, unknown, or other
  misc_feature (748)..(748): n is a, c, t, g, unknown, or other
  misc_feature (750)..(750): n is a, c, t, g, unknown, or other
  misc_feature (790)..(790): n is a, c, t, g, unknown, or other
tccccgcggtggcggccgctctagaactagtggatcccccgggctgcaggaattcgcacgagaccattacctagaacatcctaatcgaaaaactggataattcgctcgctccgctcgatgcccgcttgtttgcggtgaagcctccggcgaacagccgtagcggaaacgccgcccgagatgtctgctccctccgccccaccccgcacggtgatctgtgtgggcgacgtccacggctacatcacgaagctggagagcctctggtccaacctccaggccgcactccccgccgacgccttcgccaccgcgctggtcatcttcctcggcgactacaacgaccgcggcccgcacacccgcagggtcctcgacttcctcctcgcgctcccgacgcgctaccccgcgcagcgccacgtcttcctctgcggcaaccacgacctcgccttcgcggcgttcgtcggggcgctgccgccgccgcccgacggctccccgttctcggccacctgggacgagtacatccacaacgaggagcnacgaggngtgggttccgcgggcccgggattcgagggcatgcacgtgcangnnnagcggnngggggcggngtcatccaagggagaggtggaacccccaagagggggcctcccgtacnaggnctccatctacgacgcgcagcccacttcgaaatcctatggcgncgcccatggntcctctgatctttgcaaggctgtgcagaggaancacaagagttctgccnangagaatttggtttggatacatggaaaaggaaaatgggcanttttttattttggatgggaggaaaatc

SEQ ID NO: 18499 - protein, 213 aa, Zea mays
  misc_feature: Ceres CLONE 1384692-F
  misc_feature: SWISSPROT Homolog: EC 3.1.3.16 Phosphoprotein phosphatase
  misc_feature (117)..(117): Xaa is any aa, unknown, or other
  misc_feature (133)..(133): Xaa is any aa, unknown, or other
  misc_feature (134)..(134): Xaa is any aa, unknown, or other
  misc_feature (135)..(135): Xaa is any aa, unknown, or other
  misc_feature (137)..(137): Xaa is any aa, unknown, or other
  misc_feature (140)..(140): Xaa is any aa, unknown, or other
  misc_feature (156)..(156): Xaa is any aa, unknown, or other
  misc_feature (157)..(157): Xaa is any aa, unknown, or other
  misc_feature (171)..(171): Xaa is any aa, unknown, or other
  misc_feature (185)..(185): Xaa is any aa, unknown, or other
  misc_feature (191)..(191): Xaa is any aa, unknown, or other
  misc_feature (205)..(205): Xaa is any aa, unknown, or other
MSAPSAPPRTVICVGDVHGYITKLESLWSNLQAALPADAFATALVIFLGDYNDRGPHTRRVLDFLLALPTRYPAQRHVFLCGNHDLAFAAFVGALPPPPDGSPFSATWDEYIHNEEXRGVGSAGPGFEGMHVXXXRXGAXSSKGEVEPPRGGLPYXXSIYDAQPTSKSYGXAHGSSDLCKAVQRXHKSSAXENLVWIHGKGKWAXFYFGWEEN

SEQ ID NO: 18500 - DNA, 877 bp, Zea mays
  misc_feature: Ceres CLONE 1384696-F
  misc_feature: Encodes the peptide sequence at SEQ ID NO. 18501
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (43)..(43): n is a, c, t, g, unknown, or other
  misc_feature (44)..(44): n is a, c, t, g, unknown, or other
  misc_feature (877)..(877): n is a, c, t, g, unknown, or other
nnnnnnttttnnnnnnnnnnccccctccaccccaccgcggcannattcaaagctggagctccaccgcggtggcggccgctctagaactagtggatcccccgggctgcaggaattcgcacgagaccattacctagaacatcctaatcgaaaaaacatttcgactctcaactcccaaggtcccttttttttctcgatctggaagcgccgcagtagcagccatggacgtgagcggagcaggcgggaaggcgaagaagggcgcggcggggcgcaaggccggcgggccgacgaagaagtcggtgtcgcggtccgccagggccgggctgcagttccccgtcagccgcgtcgggcggtacctcaaaaagggccggtacgcgcagcgtgtaggcacgggtgcccccgtctacctcgccgccgtcctggaggacctcgcggccgaggtgctcgagctcgccggcaacgcggcaagggacaataagaagacgcgcatcatcccgcgccacgtgctcctcgccatccgcaacgacgaggagctcggtaagctgctggccggcgtcaccatcgcccacgggggggtcctcccccaaatccacactgtgctcctccccaagaaggtggcccgagaaggcggccaaggagccccaagaaggccgccaagtccccccaagaaggcgtaaagggatctcctgccttaaaacaatattacccattagcaatcgggcagtaagactagaatcatgtttaagggaagaacggcaaaggtttctggtccctgcagcccatctggaaacgggtaatttcaggaaattcgggggaccttttccttgctaaattggcaaaaaaagcgggccctaatcctttttggttaaaaaaaaaaaan

SEQ ID NO: 18501 - protein, 151 aa, Zea mays
  misc_feature: Ceres CLONE 1384696-F
  misc_feature (29)..(102): Pfam Name: Histone Pfam Description: Core histone H2A/H2B/H3/H4
MDVSGAGGKAKKGAAGRKAGGPTKKSVSRSARAGLQFPVSRVGRYLKKGRYAQRVGTGAPVYLAAVLEDLAAEVLELAGNAARDNKKTRIIPRHVLLAIRNDEELGKLLAGVTIAHGGVLPQIHTVLLPKKVAREGGQGAPRRPPSPPKKA

SEQ ID NO: 18502 - DNA, 800 bp, Zea mays
  misc_feature: Ceres CLONE 1384703-F
  misc_feature: Encodes the peptide sequence at SEQ ID NO. 18503
  misc_feature (564)..(564): n is a, c, t, g, unknown, or other
  misc_feature (573)..(573): n is a, c, t, g, unknown, or other
  misc_feature (597)..(597): n is a, c, t, g, unknown, or other
  misc_feature (777)..(777): n is a, c, t, g, unknown, or other
tggagctccccgcggtggcggccgctctagaactagtggatcccccgggctgcaggaattcgcacgagaccattacctagaacatcctaatcgaaaaccggtcctccacactccactgtctctcacactcacacagtctcacaaaggctcgtgggctcgaggactgtgctctataaacccccgcccagccggtcacccccaccccatcgcaaatcctcgctcgggcaagaagagccaactgaaaagtattcatccaagaacaccaccccatccgctccaagcacaagtttcgtcttgaagagagccgccaccaccaatggcttgttacaacactgcatctttagcggcgactctgctggcgttcgtgctgacgtttcaggcctgcctcgccgagaggaggctcaccgcgctggtgcaggagccggccataaccatgaggtaccacaagggcgcgctcctgtcgggaaccatcgccgtcaacttcatctggtgacgggacttctcggcgccgcagcgggcggcgatcacagacttcgtctcgtctctgacgcaagaggccccggncgaggccanccaggagcgtcgagggcacgtgantcacgacggagcgcaagtactactccagctccaaaggagcgttcacggtgatgcagctcggatcccacgcagagaacggaactgctacactcgcaggggcctgacgcagagggacctgctcaggctcgacgccagggaagcccgagctgcgcatcacctggagatcacggcgcgacgggnacccagggacggttcttgcgaac

SEQ ID NO: 18503 - protein, 58 aa, Zea mays
  misc_feature: Ceres CLONE 1384703-F
MACYNTASLAATLLAFVLTFQACLAERRLTALVQEPAITMRYHKGALLSGTIAVNFIW

SEQ ID NO: 18504 - DNA, 811 bp, Zea mays
  misc_feature: Ceres CLONE 1384704-F
  misc_feature: Encodes the peptide sequence at SEQ ID NO. 18505
gctctagaactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtgggtgcatcatggtgggcgttcctcctgctcgccggcgtgctgctggtcgtagcagccacggccggggcggaggacggagtggtcgaacgggaccgcaaggaggacctgcggtggtgcaagcaggcgtgcgagtggcagtacggaaaggacaccccgcggaagagggaatgcgagagcgagtgccgcgagcggcaccagcaagctgacgcgggcgaggacggcgacagcggcgtgaacgcctacgtctcccgctccggaaaggggcgaagtgccggcgccagttgcctgcgccgccacgagggtcaggcgtggaagaccccagagtggcatgaggcggtgccgcccccgcggactggccgtcgacatggagacaagagtacggtcgcggcaagcgagagcgggggcaagtgcccgggaaaagtgcgagcgccccccacgggggggacctggggggggaaaaggcacggttgcctgagatgaacaaaaaaaaacgggtggggggtgaatacgaggagaggcgccctacggcgctcgcctcgccccggtcggccatattagggcgctgcagcggcgccggtaacgttttcccccctcgagcaacaacccc

SEQ ID NO: 18505 - protein, 165 aa, Zea mays
  misc_feature: Ceres CLONE 1384704-F
MGKGSVGASWWAFLLLAGVLLVVAATAGAEDGVVERDRKEDLRWCKQACEWQYGKDTPRKRECESECRERHQQADAGEDGDSGVNAYVSRSGKGRSAGASCLRRHEGQAWKTPEWHEAVPPPRTGRRHGDKSTVAASESGGKCPGKVRAPPTGGTWGGKRHGCLR

SEQ ID NO: 18506 - DNA, 731 bp, Zea mays
  misc_feature: Ceres CLONE 1384706-F
  misc_feature (324)..(324): n is a, c, t, g, unknown, or other
  misc_feature (332)..(332): n is a, c, t, g, unknown, or other
agagctggagctccccgcggtggcggccgctctagaactagtggatcccccgggctgcaggaattcgcacgagaccattacctagaacatcctaatcgaaaactaccgagttttccttccccacctccccgccccacccgtcgccgaatcggagtcccgctcgcgtccacccttgccagagctcaagagctacctcctggtccggttggacagatcccttcgggcgctgcgtccaccgggattcaggcaaagtggtgtaacataagatgcaagggggaagaggtgggaggcagggtttgttcggttttggggacccttttgttnggtttcgnccggctttgacagccagggaacataatgtccggtttcttggtggggaaatccctttgatgaccttttcctcacaacccctttgggtgaaatgaggcacctagttcttcaacccttttcgggggatggtggaacctaaacttctgaacccctttggaagatgggaggcaccctaacttggcttggataaaaaatggtttgggggcccccggggaaattcccaagggggggggcccttttttgggagaaaccccaaaaacacctttcccttttattaaaagaaaaaaaaaaaaaaaacccccggtggttgttttttttaaaaacccccccttttttaataagggggcgccctagggggggcccatatttatagagggggggggtgttctttttaaaaaaaa

SEQ ID NO: 18507 - DNA, 539 bp, Zea mays
  misc_feature: Ceres CLONE 1384713-F
  misc_feature (537)..(537): n is a, c, t, g, unknown, or other
ggagctccccgcggtggcggccgctctagaactagtggatcccccgggctgcaggaattccacgagaccattacctagaacatcctaatcgaaaaatcggcctcagtcgcacatatctactatactatactctaggaagcaaggacaccaccgctatggcagcaagatgcttgcattgttcgctctcctagctcttgtgcaagcgcactagtgcgaccctattcaggcacttgcacagtcatgcattgggtacatgaaccatgctgcagactgatgatgcacaggggcttgcagcttgtggggggccggccctgaggtggaaaaatggtgggctaccgtttaaaaaaggccggggtggtggcccaaaagtaggcccccaaaaggggggcccccttttggagtccccaaaaatttttccccccaagggggttttttccccaaaaaaaaatttttttcccccaaaaaaaagggggggtggcccccatttttttgtggggggcgcgccccccccccccaaaaaaaaatttttgttgggtnaa

SEQ ID NO: 18508 - DNA, 690 bp, Zea mays
  misc_feature: Ceres CLONE 1384715-F
  misc_feature: Translation starting site: 189
  misc_feature (309)..(309): n is a, c, t, g, unknown, or other
tggagctccccgcggtggcggccgctctagaactagtggatcccccgggctgcaggaattcgcacgagaccattacctagaacatcctaatcgaaaagatggtctcgtactcttgtcacgttccttcctgactgcccccacttctcctccggcggcgcggcggcgggttacctcccaacagcccgaccatggaagccgacatcgctttcaggtatgagatcccccggaccgcccagttcctccgcgacggcgcctacaccagggtcgcgctccagttccccgacgagatgctgaaagatgctgctgcgntggcgaaggcgttgcggcgggagctttgctccggcggcgccgacagtgggttagggtgttcgtgatggccgaccacgcgaacaactcctgctgcgtgaacgaggtgggccgcgtccaaatccatgggcaggggcgtggtcaactagggcaacgcctgcatgaacccaaaatcaatttggccagtttccttgtatttgggaagggccccgttgatggccccccatggggccggcacattgggtgagggggtccaggaaaaaaaaaaaacgcattttggggtttatttgggcaaaaaaaaccccattgggttgggggggcccctaaaaaaacttttttggggggcccgggaaaaaaaattttgggggaaaattgaggagcccg

SEQ ID NO: 18509 - DNA, 699 bp, Zea mays
  misc_feature: Ceres CLONE 1384716-F
  misc_feature: Encodes the peptide sequence at SEQ ID NO. 18510
  misc_feature (438)..(438): n is a, c, t, g, unknown, or other
  misc_feature (699)..(699): n is a, c, t, g, unknown, or other
tggagctccccgcggtggcggccgctctagaactagtggatcccccgggctgcaggaattcgcacgagaccattacctagaacatcctaatcgaaaaagtttcccggctccctcgctcacgcgccgcggcatcactccggccggctggccagtcgcccactcttcccacccacaccgccgctgcctttccttccacggcgaactctccgcgggcgacgtccagactggcaacggcattccaataaaagaatgcgcccctgctctggccaactctctccacctgcattccccgttccgctaaaccctagccgcctccggcgcgtagtagattcgccatcagagacgacgctcggcggccctgaggagggatgacctacgtcaacccagacccccagccgctcgccgccgctacggcggatgattccgcaacccagcatncagctgcggtgaccgccgcgccgcagtcgacgcgaggcgctctcgggttttttgcgacggcggagccgaaacagggcgcgaccatggtggcgccatcgtccccgcagggcagtccccggtttcgcggtcgtgccccaggcccagggggtcgagaaataagcgccccccgcgtccccgaaagccctcccggtttttgcgggacccccgggctcccgcacagcaaggtgctccgggaatggcgcgccgaaagtggtaacatgn

SEQ ID NO: 18510 - protein, 110 aa, Zea mays
  misc_feature: Ceres CLONE 1384716-F
  misc_feature (24)..(24): Xaa is any aa, unknown, or other
MTYVNPDPQPLAAATADDSATQHXAAVTAAPQSTRGALGFFATAEPKQGATMVAPSSPQGSPRFRGRAPGPGGREISAPRVPESPPGFCGTPGLPHSKVLREWRAESGNM

SEQ ID NO: 18511 - DNA, 729 bp, Zea mays
  misc_feature: Ceres CLONE 1384717-F
  misc_feature: Translation starting site: 500
  misc_feature (624)..(624): n is a, c, t, g, unknown, or other
  misc_feature (722)..(722): n is a, c, t, g, unknown, or other
tggagctccccgcggtggcggccgctctagaactagtggatcccccgggctgcaggaattcgcacgagaccattacctagaacatcctaatcaaaaaaaatcctccgaaccccgccgccgacgagcgagctatggcgctggcgcggcggctgctccgccttactccctacctcggcacgctctcgctcccaccccccaactcgcatctcctccggaatcgcacctatatctctgacatgcgccgctctgccttcgtcgaccgcttgctccgttccgtacgctccgagatctccttcctcgataactccgccccgtcaccgccaccaccgcctcctaagccattcaccattgaggaccgcccgggcgagcagtgcgcccgcctgcgccgcgtgttcctgcggcacgagaggacgaagaggaggacagggtgcacgccacgttggtcgacggtgcgatccctccatcccgttaggacgcggacacggtgggcccgcccagaatgcatatcagtgttaaggttgaggtactcaaggcgcgcgtcctgaagttgcgctcaccttcgagtgctccgcgtgacctgacgagatggaggtgtgcagggtctttctcgtacgccgcggtgtncctgccccagtgcaccaatcacgccgccgccaatgaggcttccaaagcacactgctacgctccgaagtaccaatcagcacggtggaaatcgatctcgnagttcag

SEQ ID NO: 18512 - DNA, 667 bp, Zea mays
  misc_feature: Ceres CLONE 1384718-F
  misc_feature (667)..(667): n is a, c, t, g, unknown, or other
gggctgcaggaattcgcacgagaccattacctagaacatcctaatcgaaaaaacagcgaacacatctgcttcgcatttcttcccatcccccttcgcaacccaaaccccaactcgctccgcatcgatggacgcccaagggacgagaagaagccccgcggatgaagaagccggcggaggaggagcccgcggttgaaaagggcgccgccgggtaaaaagccaaagcgggagaagggggtcccccgcttgggtaaagttttcctgtttaatttttattttttgtttttgtgggcgtcgcttccccgtggttagtgtcttctttttttttattttcttgtttcctggtgccgttagggggcgcaaaaaaagggggggcgggcttggggttaaaaaaaaacgggctcttcctctaatgggttcctgggtgtgcgctaagaacctctttccccgcggaggcttctttcaactattttttttttctccaagggggggggggtcgtctgacaaacccgcacgcggtggtggcccccccctcggttccctcttatttggggcgtctcttctccccccctccacccattagtgctctcccgggcggcgctcagattcctactttaggagagccttcccccctttcttctctctttcctgagaagtgattagcctattn

SEQ ID NO: 18513 - DNA, 705 bp, Zea mays
  misc_feature: Ceres CLONE 1384724-F
  misc_feature: Encodes the peptide sequence at SEQ ID NO. 18514
tggagctccccgcggtggcggccgctctagaactagtggatcccccgggctgcaggaattcgcacgagaccattacctagaacatcctaatcgaaaaatcttttctctctctctctctctctctctctctgatttcttctcttaactctcgcgtctcgagtccttttcccttcctcccctccgttgcgtccctccgtccgtccgtccgtcgtcaccagcctcctccctcgcgcccaccgccgggatccgtccctcctcgtctgcgcccgcctcggtctagatttctgagaaaatggcgagaagtgcgtcaactaggaggcgtgtggctcgccagctcaagtccacacatcccattccttcatatcgatggaagtcaaagcccatgaaaaagccgatgaaaaaatccaaccgaaagcaagtgttgccaaccttgcataagatggactgggaagatgccaattgctctgtgtgcatggaatacccacataatggtgtgctcatcctttgctcatcccatgataagggctgtcgtccttatatgtgtggaactagctaccgacactctaattgcttggatcagttcaagatagcttacaccaagggggcattgcttgaggaagttcctgcaaataatgttgtgtctaaactggattcggcgccattggctggcaaaaaaactgactccattgacctggcatgcccatg

SEQ ID NO: 18514 - protein, 137 aa, Zea mays
  misc_feature: Ceres CLONE 1384724-F
  misc_feature (52)..(137): Pfam Name: DUF1644 Pfam Description: Protein of unknown function (DUF1644)
MARSASTRRRVARQLKSTHPIPSYRWKSKPMKKPMKKSNRKQVLPTLHKMDWEDANCSVCMEYPHNGVLILCSSHDKGCRPYMCGTSYRHSNCLDQFKIAYTKGALLEEVPANNVVSKLDSAPLAGKKTDSIDLACP

SEQ ID NO: 18515 - DNA, 721 bp, Zea mays
  misc_feature: Ceres CLONE 1384727-F
  misc_feature: Encodes the peptide sequence at SEQ ID NO. 18516
tggagctccccgcggtggcggccgctctataactagtggatcccccgggctgcaggaattcgcacgagaccattacctagaacatcctaatcgaaaaacatcgacccagccatctcctcaccctcgttcaccacacagtccgccactcctttagtagcttgtgatttgtacgtcgacgagatcactggtcgggtggcggacgacgacacatggggaagggtagtgtggctgcatcatggtgggcgttcctcctgctcgccggcgtgctgctggtcgtagcagccacggccggggcggaggacggagtggtcgaacggtaccgcaaggaggacctgcggtggtgcaagcaggcgtgcgagtgatagtacggaaaggacaccccgcggaagagggaatgcgagagcgagtgccgcgagcggcaccagcaagctgacgcgggcgaggacggcgacagcggcgtggacgcctacgtctcccgctccggaaggggcgagtgccggcgccagtgcctgcgccgccacgagggccagccggtgagagacccaggaatgcatgaggcggtgccgccgccgcggactggccgtcgacatggagccaagagtacggttcgcgcagagagagcgcgagctagtgcccgggagaggtgcgagctccaccccgcggaggaacttggtggtagaggcatcgctgcctgatggatgaaaaaacccgaaaaccgggg

SEQ ID NO: 18516 - protein, 50 aa, Zea mays
  misc_feature: Ceres CLONE 1384727-F
MGKGSVAASWWAFLLLAGVLLVVAATAGAEDGVVERYRKEDLRWCKQACE

SEQ ID NO: 18517 - DNA, 745 bp, Zea mays
  misc_feature: Ceres CLONE 1384729-F
  misc_feature: Encodes the peptide sequence at SEQ ID NO. 18518
aagctggagctccccgcggtggcggccgctctagaactagtggatcccccgggctgcaggaattcgcacgagaccattacctagaacatcctaattgaaaaacagtaactagcagctagcacatcaaacaagtggcgacagacaaagatttgtgagggtgatccgcgctgagaagagatggctaagatcgccgcggcggcggcggcggcgctgtgcttcgcggccctggtggccgtggccgtctgccaaggcgaggtcgagcggcagaggctcagggacctgcagtgctggcaggaggtccaggagagcccgctcgacgcgtgccgccaggtcctcgaccggcagctaaccggcggcggcggcggcggcggcgttggcccgttccggtggggcaccgggctccggatgcggtgctgccagcagctccaggacgtgagccgcgagtgccgctgcgccgccatccggagcatggtcaggggctacgaggaggccatgccgccgctggagaaagctgtggcccctgggggggcgccagcagcagccgccgccgcagggagaaggatgaggacaggggggctactactacccctgcagccggccaggagagggatacggctactggtcaggggggccagcggcctatgaatcaaccgtgtcgtcccggtactcccggtggcgagccaaagatctggcgggtgaagcttacgaaggccaggaatacccccggggggttgccaatgacccg

SEQ ID NO: 18518 - protein, 155 aa, Zea mays
  misc_feature: Ceres CLONE 1384729-F
MAKIAAAAAAALCFAALVAVAVCQGEVERQRLRDLQCWQEVQESPLDACRQVLDRQLTGGGGGGGVGPFRWGTGLRMRCCQQLQDVSRECRCAAIRSMVRGYEEAMPPLEKAVAPGGAPAAAAAAGRRMRTGGLLLPLQPARRGIRLLVRGASGL

SEQ ID NO: 18519 - DNA, 721 bp, Zea mays
  misc_feature: Ceres CLONE 1384733-F
  misc_feature: Encodes the peptide sequence at SEQ ID NO. 18520
  misc_feature (699)..(699): n is a, c, t, g, unknown, or other
  misc_feature (721)..(721): n is a, c, t, g, unknown, or other
agagctggagctccccgcggtggcggccgctctagaactagtggatcccccgggctgcaggaattcgcacgagaccattacctagaacatcctaatcgaaaaagccatctcctcaccctcgttcaccacacagtccgccactcctttagtagcttgtgatttgtacgtccacgagatcactggtcgggtggcgaacgacgacacatgggtgaagggtagtgtgcgtgcatcatggtgagcgttcctcctgctcgccggagtgctgctggtcgtagcagccacggccggagcggaggacggagtggtcgaacgggaccgcaaggaggacctgcggtggcgcaagcaggcgtgcgagcgacagtacggaaaggacaccccgcggaagagggaatgcgatagcgagtgccgcgagcgacaccagtaagctgacgcgggcgagtacggcaacagcggcgtggacgcctacgtctcccgctccgggaggagcgagtgccggcggcagtgcctgcgccgccacgagggccagccgttggagacccagtagtgcatgaggcgatgccgccgccgcggactggccgactacatggagcaagagtacggtcgcggcatggagagcgcggccaagtgcctggagatgtgcgagcgccaccaccgcggggactggcgggagaggcagcgctgtctgatggactgcgaaancccgggagcggtaggactaggn

SEQ ID NO: 18520 - protein, 58 aa, Zea mays
  misc_feature: Ceres CLONE 1384733-F
  misc_feature (51)..(51): Xaa is any aa, unknown, or other
MRRCRRRGLADYMEQEYGRGMESAAKCLEMCERHHRGDWRERQRCLMDCEXPGAVGLG

SEQ ID NO: 18521 - DNA, 726 bp, Zea mays
  misc_feature: Ceres CLONE 1384738-F
  misc_feature: Encodes the peptide sequence at SEQ ID NO. 18522
  misc_feature (554)..(554): n is a, c, t, g, unknown, or other
  misc_feature (573)..(573): n is a, c, t, g, unknown, or other
tggagctccccgcggtggcggccgctctagaactagtggatcccccgggctgcaggaattcgcacgagaccattacctagaacatcctaatcgaaaaagggtttcgtcgcttccagccgccgccgcgtccgcctcgccaagcgcagcagccgccgcagcacatctctctctcgatctcagccatggcggaggtggagcagcaacaggacacgccgaagctgttcaaccgctggaccttcgatgatgtccaggtgaacgacatctcgctgaacgactacctcgctgtgaacgcgacgaagcacgcgatgtacctgccgcacaccgcggggcgttactccaagaagcggttccgcaaggcgcagtgcccgatcgtcgagcgcctcacaaactccctcatgatgcacgggcgcaacaacggcaagaaggtcatggctgtccgcatcatcaagcataccctggagatcattcacctgctcaccgatgccaaccccatccaggtcgtcgtcgacgcgatcatcaacagtggaccccgtgaggatgccacccgtattggntccgctggtgttgtgaggnaggcagccgtgaatatctcacccctgaggagggtgaaccaggcatctacctcctcaccactggtgcagggaagatgctttcggaaaatcaaaccaatgccgagtcctttgaaaagaactgatcacgctgccagggctcatccaacagtacgcg

SEQ ID NO: 18522 - protein, 181 aa, Zea mays
  misc_feature: Ceres CLONE 1384738-F
  misc_feature (44)..(175): Pfam Name: Ribosomal_S7 Pfam Description: Ribosomal protein S7p/S5e
  misc_feature (131)..(131): Xaa is any aa, unknown, or other
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEIIHLLTDANPIQVVVDAIINSGPREDATRIGSAGVVRXAAVNISPLRRVNQASTSSPLVQGRCFRKIKPMPSPLKRTDHAARAHPTVR

SEQ ID NO: 18523 - DNA, 698 bp, Zea mays
  misc_feature: Ceres CLONE 1384739-F
  misc_feature: Encodes the peptide sequence at SEQ ID NO. 18524
  misc_feature (330)..(330): n is a, c, t, g, unknown, or other
tggagctccccgcggtggcggccgctctagaactagtggatcccccgggctgcaggaattcgcacgagaccattacctagaacatcctaatcgaaaaaccaccaaaccaatcgctggatttgtccagagtatttccggtttcaccgccctagatctgacccgagacgccgcgtcttcgctgagatggcgattactgcgaggcgatcgacgatggtgcgcccggcgcgggagacgccgcggcagcgactgtggaactccaacctcgacctcgtgttgccgcgcttccacacgcccagtgtctacttctaccgccgcgacgccccgtggcgnatgcgaagggcttctcgactgcaagcgtatgcctgcgcgctggcatatgcgctcgtagccttctatccatggacggcccgctctctcgggaaggagaccgtatgctcgagatccactgcaatgccgaagcagtggtcttcctcgaggccaaagggcccgaatccctctgtcaatgacctacgggagcttcggccccaccctgggagtccaggggcctaatcccggaccgtcgattaaccccgaaaaaattcttggcctttctccgttacttggggttccagggggcttattttcgaaggggggggggggccccccttggtggtgtggaattaaaacccccttgtatggggaagggatttgtctttatt

SEQ ID NO: 18524 - protein, 121 aa, Zea mays
  misc_feature: Ceres CLONE 1384739-F
  misc_feature: SWISSPROT Homolog: EC 2.3.1.144 Anthranilate N-benzoyltransferase
MAITARRSTMVRPARETPRQRLWNSNLDLVLPRFHTPSVYFYRRDAPWRMRRASRLQAYACALAYALVAFYPWTARSLGKETVCSRSTAMPKQWSSSRPKGPNPSVNDLRELRPHPGSPGA

SEQ ID NO: 18525 - DNA, 710 bp, Zea mays
  misc_feature: Ceres CLONE 1384740-F
  misc_feature (616)..(616): n is a, c, t, g, unknown, or other
aaagctggagctccccgcggtggcggccgctctagaactagtggatcccccgggctgcaggaattcgcacgagaccattacctagaacatcctaatcgaaaaatcacacatattatctgagaccaactagcaacatagaaagcacaatagtgtaccaacaatgacagccaaaatattttgcctccttatgctccttggactttctgcaagcgctgctacggcgaccattttcccacaatgctcacaagctcctatagcttcccttcttccctcgtacctctcaccagcggtgtcttcggtatgtgaaaacccaattcttcaaccctacaggatccaacaggcaattgcagctggcatcttacctttatcacccttgttcctccaacaatcatcagccctattacagcagttacctttggtgcatttattggcacaaaacatcatggcacaaacaactacaagcacttgtgctagcaaaccttggtgcctactctcagaaacatcagtttcattcattcaacaactagctgcattgaactctgcttcgtatttgaacaacaacaactaccatttcggccggtatctgctgcctacccccataatttcttccattcancaactgacagcatttgactctcctggttatttcaggaggacaattactacctttcaccccctagctggggggagccctggtactttcttaccca

SEQ ID NO: 18526 - DNA, 701 bp, Zea mays
  misc_feature: Ceres CLONE 1384746-F
  misc_feature: Translation starting site: 149
  misc_feature (292)..(292): n is a, c, t, g, unknown, or other
tccccgcggtggcggccgctctagaactagtggatcccccgggctgcaggaattcgcacgagaccattacctagaacatcctaatcgaaaaatccaatccagatcagcaaagcggcagtgcgtagagaggatcgtcgaacagaacagcatgaagatggtcatcgttctcgtcgtgtgcctggctctgtcagctgccagcgcctctgcaatgcagatgccctgcccctgcgcggggctgcagggcttgtacggcgctggcgccggcctgacgacgatgatgggcgccggcggnctgtaccccctacgcggagtacctgaggcagccgcagtgcagccccgctggcggcggcgccctacttacgccgggtgtgggcagccgagcgccatgttccagccgctccggcaaccagtgctggcagcaagcagatgaagatgatggacgtgcagtccgtcgcgcaccagctggaaatgatgatgcaacttgagcgtgccgttgccgccagagcaagcctggaagagccaggtctgatgcagcagcacaagcagctgctggcagcccagggcctcaaaccccttggccatgatggaggcccaaaaaattgcccggccaaggggtggacttctaacagttaccagctggccccgttaccggaacaaacccctggggggggtcccccggtgcaatttccgcccctaaaaag

SEQ ID NO: 18527 - DNA, 712 bp, Zea mays
  misc_feature: Ceres CLONE 1384752-F
  misc_feature: Encodes the peptide sequence at SEQ ID NO. 18528
aagctggagctccccgcggtggcggccgctctagaactagtggatcccccgggctgcaggaattcgcacgagaccattacctagaacatcctaatcgaaaaaactgccggcgctctatcttccgctctctctcctactcgcgctcggcaaggcggcggcgccgctcaagctcgggctacggcgtcagcggcatcccctccgcctctcgccagtcgcctcgcgccctcgcctccggtcacaccggccggtgactctgctaaaaatggtgttcctttcaaatgaagacgcctggatccatgatgaagacatcatggatgatgctgatacagatgctgaagaatcagactcagaaggtgattcaggtgaagaagctcaggctaagcctgcagacaaagcgatatacaacaaggaggctattcttgaaaaacttgaagacatagcctggcccaagaatgtggactggatgcacaaactcactgttgagcatgatcaaggggagaaagttgatgtgaacgatgatcttgcccgcgaacttgcgttttacacccaagctttggatggcacaaggcaggcctttgataagctgcagtcgatgaaggtccggttcctcagatcaacagattactacgctgacatggagaagactgatgcacacatgcacaagatcaatggggaggtcgttgtcagaagactagacgattgaggaagctga

SEQ ID NO: 18528 - protein, 146 aa, Zea mays
  misc_feature: Ceres CLONE 1384752-F
  misc_feature (14)..(146): Pfam Name: Ebp2 Pfam Description: Eukaryotic rRNA processing protein EBP2
MVFLSNEDAWIHDEDIMDDADTDAEESDSEGDSGEEAQAKPADKAIYNKEAILEKLEDIAWPKNVDWMHKLTVEHDQGEKVDVNDDLARELAFYTQALDGTRQAFDKLQSMKVRFLRSTDYYADMEKTDAHMHKINGEVVVRRLDD

SEQ ID NO: 18529 - DNA, 639 bp, Zea mays
  misc_feature: Ceres CLONE 1384758-F
  misc_feature: Translation starting site: 299
tggagctccccgcggtggcggccgctctagaactagtggatcccccgggctgcaggaattcgcacgagaccattacctagaacatcctaatccaaaaaaacggtaaaggcacaacgaagaagagagatcaactactcatgcaagcactgcggtatttaatttagattcttaggaacaaaaacaccaagcaccaactttgtacatattaatggacgccatgcacatggtgatcgatcggtctatatagaaagacaggcgggtactagagaagttgtgtggtgtccaagctacacacgggatgctactaactagctgcaggcaagggcgaggaatggcaagcctttcatgtgctcgggcggacggtgttgtccgttccggcgctctgcccgccaagctgttgctgtgcgccagctgctgcttccctacggcggctccagtcgcggacggagaggtgcaggtgcttgcctgccgccagcatctccaccgcttgccgaggcgtcaggatctccgtcgccagcgcccgcgccgtcgccatcctcagctcgtcggcctccaccagcagccgcgacagcgcggccttgtagctgtccagcgccgcgtccacctcggcgtccgcggctcctagccgggccgccctga

SEQ ID NO: 18530 - DNA, 634 bp, Zea mays
  misc_feature: Ceres CLONE 1384759-F
  misc_feature: Translation starting site: 180
  misc_feature: SWISSPROT Homolog: EC 2.5.1.47 Cysteine synthase
tccccgcggtggcggccgctctagaactagtggatcccccgggctgcaggaattcgcacgagaccattacctagaacatcctaatcgaaaaacgctcgtctgtgtctgcctactccctcctccggctcccgcgaagcgactccaagaagcagcaggagcgtcgagctcgagcagcagccatggatggcgaggaggttggcaggaggggtattcctactctgctgaagccgtcttcctcctccagcgatggcagtgccggggaacaagagcacatcgcttctgacgtcactcaggtgctaccctctcttgccacccaacctttttggctctaatctcctccctgctcccgtttgttgctgctgctactagtggttgaattagagatttgactgttcttgcgcaacggtttccctcagctcataggatggacgccgctggtcgaattgaagcgaatcgccagcgaggctgggatcgatgcgcggatcgtcggcaagatggaggcttaccagccactttgctccatcaaggaccgctctgctttgagaatgatagaggatgccaggagaggggattgatttcgcctggagtcacaacgctggtggagccgacgagtggtaacatgggggttagggtt

SEQ ID NO: 18531 - DNA, 682 bp, Zea mays
  misc_feature: Ceres CLONE 1384774-F
  misc_feature: Encodes the peptide sequence at SEQ ID NO. 18532
  misc_feature (52)..(52): n is a, c, t, g, unknown, or other
  misc_feature (250)..(250): n is a, c, t, g, unknown, or other
aaagctggagctccccgcggtggcggccgctctagaactagtggatcccccngggctgcaggaattcgcacgagaccattacctagaacatcctaatcgaaaagtccacctcagctcccatatccgctcccctacctctccagcatctcccgtctccgtcgtctcgtctccgctcctcacctcgccagccatgggcaagatcaagatcggaatcaacggtttcggaaggatcggcaggctcgtggccagngtcgccctgcagagcgaggatgtcgagctcgtcgccgtcaacgaccccttcatcaccacggattacatgacctacatggtcaagtacgacaccgtgcacggccaatggaagcacagcgacatcgccctcaaggactcgaagacgcttcctctcggggaagagccggtaccggtctttggaatcaggacccccgaggaaacccctggggtgagggtgggggttaaatatgccgggaaccccccgggggctttcctggaaaagaaaagggttgtgccattttaaggggggggcccaaaaaagggtttttcctccccccaaaaaaatgccccccgggtttgtttggggaaaaaagaaaaaaaaccccccccgggaggaaaagttgttccggggggggggggcacaaaaaggggggtgccccccctgggaaaaaat

SEQ ID NO: 18532 - protein, 113 aa, Zea mays
  misc_feature: Ceres CLONE 1384774-F
  misc_feature (4)..(99): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (20)..(20): Xaa is any aa, unknown, or other
MGKIKIGINGFGRIGRLVAXVALQSEDVELVAVNDPFITTDYMTYMVKYDTVHGQWKHSDIALKDSKTLPLGEEPVPVFGIRTPEETPGVRVGVKYAGNPPGAFLEKKRVVPF

SEQ ID NO: 18533 - DNA, 623 bp, Zea mays
  misc_feature: Ceres CLONE 1384783-F
  misc_feature: Encodes the peptide sequence at SEQ ID NO. 18534
  misc_feature (475)..(475): n is a, c, t, g, unknown, or other
  misc_feature (559)..(559): n is a, c, t, g, unknown, or other
  misc_feature (561)..(561): n is a, c, t, g, unknown, or other
tccccgcggtggcggccgctctagaactagtggatcccccgggctgcaggaattcgcacgagaccattacctagaacatcctaatcgaaaaaaaagcaaattgacaccttctccgttcccgacgactcccgtgagcgtggagcggcgactaggcgaggccatggcctccggcatcggctccggccagcagcaacccccagcgccggcggcagatgctgacccgggagccgtcggcgacaagctcgtcttcgaagcgccgcctcagcccgtgagggaggactacgtccagaacgccgtcaagtttctctcccaccccaaggtcaggggctcccccgtcgtctacaggcgatccttcctcgagaagaagggccttagcaccgaggagatcgacgaggccttccgaagggttcctgatcctcaacccagcactacggctaccacttctccgcagcagcaggtcaacagccagaatcanttccgtcggggtgcaagcttatgcgccagcacaacctgtgcacccagcaaacgctgggccctgtcgtccttccacgcagcccangntttagctggtaccaagcattcctgctgcgggctcttggcgttttgggttttgtgcttagcgc

SEQ ID NO: 18534 - protein, 154 aa, Zea mays
  misc_feature: Ceres CLONE 1384783-F
  misc_feature (37)..(154): Pfam Name: Pex14_N Pfam Description: Peroxisomal membrane anchor protein (Pex14p) conserved region
  misc_feature (105)..(105): Xaa is any aa, unknown, or other
  misc_feature (133)..(133): Xaa is any aa, unknown, or other
  misc_feature (134)..(134): Xaa is any aa, unknown, or other
MASGIGSGQQQPPAPAADADPGAVGDKLVFEAPPQPVREDYVQNAVKFLSHPKVRGSPVVYRRSFLEKKGLSTEEIDEAFRRVPDPQPSTTATTSPQQQVNSQNXFRRGASLCASTTCAPSKRWALSSFHAAXXLAGTKHSCCGLLAFWVLCLA

SEQ ID NO: 18535 - DNA, 678 bp, Zea mays
  misc_feature: Ceres CLONE 1384789-F
  misc_feature: Encodes the peptide sequence at SEQ ID NO. 18536
  misc_feature (483)..(483): n is a, c, t, g, unknown, or other
  misc_feature (510)..(510): n is a, c, t, g, unknown, or other
  misc_feature (551)..(551): n is a, c, t, g, unknown, or other
  misc_feature (566)..(566): n is a, c, t, g, unknown, or other
  misc_feature (599)..(599): n is a, c, t, g, unknown, or other
  misc_feature (678)..(678): n is a, c, t, g, unknown, or other
tccccgcggtggcggccgctctagaactagtggatcccccgggctgcaggaattcgcacgagaccattacctagaacatcctaatcgaaaaagcacaagaacactcctagctagctgaagatctcgagtgcaacgcaacgttggcgcttggcggccagtagtagcagctaatttagcgtcgctccttcctagacgagagatcgagaaaccatggccaagctccaagtcactcctggcgccgcgttcaccgagtgcaatgaactcaacttccagggcctgtacctgtaccacacgcccctgggccccaaggccaaccaagctgcgatcgtagagagcaaggccaagatcggcatcggtgccaccgtggttaacaactgggcagtgtatgacgggccagggccaggcgctaagctcgtcggccgtgcgcagggcttgcacatcctagccggcaactgggtcaactcattcaccctggtgttcgangatgaaagggttcagtgggtccacgcnttgaagtggggggcataacggttgaaactggcgaggtgggncttggttgttggggncacccggccagtttggctatggcgaacggatcntcctctccaagaagttcccacgagcagagaagcggacgggaacgtcattaaagagcttaagtgtccatgcattctgccn

SEQ ID NO: 18536 - protein, 105 aa, Zea mays
  misc_feature: Ceres CLONE 1384789-F
  misc_feature (91)..(91): Xaa is any aa, unknown, or other
MAKLQVTPGAAFTECNELNFQGLYLYHTPLGPKANQAAIVESKAKIGIGATVVNNWAVYDGPGPGAKLVGRAQGLHILAGNWVNSFTLVFXDERVQWVHALKWGA

SEQ ID NO: 18537 - DNA, 654 bp, Zea mays
  misc_feature: Ceres CLONE 1384791-F
  misc_feature: Encodes the peptide sequence at SEQ ID NO. 18538
  misc_feature (367)..(367): n is a, c, t, g, unknown, or other
  misc_feature (389)..(389): n is a, c, t, g, unknown, or other
  misc_feature (416)..(416): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (561)..(561): n is a, c, t, g, unknown, or other
  misc_feature (587)..(587): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
gaagctccccgcggtggcggccgctctagaactagtggatcccccgggctgcaggaattcgcacgagaccattacctagaacatcctaatcaaaaatcggtgtgcttatgcgtaagttcgtgcatcggcgcacgtatggctcctaacacctccttgctcgtgctcctcttcctcctgcccgccgccgccaccgccgccgcaccggctaccggcaacaccgccttcaacgtgacggagatcctcggccggtacccggagttcaagctcttcaacctcctgctctccaagacccgcgtcgcgcgcgaggtcaacagccggagccccgtgaccgtgctcgtccgaaaaaattccgggcggtgggactggnctcctccgccgcagcgccaggnctgccgcgcgccggcgcttcgtggagnctccgtctccgtgcacgcgtcgcgctggactaacatcgacgcgggccaaagctgggcgtcgcctggccccggggccaggccccaccgtggnnnaccaccgctgttccagacccaccggggaagcgcgctcggcccccaacggggntccctgaacgtccccgcccccggggnggggggggggnnncaaaagccctttttctgtttcggccggggcgggggtttcttttgttcaacccca

SEQ ID NO: 18538 - protein, 173 aa, Zea mays
  misc_feature: Ceres CLONE 1384791-F
  misc_feature (78)..(78): Xaa is any aa, unknown, or other
  misc_feature (85)..(85): Xaa is any aa, unknown, or other
  misc_feature (94)..(94): Xaa is any aa, unknown, or other
  misc_feature (125)..(125): Xaa is any aa, unknown, or other
  misc_feature (151)..(151): Xaa is any aa, unknown, or other
  misc_feature (155)..(155): Xaa is any aa, unknown, or other
MAPNTSLLVLLFLLPAAATAAAPATGNTAFNVTEILGRYPEFKLFNLLLSKTRVAREVNSRSPVTVLVRKNSGRWDWXPPPQRQXCRAPALRGXSVSVHASRWTNIDAGQSWASPGPGARPHRGXPPLFQTHRGSALGPQRGSLNVPAPGXGGGXQKPFFCFGRGGGFFCSTP

SEQ ID NO: 18539 - DNA, 677 bp, Zea mays
  misc_feature: Ceres CLONE 1384799-F
  misc_feature: Encodes the peptide sequence at SEQ ID NO. 18540
  misc_feature (315)..(315): n is a, c, t, g, unknown, or other
  misc_feature (414)..(414): n is a, c, t, g, unknown, or other
  misc_feature (424)..(424): n is a, c, t, g, unknown, or other
  misc_feature (458)..(458): n is a, c, t, g, unknown, or other
  misc_feature (468)..(468): n is a, c, t, g, unknown, or other
  misc_feature (498)..(498): n is a, c, t, g, unknown, or other
  misc_feature (505)..(505): n is a, c, t, g, unknown, or other
  misc_feature (531)..(531): n is a, c, t, g, unknown, or other
ggagctccccgcggtggcggccgctctagaactagtggatcccccgggctgcaggaattcgcacgagaccattacctagaacatcctaatagaaaaactgccaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgnaggccggcagcgtcctccgcgccgcgctgtggctccctggtccgtgccgtttcgtctacgtcacctacgccttcttctcccgagtcgctggcctcagcnaacgctgggntacatcttcccgtggcgggggctcaaggtgcgancaatcctagnatggtgggcgcgctccgtggctccccaggnttctagnccgggcgacgtgcacccggagaggcntggaaggggtgttcagcttccttcggcagggcgctacgtcgtcacggccagccccaggggtcatggtcgagcccttcgccagggccttcctaggcgccgacaaggtcgtcgggaccgagctggaggtcggcagggacggcaaggcc

SEQ ID NO: 18540 - protein, 167 aa, Zea mays
  misc_feature: Ceres CLONE 1384799-F
  misc_feature: SWISSPROT Homolog: EC 2.3.1.15 Glycerol-3-phosphate O-acyltransferase
  misc_feature (47)..(47): Xaa is any aa, unknown, or other
  misc_feature (80)..(80): Xaa is any aa, unknown, or other
  misc_feature (95)..(95): Xaa is any aa, unknown, or other
  misc_feature (98)..(98): Xaa is any aa, unknown, or other
  misc_feature (108)..(108): Xaa is any aa, unknown, or other
  misc_feature (110)..(110): Xaa is any aa, unknown, or other
  misc_feature (119)..(119): Xaa is any aa, unknown, or other
MVASPRFKPIEECCSEGRSEQTVAADLDGTLLISRSAFPYYLLVALXGRQRPPRRAVAPWSVPFRLRHLRLLLPSRWPQXTLGYIFPWRGLKVRXILXWWARSVAPQXSXPGDVHPERXGRGVQLPSAGRYVVTASPRGHGRALRQGLPRRRQGRRDRAGGRQGRQG

SEQ ID NO: 18541 - DNA, 677 bp, Zea mays
  misc_feature: Ceres CLONE 1384803-F
  misc_feature (440)..(440): n is a, c, t, g, unknown, or other
tccccgcggtggcggccgctctagaactagtggatcccccgggctgcaggaattcgcacgagaccattacctagaacatcctaatcgaaaaaattccccattcaccaatccccagtattgtagtaggggggaaaaacgagagaaaagaaacagcagtagcggaggcaatacgaaatggtggccgccgtcgcgtcgccttcgtcggcggcaccctccgccggccgtccccatccgacatacaaggagatgatcatgcaggcgctgacggagctgcgggacccgagcgggtcgagccgcagcgccatcgccagctacatcgccgaccacttctccggcctccactcgcgccacgatgccctcctctccgtccatctccgcagcctcaagtcccatggccaacttcgcctcgtctctggcaactacttcgtctccaccgccgnctcagcggcaggggcgaggctccaacatcccgcccaaccccaaccctgcttccggggcagaagccgtgggtcgggggcggcctcgcaagtacgcagattcagccccttccgtcccgaccccggggcgtttcaggcggccaaggggaaggggcgtgggacgcccacgcaaacgcaagagcgcccaagggacccgggtggcttcctccccctccccttcgccgctacagggggaagcaa

SEQ ID NO: 18542 - DNA, 557 bp, Zea mays
  misc_feature: Ceres CLONE 1384805-F
  misc_feature (152)..(152): n is a, c, t, g, unknown, or other
  misc_feature (197)..(197): n is a, c, t, g, unknown, or other
  misc_feature (207)..(207): n is a, c, t, g, unknown, or other
  misc_feature (220)..(220): n is a, c, t, g, unknown, or other
  misc_feature (225)..(225): n is a, c, t, g, unknown, or other
  misc_feature (226)..(226): n is a, c, t, g, unknown, or other
  misc_feature (241)..(241): n is a, c, t, g, unknown, or other
  misc_feature (252)..(252): n is a, c, t, g, unknown, or other
  misc_feature (320)..(320): n is a, c, t, g, unknown, or other
  misc_feature (488)..(488): n is a, c, t, g, unknown, or other
ccccgcggtggcggccggctctagaactagtggatcccccgggctgcaggaatcgcacgagacattacctagaacatcctaatcgaaaaactactacatcagtccaccgccaccgcgcaccgcgagtccgcgacagacatccgcgccccggnctcactctcactccccaccgtgccgccacaagcggcgcgacgcanccacgcaggnagagggaaatggncacgnncgcgactggccacgncggggagtaanaagcagcccgtgctgctgctgctctccccctggcgctggcgctggcgctggcggcctccggggccggngggggggggggatgggcacttcccggccgggttaaatttcggggaccccaatcgggaaacgggggggcctggaattcgtctttcgggggccgaaccggcgccaaggggggggaaccttttttggggagggccccccgggccgttaaagggggagggggggcccccccnaaattaaatttttagctttaaaaacccgggggggtaatccccccccggggggcaccaaaaacctcatgg

SEQ ID NO: 18543 - DNA, 628 bp, Zea mays
  misc_feature: Ceres CLONE 1384806-F
  misc_feature: Translation starting site: 207
  misc_feature: SWISSPROT Homolog: EC 5.3.1.1 Triose-phosphate isomerase
tggagctcaccgcggtggcggccgctctagaactagtggatcccccgggctgcaggaattcgcacgagaccattacctagaacatcctaatcgaaaacttaaagcacgcgcgcgccctgtgctccccctcagtcctcgctagtcctttctccatcacaaacgctattcttttttccctaaagctcggagaccgccggaagcgagcgatggcgtgcaagaccaagagcctgctgttggcgctcagcgtggcggcgctgctcgaggtgcagtcgcactcccacggcctgggggacttcacgagcgggagcggtgaggcgacgacgacgccggagatgcagaccttcttcaagccccaggccgctgcggcgctcccggaggccctcgacgcctccatgcccgccaagccggaggcggcggcggcggctctcccgaccacgacaagggccggcacggcgccgtcagccacgacgggacaggacgtgtccgtgaacgccggagtgtgctgcagacaaggtagcctatgcccttgctcaaggtctgagggtgattgcttgtgtgggcgagactcttgagcagcgacaggctggctccaccatgcatgttgtgggtgcccagactacagctattg

SEQ ID NO: 18544 - DNA, 642 bp, Zea mays
  misc_feature: Ceres CLONE 1384816-F
  misc_feature (450)..(450): n is a, c, t, g, unknown, or other
  misc_feature (526)..(526): n is a, c, t, g, unknown, or other
  misc_feature (531)..(531): n is a, c, t, g, unknown, or other
  misc_feature (599)..(599): n is a, c, t, g, unknown, or other
tccccgcggtggcggccgctctagaactagtggatcccccgggctgcaggaattcgcacgagaccattacctagaacatcctaatcgaagtatctgaccacgtcacacgacaccaccaccagccctccccttcatcaattggagcacggcgcccgttcattcccctcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttcctcctgcgtcgcccacctccgctgctgctgtcgcgtagttggctgccgttgttgaagacgcgaagcctctttaggggttcgcgatttctccgctggatcggttcgagaaattggtaagctatggnatctctcgcggccccacatcgtcggaccctctcgctcgggctccactctcacggtcacgcccacgccaacgctcgnaaggnacgcggtagccgcgccgctgcgcctgtccgacgaacgcggaggagcgaagccggaaccgcgtcggggnccggagaggcgaacgcggagagggaagaacaaggaacgggggg

SEQ ID NO: 18545 - DNA, 635 bp, Zea mays
  misc_feature: Ceres CLONE 1384823-F
  misc_feature: Translation starting site: 259
  misc_feature (443)..(443): n is a, c, t, g, unknown, or other
  misc_feature (458)..(458): n is a, c, t, g, unknown, or other
  misc_feature (516)..(516): n is a, c, t, g, unknown, or other
aagctggagctccccgcggtggcggccgctctagaactagtggatcccccgggctgcaggaattcgcacgagaccattacctagaacatcctaatcgaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactggctcgagcacggcatccagcctgatggccaagtgcctggagataagaccgcgggacatcacgatgatgccttcagcaccttcttcagccagactggtgctggggaagcacngtccccgtgcaatcnttcgtgatctagaacccactgtgatcgatgaggtgcgcactggggacgtacccgcagntccttccaccctgagcaggtcatcagggggcaaggaggatgccggtaaaaatttcggcccggggccctaaccaaatgggaagggaaatgggtggaactggggccttgaccggatcccaa

SEQ ID NO: 18546 - DNA, 674 bp, Zea mays
  misc_feature: Ceres CLONE 1384826-F
  misc_feature: Translation starting site: 187
  misc_feature (248)..(248): n is a, c, t, g, unknown, or other
  misc_feature (674)..(674): n is a, c, t, g, unknown, or other
ggagctcaccgcggtggcggccgctctagaactagtggatcccccgggctgcaggaattcgcacgagaccattacctagaacatcctaatcgaaaaaaaccctaaccccatcccgcactccccccctcccccaacacgcgcgtgctttcttagccgctaagcatatccctccccgccacgatctcgatggtggagatgtctgtggtggagctcaggacgctgccgctcggcttcccgctccaccccancgacgaggagctcgtcaccactacctcaaggggaagatcaccggcaggatcaactccgaggtcgaggtcatccccgaaatcgacggctgcaagtggcagccgtgggaactcccaaataaagccctgggaccgggccgacgatacttggggggggtttctttcgccccccaggggccggaaggaacccccacggggaggagggggcaaagggggcccccggggggggggtactgggaaagggcttggggaggggcggggaaattcaaatccccgggggggcaaaagggccaacaaaataatacttgggggtgagaaaaaaaccccccgttttctcccccggggggggggccccccacaggggaaaggcccgggggcgggctttaattatattataaacctccccaccccaccccctggtgttatccn

SEQ ID NO: 18547 - DNA, 621 bp, Zea mays
  misc_feature: Ceres CLONE 1384827-F
  misc_feature: Encodes the peptide sequence at SEQ ID NO. 18548
  misc_feature (477)..(477): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (538)..(538): n is a, c, t, g, unknown, or other
  misc_feature (539)..(539): n is a, c, t, g, unknown, or other
  misc_feature (567)..(567): n is a, c, t, g, unknown, or other
tggagctccccgcggtggcggccgctctagaactagtggatcccccgggctgcaggaattcgcacgagaccattacctagaacatcctaatcgaaaaacgaagagcagcagcagacacctccgccacctccaccctcgaatcgttccccaccatggcgtcgcagggatcctccgtcttcgccgcactcgagcaggccccggaggaccccatcctcggagtgaccgttgcctacaacaaggatcccagccccgtgaaggtcaacctcggggtcggcgcctaccggaccgaggaagggaagcccctagtgctgaacgtggtcaggcgcgcccgagcaaaatgggtgagttaaaaaaaaattccccccccgggggggaggagagggaaaaaaccccaccaacacccgcgggggggggggggggaggattaaaaaaaaaggggggggggggggggggtgtttttttttttttttttttttngcnnncgccccgcccccccccccttcttttttttaaaaaaaaaaagaagaaggagaggggnncccgccgcgcgccgcgcccccccccacnttttttttttattttttttaaaaaaagagggggagtgttttttttcttttcccc

SEQ ID NO: 18548 - protein, 65 aa, Zea mays
  misc_feature: Ceres CLONE 1384827-F
  misc_feature: SWISSPROT Homolog: EC 2.6.1.1 Aspartate transaminase
MASQGSSVFAALEQAPEDPILGVTVAYNKDPSPVKVNLGVGAYRTEEGKPLVLNVVRRARAKWVS

SEQ ID NO: 18549 - DNA, 669 bp, Zea mays
  misc_feature: Ceres CLONE 1384828-F
  misc_feature: Encodes the peptide sequence at SEQ ID NO. 18550
tggagctccccgcggtggcggccgctctagaactagtggatcccccgggctgcaggaattcgcacgagaccattacctagaacatcctaattcgaaaagtaccaccgtgacagttctattaacttgacgagacaaaaggggggaaagttctgctcctacgatcctacctccagtgatgtcagcaccaccgctggccggcggcggcgccatcatcaatgaggtcctcaccgatgacgagctacgcgcagtgctcaggcggctggggcccgaggcggagcgggacgcgtcgggctcgtgtgccgcgctggctccggatccagagctccgagcggcggcgcctgcgcgcgcgcgccggcccggacatgctgcgccgcctcgctgcacgcttccctggaagcctggatctcgacctctctcagtcgccttcccgctctttctaccccgggggcatcgaagacgacctcaacgttattggcccggagtttccgaaccctggggggcctccggcgggagaatggaaggggatctctggaggcgcggggtgccacaaggggaaatggaatggccttctcgggagcccctgaggggcccccgtgccgataagaggggcagacaaagggtgtttacgccgttgctacaaagcgggacaaaataccagcccccgaaaaa

SEQ ID NO: 18550 - protein, 117 aa, Zea mays
  misc_feature: Ceres CLONE 1384828-F
MTSYAQCSGGWGPRRSGTRRARVPRWLRIQSSERRRLRARAGPDMLRRLAARFPGSLDLDLSQSPSRSFYPGGIEDDLNVIGPEFPNPGGPPAGEWKGISGGAGCHKGKWNGLLGSP
